United States Patent 8,344,211 (PLANT NUCLEOTIDE SEQUENCES AND CORRESPONDING POLYPEPTIDES) - sequence listing, part 11

SEQ ID NO: 41114 - DNA, 824 bp, Zea mays
  misc_feature: Ceres CLONE 1435709-F
  misc_feature: Encodes the peptide sequence at SEQ ID NO. 41115
  misc_feature (31)..(31): n is a, c, t, g, unknown, or other
  misc_feature (32)..(32): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
gtttgctgggctctcttctcccctggctttnntttaggnaaagnncgaaactggagctccccgcggtggcggccgctctattttagtggatcccccgggctgcaggaattctgtacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggagcgaccgccggggcaagtgccaccgttgccttcagcaacggctacagcaacgcggcggcgctgctgacaacgccagcatcggcgtccccggggcagctgaacggcatcatccagtgccttatgggctgatatacgcaggtgttcggatgttccatttggatggaagggaaacccaggcgcctgagggggcgggtgtggctcatcacgctgcgaccagaaagagcggcgtgttgacggggcacactgagggcactggcgccatcacactcattgtgcggatgtcggtccaaagacccaaacaaaccaaacaacaaaggcccctcccaagccacaaaggcggaccaggtcccggcccttacacccccgccctttaaccttataccatgctcgtgttgcgggggacgtactttctgctttcgaaccggtgcgcaagcttgtgcaccggctcggcccacacaagcctggatcccagcgctaccaaggtataatataacaataaagagccaaggggacagcgggacgcaaatcg

SEQ ID NO: 41115 - protein, 68 aa, Zea mays
  misc_feature: Ceres CLONE 1435709-F
MAAAMTGSARASTGSLLVLLFVALAGATAGASATVAFSNGYSNAAALLTTPASASPGQLNGIIQCLMG

SEQ ID NO: 41116 - DNA, 670 bp, Zea mays
  misc_feature: Ceres CLONE 1435710-F
  misc_feature: Translation starting site: 332
aagctggagctccccgcggtggcggccgctctagaactagtggatcccccgggctgcaggaattcgcacgagaccattacctagaacatcctaatcgaaaaagaaatccatcccgatcctatcgtccccaatttcttctgctccacctaaatagatccgtagccgtagcctaggcgcgcacattgcagaaagatcgagcgaaaggtcggcagcaggcgcatagatgcaggggtgagggcacgggcggcagcgcttgacgggcgacgagtaaaccctaacgctttgattgcgggcggcgtcgtctgagccagtcccgagtcgatacgctgtcatgcctgtcaatcctcctccgccacctcctgggtcgtcgtctttggctccggcgggggccagctacttcccgctccctttccacctgcagcagcaccagccgccgccgccgcaggtgccgccgcctatggcggcaagcagctatcaacactatcgggaacggcttggtcaggcccatcggctggtccaacattgacactcatcaccgaccggcccctggagatcatgatgaatgagtccacgcactcgaagaaagagtatcctgacaggatacttatcggtccaattatggaggagtacaacaaagctgcatggcatgagcttattgaacgtgttgaag

SEQ ID NO: 41117 - DNA, 593 bp, Zea mays
  misc_feature: Ceres CLONE 1435711-F
ggagctccccgcggtggcggccgctctagaactagtgggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatgggcggatgaaaactacgctcaacgtctggtgggtcagaaagtttccatggggccagttccccttggcttgtttgaaaccaaaaaaattcccttttttccttttttccccccaaaaaaaaaccacccctgggtttttaaaaagaggtccttttttttttttaaaaaaggggcccccagagttttttggggggaaaaccccgggggggtcccttctttgtgggggccccctcttttttttttttttcccccaaaaaaaagaaaattttttttaataaaaccccccccccttggggggggggggggatcccttccccctctcccccaccaccccccc

SEQ ID NO: 41118 - DNA, 817 bp, Zea mays
  misc_feature: Ceres CLONE 1435714-F
  misc_feature: Encodes the peptide sequence at SEQ ID NO. 41119
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
nccccnnnnnnnnnnnnnnnnnnnnnnnnnnnggtcgggtantgtttacnnnntnaaaactggagctccccgcggtggcggccgctctatactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgccctgattgaaccaactagcggcaacacaggcattggactggcctttatggctgctaccaagggcttacaacttaccctcccaatgcctgcctccatgagcctggaggaggaggatcatatttgaaggtttttggtggttgaactttggcccttactggaccccactctttgggaaaaggaaaggaccttgtccaaaaaagcgcgggatgaaatattcaaggccaaaagacacccccaacctcgggatactttttcttcaaacaaaatttggaaaaaattccccaggctaaaacccccaaaaagaattctccccttatgtgaaaaaactttcccggtggggccccg

SEQ ID NO: 41119 - protein, 112 aa, Zea mays
  misc_feature: Ceres CLONE 1435714-F
  misc_feature: SWISSPROT Homolog: EC 2.5.1.47 Cysteine synthase
MGEASPSIAKDVTELIGNTPLVYLNKVTDGCVGRVAAKLESMEPCSSVKDRIGYSMITDAEEKGLITPGVSALIEPTSGNTGIGLAFMAATKGLQLTLPMPASMSLEEEDHI

SEQ ID NO: 41120 - DNA, 682 bp, Zea mays
  misc_feature: Ceres CLONE 1435716-F
  misc_feature: Encodes the peptide sequence at SEQ ID NO. 41121
ggagctccccgcggtggcggccgctctataactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagcttgaagagatgcgtactgctcatgttgtctcaattggctcagaatcattctgtgacttgaatcctcattacaaagcaggaagaaaaactgagtttaccttggatactcgaacaagtttggcactttttgggtctttcagctgcaactgattatgtggcttcgcggagtataacgagcacgataatgcattatcgggtgggagcttgtggggagggtcaatggcgtagggactcctacggctggcattggggggtgcggaggggccgtcgaagtggggttgaagttggatagattgacagttatgttttgtggcg

SEQ ID NO: 41121 - protein, 46 aa, Zea mays
  misc_feature: Ceres CLONE 1435716-F
MRTAHVVSIGSESFCDLNPHYKAGRKTEFTLDTRTSLALFGSFSCN

SEQ ID NO: 41122 - DNA, 708 bp, Zea mays
  misc_feature: Ceres CLONE 1435718-F
ggagctccccgcggtggcggccgctctagattagtggatcccccgggctgcaggaattctcacgagaccattacctagaacatcctaatcaaaaaaaaaaaaaccatagccgccgcgccaccccgactcccaagaggtcctaccctcccccaccactgcagatccatcccggcgggcccaagaattgcagagaggataaagttgattggcgacaacccgattccggtaccccctcaaggggccactgcaatggtcaaggtggccctgttcggcggcgcagccttgtactctgacttgaacatcctctagaagggcaagggatgggcacctttctatctacttccaccgcatccagcggatctagtgagtggtataccccgaacggactcactttgtgataccctggttgttaccaccaatcatgtatgaattccgagctcaacctgaatctaggtgatgagactttctgggagtctggatctttcggatggaggaaaatatgggctccgagacctcaccaagccgatcccagaaaggaccacgaatatctacatacactagggaacaaaacttcataggaagaggtttagctttcatcattcctacaagcatgaaattcgttggtggcctcagatagggctggtcagaatgattacccaaaaccgggacgcttggaattgaaataaccaagaataagactggaaaggc

SEQ ID NO: 41123 - DNA, 729 bp, Zea mays
  misc_feature: Ceres CLONE 1435726-F
  misc_feature: Encodes the peptide sequence at SEQ ID NO. 41124
  misc_feature (397)..(397): n is a, c, t, g, unknown, or other
aagctggagctccccgcggtggcggccgctctagaactagtggatcccccgggctgcaggaattcgcacgagaccattacctagaacatcctaatcgaaaattttcaagctctcctcccctcttcctaccattagcagtagccacagccagaacaccagcagacagcagcatcatcagggaggaacacgatgagcggagccggtccggatctgcaactgccaccggggttccggttccacccgacggacgaggagctggtgatgcactacctctgccggcgctgcgccgacctggccatctccgtccccatcatcgccgagatcgacctctacaagttcgacccatggcagctcccaaggatggcgctgtacggcgagaaagagtggtacttcttcntcccgcgggaacagcagtacgcgaaacggtccagcccaatcgcgccactggggctggtactggaaggccacgacccttacaagcccgtgggcagcccaagcagctggcctcaaaaacggcctggtcttctaccccggaatgggcccagggccaaaaaaaccactggatcaggcaaaataaaccgcttcgcgacttcaaccgtttgggcccaaaaaaaacccccctggggtggaggaaggggcccgggcgcccttctccaaaaaaaaggcgcccgggttgaaaaaaggcccccggttttgggcccaccccaaatcctttttccccggccgggt

SEQ ID NO: 41124 - protein, 180 aa, Zea mays
  misc_feature: Ceres CLONE 1435726-F
  misc_feature (10)..(133): Pfam Name: NAM Pfam Description: No apical meristem (NAM) protein
  misc_feature (70)..(70): Xaa is any aa, unknown, or other
MSGAGPDLQLPPGFRFHPTDEELVMHYLCRRCADLAISVPIIAEIDLYKFDPWQLPRMALYGEKEWYFFXPREQQYAKRSSPIAPLGLVLEGHDPYKPVGSPSSWPQKRPGLLPRNGPRAKKTTGSGKINRFATSTVWAQKKPPWGGGRGPGALLQKKGARVEKRPPVLGPPQILFPRPG

SEQ ID NO: 41125 - DNA, 817 bp, Zea mays
  misc_feature: Ceres CLONE 1435728-F
  misc_feature: Encodes the peptide sequence at SEQ ID NO. 41126
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tggggggcccccccccccccccccccaccccangaannnnnnnngnngnnnnnncaaagctggaactccccgcggtggcggccgctctataactagtggatcccccgggctgcaggaattcgcacgagaccattacctagaacatcctaatcgaaaattccccgtttgccttgtttacaattcttccccaaaacacatcctgcgatcctcgaaacctccgccgagcatcaatcatgtgggcctactgcggcaagtactcggatgagctcatcaagaatgctgcctacatcggcacccctggcaagggtatccttgctgctgatgagtcaacttggcaccattggcgggcgtcctttccagtcctcgaatgtcctagaaacgttggaaggaaaaacccggccggggcttctcccggggaagccccctggtttccggggtgtccccctgggggggggcgttcccaggtccccttgtgggcgggggggggatttcttttttttcggggggaacacccccccccaccccccaaaataaccccaagggattgggggcacgcgcccttttttttcttccaatggtttccctctcccggggagagagggagggcctattccccccccctgggccaaccaaaggggcccacaccaaagggcccaccccattgagaaggggtgtgtggggaccccccgcaaaagcgggaggaccccccccccccccgaggcccccccgaatataacccccgcgaaaaaagcccgtctgatctaaaaaatacttacaagagcgccgtgggcccccctttttcccaagagcggggtgg

SEQ ID NO: 41126 - protein, 143 aa, Zea mays
  misc_feature: Ceres CLONE 1435728-F
  misc_feature: SWISSPROT Homolog: EC 4.1.2.13 Fructose-bisphosphate aldolase
MWAYCGKYSDELIKNAAYIGTPGKGILAADESTWHHWRASFPVLECPRNVGRKNPAGASPGEAPWFPGCPPGGGRSQVPLWAGGGFLFFRGEHPPPPPKITPRDWGHAPFFFFQWFPSPGERGRAYSPPLGQPKGPTPKGPPH

SEQ ID NO: 41127 - DNA, 706 bp, Zea mays
  misc_feature: Ceres CLONE 1435730-F
  misc_feature: Encodes the peptide sequence at SEQ ID NO. 41128
  misc_feature (342)..(342): n is a, c, t, g, unknown, or other
aagctggagctccccgcggtggcggccgctctagaactagtggatcccccgggctgcaggaattctcacgagaccattacctagaacatcctaatcgaaaaaactactccgtcactttgtttgcaaagctcctcctcgatccatcgatcactgcaccggccggcggcaccgcgctcgcaggggctagccaacaagacggcagcaatggcggaccgtgaccgcagcggcatctacggcggcgcccacgccacctacgggcagcaacagcagcagggaggaggcgggcgcccgatgggtgagcaggtgaagggcatgctccacgacaaggggccgacggcgtcncaggcgctgacggaggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacgggcgtcatggggttcctcacgtcgggcgcgctggggctcgggggcctgtcctcgctcacgtgcctcgccaacacggcgcgggcagcgttccagcgcacccgggactacgtggaggaggcgcaccccaagatggcggaagccgcggcgcaacgcggccacaagaccgcgcaggcaagcccagccatccaggggcatggcgcaggag

SEQ ID NO: 41128 - protein, 167 aa, Zea mays
  misc_feature: Ceres CLONE 1435730-F
  misc_feature (44)..(161): Pfam Name: Oleosin Pfam Description: Oleosin
MADRDRSGIYGGAHATYGQQQQQGGGGRPMGEQVKGMLHDKGPTASQALTEVTLFPLGGLLLVLSGLALTASVVGLAVATPVFLIFSPVLVPAALLIGTGVMGFLTSGALGLGGLSSLTCLANTARAAFQRTRDYVEEAHPKMAEAAAQRGHKTAQASPAIQGHGAG

SEQ ID NO: 41129 - DNA, 562 bp, Zea mays
  misc_feature: Ceres CLONE 1435732-F
  misc_feature (204)..(204): n is a, c, t, g, unknown, or other
  misc_feature (212)..(212): n is a, c, t, g, unknown, or other
  misc_feature (213)..(213): n is a, c, t, g, unknown, or other
  misc_feature (235)..(235): n is a, c, t, g, unknown, or other
  misc_feature (309)..(309): n is a, c, t, g, unknown, or other
  misc_feature (342)..(342): n is a, c, t, g, unknown, or other
  misc_feature (420)..(420): n is a, c, t, g, unknown, or other
aagctggagctccccgcggtggcggccgctctagaactagtggatcccccgggctgcaggaattcgcacgagaccattacctagaacatcctaatcgaaaaagctggagggcaccaagctaacatttagttgcaaaggagcgctaggaagaagaagcaacgagccatggcctccggtggcccgaaacccaaactgggcctacantcatcttnngtacgtgaggggaacgtggaanaaaggctgcctccttctacgacgccgctttcgctacacgtccgccgctcggacagttcgcagtaaacgcgggcntgcccctggctgctgatccgatgccgctaatanctgcgcaatgcccccctctggtttacttttcaggtggcgaactgaaaaggggaaaacatcccgtccccccctcacaanggaaaccaaaaatttcggggggggaaatttccaaatcccgggccccgggggggtttccggaagtttttttccccacgagaatttaaaccccctataaaaccccctggaaaaaagggggggggggctaaaacaccccccaaaa

SEQ ID NO: 41130 - DNA, 727 bp, Zea mays
  misc_feature: Ceres CLONE 1435734-F
  misc_feature: Encodes the peptide sequence at SEQ ID NO. 41131
ggagctccccgcggtggcggccgctctagactagtggatcccccgggctgcaggaattcgcacgagaccattacctagaacatcctaatcgaaaaaacccagggtgagtctccggatccgtcgccgtctggtctccgtgtgctctcgtcgccgtcgccgtcgccgccgtctgactgaccccctcgcctcccgcggcgtcgggtctctggtgctgctgctactgctgctgcgtgcagggctgtgatggcgaccaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagttgagaagttggctgccgctttgccagaaggtggagttctgctcctagagaatgttagattctagcaggaggaagagaagaacgaacctgagtttgctaagaagctagcatctgttgctgacctttatgtcaatgatgctttttggcacggcacacagagctcatgcttcaaccgaa

SEQ ID NO: 41131 - protein, 123 aa, Zea mays
  misc_feature: Ceres CLONE 1435734-F
  misc_feature (3)..(124): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRF

SEQ ID NO: 41132 - DNA, 677 bp, Zea mays
  misc_feature: Ceres CLONE 1435735-F
  misc_feature: Encodes the peptide sequence at SEQ ID NO. 41133
  misc_feature (677)..(677): n is a, c, t, g, unknown, or other
tccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatgccatgaaccggcgagcccccctcggcgatattggcaacctcgtcagcgtccgcccagccgaagggaaaccn

SEQ ID NO: 41133 - protein, 62 aa, Zea mays
  misc_feature: Ceres CLONE 1435735-F
MPTRNHNAAAAAAPQHHHHNRGGAPALGKSKAVPGRADAMNRRAPLGDIGNLVSVRPAEGKP

SEQ ID NO: 41134 - DNA, 780 bp, Zea mays
  misc_feature: Ceres CLONE 1435736-F
  misc_feature: Encodes the peptide sequence at SEQ ID NO. 41135
aagctggagctccccgcggtggcggccgctctacatctagtggatcccccgggctgcaggaattcccacgacaccattacctagaacatcctaatcgaaaaacgaactctttctgagtcccgaccgttggaaccgttcctctcgcctcctcgacacactccgtcttgcgtggtagcagcagcgctcgcccacgcgctcgtttatattatatatagtgcgactgtgcctcccctccccgagccatagccacttcgtcccctcgagaactgtaccatcacgcgccggctttgattgagcagggactgagacagaggacaagagagtgtgaaagggggcaagaaaatgctatcttgtgcctttgtgcttcagcgaatacgcgacggctgcgcacgcacgaggtgaaataggagtcgcggttcgcgcacctcaaggcttttttcgcctccctgctcctccgggatcttcggcacccctccattcccaggacgaggatgaggacttatagtggccccctgggaaaccacaaggttgcagggggctgccctttaccaagcttttccctttccaaaccaaagggggggcctcccgtctttgggaaaaaataaaggcctcttccccggccaaaattgtattaattgaaggcgggggacccccccccgcgggaaaatttgggaaacccccttggaaggcctcccccccccctcaaagggtgaaacccccccccccgccagaaagagaaataatgcccccccctcacacggggaaaattttctcccaccc

SEQ ID NO: 41135 - protein, 37 aa, Zea mays
  misc_feature: Ceres CLONE 1435736-F
MRTYSGPLGNHKVAGGCPLPSFSLSKPKGGPPVFGKK

SEQ ID NO: 41136 - DNA, 709 bp, Zea mays
  misc_feature: Ceres CLONE 1435738-F
  misc_feature: Encodes the peptide sequence at SEQ ID NO. 41137
aagctggagctccccgcggtggcggccgctctatactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggctgcgccgtcatcgtcccgacggcgcggatggggccggacgggtcgtcgtcgtgttcgggggaggaggcggtggtggtgtaccagagcagcgccaaccctctgcccagcggcatcccggcctacaccgtgcagatcatcaacgtctgcggcggagggtgcaccgtggaccacgtgcacgtctcctgcggggacttcacctccccggagctcgtcgacccggcaaagttccagcgcgtcgcctacgacgactgcttcctcaaaggcggcgcccccttggaacccagcgagaccggtctcatgcagtactccaactccttctcctaccaactcagtgtcgcctcccgcccgggcccactagagatc

SEQ ID NO: 41137 - protein, 172 aa, Zea mays
  misc_feature: Ceres CLONE 1435738-F
MGEWCFKKRAALVIIVAIISSLQLLLITAQEAGGDHEVWSSSSSPAGGRGGCAVIVPTARMGPDGSSSCSGEEAVVVYQSSANPLPSGIPAYTVQIINVCGGGCTVDHVHVSCGDFTSPELVDPAKFQRVAYDDCFLKGGAPLEPSETGLMQYSNSFSYQLSVASRPGPLEI

SEQ ID NO: 41138 - DNA, 913 bp, Zea mays
  misc_feature: Ceres CLONE 1435739-R
  misc_feature (20)..(20): n is a, c, t, g, unknown, or other
  misc_feature (27)..(27): n is a, c, t, g, unknown, or other
cgattgggtactggagtctnttcgagntcgacgttatcgataagctttttttttttttttttacagcggtagccttcgctttgttattccttttttttttttctttttttgttgttatttaggggcgccgaggccgggcacgccccccaccccgggcgcaaaggcgcgcgggaccggggggggccccgcggcgcccgccaaaggcacaccccctgaagagtgtgcccgacacaagggaagaccttgaggcccccacccggggaggacagcgcgagacgaacaaacaggggggagcgccgggaggggctgggccggaaccgaagcgccaccaacgacgcgctggataagcataacaagaaggcggtcgcaacgccccccccccccagggcgtaggcgggtggcgcccccaaaaaacatcgtcgcggcaagcggggcatccgtggcgtccaaggaacaagggggcaacaccacccccaagggggggggcgggattctgtaacccggaagcgggcccaaaggtcaggcggcctccggaagggaggaagaacaacccggaaagcccctggcctgggcccccccgcccccctaaaaggaagggggaggggcgcccccccctcctggggggaaggcccgcccgaaaaatattttattgccccaaaaaccccacttccccccccttggggggggccccccggaaccccaaagcccccccttagttggggaaaaacggccccggggaagccgcacctgaaaaaaccccccaatccccccgccttgccccacccgggaaaaaagagaggtaccaaaacccggcgccctttgaaattgagacatcccaaaaaggtgttttggggccgggaaaaaaccggggaaaaaggttccaacaaccaaaaaggcgccgcccccggggggt

SEQ ID NO: 41139 - DNA, 671 bp, Zea mays
  misc_feature: Ceres CLONE 1435739-F
  misc_feature: Encodes the peptide sequence at SEQ ID NO. 41140
aagctggagctccccgcggtggcggccgctctttaactagtggatcccccgggctgcaggaattcgcacgagaccattacctagaacatcctaatcgaaaaacttcgttccgggttccggatagcttacttcccatcgattgccctccgacccggtggtcgaatgctaacattacgggcgctctggccaagaacaggtgacaaggaagatgaccacgctggacacgcggacactcaaggacaacctgacgaccatggacaggaagtgcctcgagaaactcggccacccgctgcacaaccgcgacgccgacagcttcatccgcaccgctggagtcagggcggccatagccgtctccagaaaggcctacctcgtccccctcgaaggactttcacgagactcgtccgggctaaacgccaacggcggcaagcggagccatttctccagcatcacaggtgacgacggccataggtcgctcaacgcaatgctaaaaacggccggcaaggaggccttccattggaggttggcaaccggagtctactcagggctcacgtacgctctgcgggaggccaggggatgccacgactggaagaacagcgccatcgcaggagccatcgctggggcggcggtggcgctcacgggtgactccggaggccactccgactagctcgtca

SEQ ID NO: 41140 - protein, 151 aa, Zea mays
  misc_feature: Ceres CLONE 1435739-F
  misc_feature (21)..(151): Pfam Name: Tim17 Pfam Description: Tim17/Tim22/Tim23 family
MTTLDTRTLKDNLTTMDRKCLEKLGHPLHNRDADSFIRTAGVRAAIAVSRKAYLVPLEGLSRDSSGLNANGGKRSHFSSITGDDGHRSLNAMLKTAGKEAFHWRLATGVYSGLTYALREARGCHDWKNSAIAGAIAGAAVALTGDSGGHSD

SEQ ID NO: 41141 - DNA, 691 bp, Zea mays
  misc_feature: Ceres CLONE 1435740-F
  misc_feature: Encodes the peptide sequence at SEQ ID NO. 41142
  misc_feature (433)..(433): n is a, c, t, g, unknown, or other
  misc_feature (576)..(576): n is a, c, t, g, unknown, or other
aagctggagctccccgcggtggcggccgctctatactagtggatcccccgggctgcaggaattcgcacgagaccattacctagaacatcctaatcgaaaaacaggatcatctcgttctggatccattggtttcctacctggtgagggactgaggggcccgcagtgcattgatttgggattctgttcaaacatttgcggaaggagcctctggcgaccgctctggatgcgatcgactgcaaacctgctgtggcatgcgaggcccgccagccactgtcgatcaaggaggtggatgtaccgcctccgcaggccatggaggtgctcgtaaagatcctcttcatctcgctctgccccaccgactgctacttctggcaggccaaggcctgcactcccgtgctccctcggatctttcgacgccaagctggaggcatcatcnagactgttgcagagggtgtgactgatctagctctgggtgaacatgtccttcctgtgttcactgaagagtgcaacgcgtgtgccctctgcaagacgacatcagagcactcgtgtgatctgctcttgatcaacccagaccgcgcngtgatgattgtcgacggctagtcgcagatttcaatccatgggagacgtatctaccacttgtgtggggcactactactttcaacgagtacaccgtcgtgcctgaagcatcgagtgc

SEQ ID NO: 41142 - protein, 95 aa, Zea mays
  misc_feature: Ceres CLONE 1435740-F
  misc_feature (2)..(93): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (42)..(42): Xaa is any aa, unknown, or other
MEVLVKILFISLCPTDCYFWQAKACTPVLPRIFRRQAGGIIXTVAEGVTDLALGEHVLPVFTEECNACALCKTTSEHSCDLLLINPDRAVMIVDG

SEQ ID NO: 41143 - DNA, 734 bp, Zea mays
  misc_feature: Ceres CLONE 1435743-F
  misc_feature: Encodes the peptide sequence at SEQ ID NO. 41144
aagctggactccccgcggtggcggccgctctagaactagtggatcccccgggctgcaggaattcgcacgagaccattacctagaacacctaatcgaaaaactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacaccccatgcccgtgccaacagccgcatccaagcccgtgccagctgcagggaacctggcgcgtttggcagccaccccaaatcctggccccatgcctcaagtttctaagggattagtgcagcccgagggggaacccctaatgcctccctcaatgcccatccttttccgcaccatggtttcccccccccctccggggagggggagacccccaaccccggtacccagggaaaaccttggggttgggcccccccgagccctcccttgggaaaaaagccccgaaa

SEQ ID NO: 41144 - protein, 191 aa, Zea mays
  misc_feature: Ceres CLONE 1435743-F
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPMPVPTAASKPVPAAGNLARLAATPNPGPMPQVSKGLVQPEGEPLMPPSMPILFRTMVSPPPPGRGRPPTPVPRENLGVGPPRALPWEKSPE

SEQ ID NO: 41145 - DNA, 744 bp, Zea mays
  misc_feature: Ceres CLONE 1435744-F
  misc_feature: Encodes the peptide sequence at SEQ ID NO. 41146
  misc_feature (456)..(456): n is a, c, t, g, unknown, or other
  misc_feature (487)..(487): n is a, c, t, g, unknown, or other
  misc_feature (488)..(488): n is a, c, t, g, unknown, or other
aagctggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcaacgaagaggagcgtgggcaccctcggcgaggcggatctgaaggggaagaaggtgttcgtgcgcgccgacctcaacgtccctctcgacgacgcccagaatatcaccgacgacacccgcatccgcgcctccgtccccaccatcaagttcctcctcgagaagggcgccaaggtcatcctctgcagccacctgagtcgtcgaaaggtgtcactcccatgtacagcttgaagcctcttgttccacgcttgtctgagctccttgnaagtgagtccggatggccatggatgcattgnngagaagctgaaaaagtggcttgcccttttgccgaaggtggattccgctcctggagaaggtttattctccaaggggaaaggaaaaaccaaccctgaatttgccaaaaaactaccccctggtggggaaccttttattcaaagaaagctttgtggacggccacaataaccttttcgtttcccccgggggggtttccccctttttttaaacccggggtggccggggcccccccgctgcaaagggaattttgtcccctttt

SEQ ID NO: 41146 - protein, 76 aa, Zea mays
  misc_feature: Ceres CLONE 1435744-F
  misc_feature: SWISSPROT Homolog: EC 2.7.2.3 Phosphoglycerate kinase
MATKRSVGTLGEADLKGKKVFVRADLNVPLDDAQNITDDTRIRASVPTIKFLLEKGAKVILCSHLSRRKVSLPCTA

SEQ ID NO: 41147 - DNA, 722 bp, Zea mays
  misc_feature: Ceres CLONE 1435750-F
  misc_feature: SWISSPROT Homolog: EC 3.1.1.31 6-phosphogluconolactonase
ggagctccccgcggtggcggccgctctagaactagtggatcccccgggctgcaggaattcgcacgagaccattacctagaacatcctaatcgaaaaaccacatccttgtccaccttcgtctccgccgctgtcggtgcctgtctcgtcccacccctcaccgggcggcggtcgccggcggcatctcgcgtagcccagatttgccgctgactaatcggatccgaaccccgtatcttctcttcttccccctccttccccattgtccccgacgctgaggtggccactcggcggcgcctcccccaccgcctccgatgccggctccaagaagaagttgctcatcttcgactccgaggaggatctcgcggtttctcttgggaagtacactgcggagctgttggagaagttcgaggaccatagggacgccttcacctccgtgctctctggcggatccctcatcgaggtcctcatgatcctgatcgagccgccgaacctggattcagtggactggagcaggtgtcacgtcttctaggtggatgagagggtcgtgcccaagggccatgtggatagcgactacaagctcgtctatgatgggtctctcttccaggtgccgattcctcctcgacaagtttttgctttaaacgatccttagtcatttgacggaccggctaaggattacaaatcgtggctgaattagtttggtaaaaacggcgtggatttctatgtcg

SEQ ID NO: 41148 - DNA, 713 bp, Zea mays
  misc_feature: Ceres CLONE 1435751-F
  misc_feature: Encodes the peptide sequence at SEQ ID NO. 41149
  misc_feature (556)..(556): n is a, c, t, g, unknown, or other
aagctggagctccccgcggtggcggccgctctagaactagtggatcccccgggctgcaggaattcgcacgagaccattacctagaacatcctaatcgaaaactctcgatgaggaaatggaattcaaagaatttgcacagaggccagatgcatatgccaagctctgctcaatgattggtccttcaatttatggtcattctgatgtcaagaaagctattgcatgcttgttatttggggggtctaagaagaggctacctgatggtgtacgtttgagaggggacattcatgtcttgcttctgggtgacccatccacagcaaaatcacagttcctcaaatttgtagagaagactgcccctattgcagtctatacatctggcaaaggttcatctgcagctggtcttacagcatctgtaactcgggatagtagctcgcgcgagttttatttggaaggaggagccatggttttggctgatggtggagtagtttgtatcgatgaatttgacaagatgcgacctgaagacagagtggcgattcatgaggccatggagcagcagacnatatctattgccaaagctggcattacaacagtactcaattcaaggactccagttcttgcagctgcaattcaaatgcaggacgctatgatgatcttaagactgcacagataatattgatctacagaccaccatctttctagaattgatcaaatcttta

SEQ ID NO: 41149 - protein, 183 aa, Zea mays
  misc_feature: Ceres CLONE 1435751-F
  misc_feature (2)..(184): Pfam Name: MCM Pfam Description: MCM2/3/5 family
MEFKEFAQRPDAYAKLCSMIGPSIYGHSDVKKAIACLLFGGSKKRLPDGVRLRGDIHVLLLGDPSTAKSQFLKFVEKTAPIAVYTSGKGSSAAGLTASVTRDSSSREFYLEGGAMVLADGGVVCIDEFDKMRPEDRVAIHEAMEQQTISIAKAGITTVLNSRTPVLAAAIQMQDAMMILRLHR

SEQ ID NO: 41150 - DNA, 699 bp, Zea mays
  misc_feature: Ceres CLONE 1435755-F
  misc_feature: Encodes the peptide sequence at SEQ ID NO. 41151
  misc_feature (383)..(383): n is a, c, t, g, unknown, or other
tccccgcggtggcggccgctctataactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggntcgcacccacgacggccacagtgagctcgtcgctgctgcttgggatcactgggctcccagacactaagttcaagagtgcgatagatactgcactggcagatggtgagtgcaaccccactgaaaaggctgaggaaaggatgtcctgttacctcacaaaggtcttgcaaatgttgcccctaaacgggtcatcaagtcccggggaaaatttcaacggaaaaaaacccccggtaacttaaaaacccccggggataaccccaggggtacatgaagtgttaaacttttacaccgcaatgtggttccccaactgacgccctgt

SEQ ID NO: 41151 - protein, 160 aa, Zea mays
  misc_feature: Ceres CLONE 1435755-F
  misc_feature: SWISSPROT Homolog: EC 2.2.1.2 Transaldolase
  misc_feature (83)..(83): Xaa is any aa, unknown, or other
MALSIYTPTSSSLVPPSIQEVRLTSRPPKPATFSLRRPHLAARAAAGNAPTSPVREVVTELDAVAGFSEIVPDTVVFDDFERXAPTTATVSSSLLLGITGLPDTKFKSAIDTALADGECNPTEKAEERMSCYLTKVLQMLPLNGSSSPGENFNGKKPPVT

SEQ ID NO: 41152 - DNA, 742 bp, Zea mays
  misc_feature: Ceres CLONE 1435759-F
  misc_feature: Encodes the peptide sequence at SEQ ID NO. 41153
  misc_feature (742)..(742): n is a, c, t, g, unknown, or other
gctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtggtatttacgagaatagatattacaggcccaaacagctgctgcttctgttgaagcacgccgcaccggcagacgttacccctccaatgggcgaatgcagaacggagtacaggggcctgcccgacgccaatggcaaggacgcggggacggtgccagccgcgctccgcaaggtgtccatactcccgctcgttttcctcatcttctacgaggtctccggtgggccgatcggcatcgaggacagcgtgggcgcacctaggcctctcctccccatcgtccgcttcattgtcatccccgtcatctggagcatcccggaggcgctgattaccgcggagctgggcaccctgttcccggaaaaaagccgggtacgtgcatgggggtcgcctcatcccttcggtccctaggggggaattccggcaagggtgggttaaatgggctcaggggtttccattgacaaatgcccggtaaccccgtccctttttctgggaactacaccaaagtcccccccttggcccagcccctgggggaggcgcgccccccccaaagggcgctttccccggggtcttcaaacagtgggggggggggggtcttaacacctgn

SEQ ID NO: 41153 - protein, 104 aa, Zea mays
  misc_feature: Ceres CLONE 1435759-F
MGECRTEYRGLPDANGKDAGTVPAALRKVSILPLVFLIFYEVSGGPIGIEDSVGAPRPLLPIVRFIVIPVIWSIPEALITAELGTLFPEKSRVRAWGSPHPFGP

SEQ ID NO: 41154 - DNA, 715 bp, Zea mays
  misc_feature: Ceres CLONE 1435760-F
  misc_feature: Encodes the peptide sequence at SEQ ID NO. 41155
aagctggagctccccgcggtggcggccgctctagaactagtggatcccccgggctgcaggaattcgcacgagaccattacctagaacatcctaatcgaaaaagcaagcaattgtcaaccgactctatcttagctctctttgcaagccagtaggtcaccactcaaaagcttgtgaagcaggtgagatgggcaaggaggtggatgtgtccactctagaggccggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacggttgccacggtgatcgggtacaagcaccagacggacgcgtcggcgtcggggcccgacgcggcccccaccggcgtgggcatcctgggcatcgcgtgggcgttcggcggcatgatcttcatcctcgtctactgcaccgccggcatctcgggcggccacatcaacccggccgtcacgttcggcctctttctggcgcgcaaggtctccctggtgcgcgctctgctgtacatggccgcgcaaagcctcggtgctatctgcggggtctcgctcgtcaaggcttcccgagcgggttctacgcccgctacggcggccgcgccaatgaggccagcgcccgggtatccacccggaccggggctcgccccc

SEQ ID NO: 41155 - protein, 177 aa, Zea mays
  misc_feature: Ceres CLONE 1435760-F
  misc_feature (33)..(177): Pfam Name: MIP Pfam Description: Major intrinsic protein
MGKEVDVSTLEAGGVRDRDYADPPPAPLIDIDELGKWSLYRAVIAEFVATLLFLYITVATVIGYKHQTDASASGPDAAPTGVGILGIAWAFGGMIFILVYCTAGISGGHINPAVTFGLFLARKVSLVRALLYMAAQSLGAICGVSLVKASRAGSTPATAAAPMRPAPGYPPGPGLAP

SEQ ID NO: 41156 - DNA, 739 bp, Zea mays
  misc_feature: Ceres CLONE 1435761-F
  misc_feature: Translation starting site: 202
  misc_feature: SWISSPROT Homolog: EC 3.1.2.6 Hydroxyacylglutathione hydrolase
  misc_feature (380)..(380): n is a, c, t, g, unknown, or other
  misc_feature (739)..(739): n is a, c, t, g, unknown, or other
aaagctggagctccccgcggtggcggccgctctagaactagtggatcccccgggctgcaggaattcgcacgagaccattacctagaacatcctaatcgaaaagaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcacactgggatcatgcntgtggcaatgagaagatgaagctgcaagtgccaaggataaaggtatttgaggattccttggacatgtgaaagctgccctgatcaggggaaaatggaatgattttccacttggaaggaacttgaaactttggctaaccccccttggccccctaagggcaatacccctcctttgttctcagaggggggggaaaaaccccgggcctttcccggaaaaacctggttcttggtggggggggaaatttttttagggggtcttccaaaaaaaaaaaacccccccctttatgaacccggggggcccgccccaaaaacacaccccaattttgggggggggaaagaaccctcgaaaaacacaaaaattn

SEQ ID NO: 41157 - DNA, 902 bp, Zea mays
  misc_feature: Ceres CLONE 1435762-R
ccgattgggtaccgggccccccctcgaggtcgacggtatcgataagcttttttttttttttttttatgaaaccaaaacggtttctcccaaactcaaaactttgtactcggataaaacatacaacccccttttggccttaaacgagaagcaactgatccgttcacaaaactggtccaaaaaacctgagcctcgataacagagagatgctgatcatcaagccccttccaggcccaaatcgctttcccatctcccttcttcttattcaactcagaaaccacaattctagctctcctctcccacccagttttaccatacgcagggaaaccaaacccccccccttagcataagttcaaacctttgagtttcccccaaaagtcgttgacatggtcatgacccacaaacactgacttcacatctcctctagttaccaacgttgggaaaaaaccaaattttgtggaagctaagaatgttccttcttgccccaccccttttgtcgcgtcctttgagtcaaaactccaaaactctggtaatggaatgtgaaagtaagctagccctggagctgtaccttgctaaggatgaggctctgcgttgtacaccctctggagactttttgaagttctctcaaaccaaaactgtctgagaagtcttgacccaatcataacccttccatgtaaggaaccactagagaaatcctccactgctcccgaaaataaaaattgagaacagatttttttctgaaagagtggactcgagagtctctcccgaatttggaagattgggatttcccaacccccctccatgggattgggccagcctccggggagggttcaccttaaaaaaaaagggttggggaaaccttcccaaaagggtttcatccaattccttggccccgggaaaaagag

SEQ ID NO: 41158 - DNA, 733 bp, Zea mays
  misc_feature: Ceres CLONE 1435765-F
  misc_feature: Translation starting site: 153
ccccgcggtggcggccgctctagaactagtggatcccccgggctgcaggaattcgcacgagaccattacctagaacatcctaatcgaaaaagagccgccgacaactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatggtgctcccaacttttggggtatgattttttaccactgataaactgagatccctagtggaggagtggcagacattaatcgaagcccatgttgatgtcaagacaacccaacactacctgttgcgtttgttctgcatccggcttcccgaaaaggcccccaacccaggtccaagagaacctgcttttgctccgggatcccaaaacccgtcaaaacccccctaagagagggttgaaaattttgaatcaccccggcctttctaactggggaacctgaaaaaaaacttggtttcgaaatttc

SEQ ID NO: 41159 - DNA, 876 bp, Zea mays
  misc_feature: Ceres CLONE 1435766-F
  misc_feature (21)..(21): n is a, c, t, g, unknown, or other
  misc_feature (22)..(22): n is a, c, t, g, unknown, or other
  misc_feature (43)..(43): n is a, c, t, g, unknown, or other
  misc_feature (819)..(819): n is a, c, t, g, unknown, or other
tttttttttttgggtggggtnntttcggttatggcaaccgccnaaaactggaactccccgcggtggcggccgctctagtactagtggatcccccgggctgcaggaattttcacgagaccattacctagaacatcctaatcgaaaaaaaacgcagcgacctcgccccccctgccccgctcctccccttttcccggtagcagagacggagcaccgcagcccgccataaaggaagacgaaacgcgccgcggcgcaacgcaccgcgtgctagtgaaagggcgcagcggaaggccgccgccgcgctgctatttagacaggaagcggggcgatcgaatcgcgtctctcaaccaatcgataaatctgccggtaggtcgatcaaggagagcgcggcccacgtccccgttccgttccgttggcggggaaggaaggaaggagagagaggagccgatggcttccgggtacgggggccccccccacaataacaactaccttgttccaaggtggtggctgattgggcgacaggcggccgtgggggaagtccaaaacctggcttgttcgcgggctccccccagggaccgaaactcaccgccgccgaagagccccccccccacccatccggacggtgcaaatttcgcgcccgcccaagatagcgtccccaaaggtcgaaagaaaacaaggctgcgggtcaaggtgctccttaaatctgtgggcaccccccgcccgggcgccagcaaaaagggaaccggtggtccctatctgttaatatctcaaaaataaacctgccgcgagcccatttgtagaccctcttatggtctgtgttancaaaactattgaggccttccccaaacccctctcttcgcaactagagcgcgggaaccg

SEQ ID NO: 41160 - DNA, 904 bp, Zea mays
  misc_feature: Ceres CLONE 1435770-F
  misc_feature (16)..(16): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
gccccccgccgttttntttttttgggggaacaaaccccgngggnnnnaatgaggggctcgccccagtggcggcggctctacaacaagtggatcccccgggttgcaggaattcgcacgagaccattacctagaacatcctaatcgaaaaactatcctaccaggcaccactcgcatcgtgtgctcagacagatccccgtcccgcatttcctaaggccaggttagttggcattgaagacgatgactgcttctgcacctgctggtgtgcagatgggggttgcacgcccttgcatttcggcctcagcagaaaatcttaccgcacggcttaccgcctcctaggaccgagtgcatggccagtacccctgctcgctggcccgaaatgcggctgctcctgggcccttagggtctaacccccacgtgatgttgtggggggaagccaactagtcggaagagttgttgtccgcgggggtggcttcggggcgcccccccccaaaagagaaaaaaggcgccggccgcccgcctgcgaacttgccgcgcatgcatgaacgggcgtaccgcgggagggggccacaactgcgacaacggcgcccccactcctctgcaggctcggcctgcactaaaacatagtgggggggggggggggcgttggccgcggccccccgcctctgtttccacccgctcgtaacagaacggcacgcctagaggcactcgggggaaagagggtcggcgaggaagtctgttgcagacgctgctgcgcaacaggatatactcctccgccggtgggtgtgggttggtgtgcgtgcaggcgcccgcccgccgcactcggcatggccgcagtcccctcctccccgggccggcccccccaggccccgcccccccctctcctcccgcccacaccctgggccca

SEQ ID NO: 41161 - DNA, 688 bp, Zea mays
  misc_feature: Ceres CLONE 1435773-F
  misc_feature: Translation starting site: 158
ggcggccgctctagaactagtggatcccccgggctgcaggaattcgcacgagaccattacctagaacatcctaatcgaaagtgtttctgctgccgtctccaagaccgctgctgctcctattgagcgtgtcaagcttttgattcagaaccaggatgagatgcttaaggctggcaggctctctgagccttacaagggtattggtgactgtttcggcaggaccattaaggatgagggttttggttctttgtggaggggaaacactgctaatgttatccgttacttccccactcaggcgttgaactttgcgttcaaagattacttcaagaggcttttcaacttcaagaaggacagggatggttactggaagtggtttgctgggaacttgggatctggaggtgcagctggtgcctcttcccttctcttcgtgtactctcttgactacgcacgtacccgtctcgccaatgactcccaggctgccaagaagggaggtgaaaggcagttcaatggtcttgtcgatgtctacaaaagaccctcaagtctgatggtattgctggactctaccggggattcaacctctcctgtggtggtatcattgcctaccggggcctctactttggcctgtacaactctttgaagcctcttctccctgctgactccaggacacctccctccctagttttcccctggg

SEQ ID NO: 41162 - DNA, 938 bp, Zea mays
  misc_feature: Ceres CLONE 1435777-F
  misc_feature (14)..(14): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (724)..(724): n is a, c, t, g, unknown, or other
ggggggggcccttntttttctttcccccccccccnaaggggnnnnttaaannnnncaaaactgggactccccgcggtggcggccgctctattatagtggatcccccgggctgcaggaattttcacgagaccattacctagaacatcctaatcgaaaaatgcgtcctgttgcaatggcaccttcagtaggtcctcgcatgcccatgtttccacctagggttcctggagttggtcagcagctgttttatggtcagccacctccagccttcataaaccctcaagctggatttgctttcgggccccctgtgatgcctcgcgggagggctggtgggcccaaagccaaaaccttccgacgtccagggctgcgccggggagagtcctccagatatattcctgcctggtggtgccatgctgggggtctgggggggctctgtctcccggccctctgggggccccacgcacgtccgacaaacaatactatattccccgagggggagggtctcccccccccccccgcgcaccatcgcttcatgccgcgccaacggagggcgggaggggaaaccgcgtgcgccggcccgcgcccaccgcgccacccgcgccccccatccgcatgcccccctcccccccgccgcctcctaccaccacgttcgctcccatgggagcagagtgagggccgtcagggtcgcggtggttaccacgtacaaacggcaggacggatatctaanaccccgccatgggctctggtgtgcctttacccgccccacaccctcccaactacctaccacgccccgcgccacacagacgcccacacccacgtgtgagaagtagagtcccgcccatcacagcgactcgcccagcgactaccatgccgcgccgttctggctccccgctccgcggcctgggtatgggtggatgtatacgtcgtctggtctagccgcc

SEQ ID NO: 41163 - DNA, 678 bp, Zea mays
  misc_feature: Ceres CLONE 1435779-F
  misc_feature: Encodes the peptide sequence at SEQ ID NO. 41164
  misc_feature (509)..(509): n is a, c, t, g, unknown, or other
tccccgcggtggcggccgctctagatctagtggatcccccgggctgcaggaattcgcacgagaccattacctagaacatcctaatcgaaaaaaccaagcagtaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcagncgggccagcgcgtcccggtctccgtcaccccgcacggctcgccgctgcagggccgcttgcccgcccgtcgctgggccattccagggccgctgctcccgtgcacacgggggcccagcggcgactggcccaacgtccagaaaatgaaaattatttttgtgaacccgcacgg

SEQ ID NO: 41164 - protein, 167 aa, Zea mays
  misc_feature: Ceres CLONE 1435779-F
  misc_feature (112)..(112): Xaa is any aa, unknown, or other
MASPKPSSAALLLLAAAAVLALARADLTHDNCVKNKKVTVQNLCSHDVTLTLEPLANSPPLFAGTYTLHPRSHAEFPVCWWTGRLRAPDAAQVEFHVGVDGGSFYLAPNAQXGQRVPVSVTPHGSPLQGRLPARRWAIPGPLLPCTRGPSGDWPNVQKMKIIFVNPH

SEQ ID NO: 41165 - DNA, 704 bp, Zea mays
  misc_feature: Ceres CLONE 1435782-F
  misc_feature: Encodes the peptide sequence at SEQ ID NO. 41166
acccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaccctgaccggaaaaactatcaccctcgaggtggagtcctctgacaccattgacaacgtcagggccaagatccaggacaaggagggcatccctccagaccaacaggggctcatcttttgttggaaaccagcttgaggaccggcgcacgcttgccgactaccacatccaaaagggagagccccctcccacttgggggcggcccctcaggggaaggcatggcaaatcttccgggaagaccccgtgaccgggaaaaactattccccctccgaggggggaatcctcccaaaccccc

SEQ ID NO: 41166 - protein, 83 aa, Zea mays
  misc_feature: Ceres CLONE 1435782-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKP

SEQ ID NO: 41167 - DNA, 838 bp, Zea mays
  misc_feature: Ceres CLONE 1435784-F
  misc_feature: Encodes the peptide sequence at SEQ ID NO. 41168
  misc_feature (5)..(5): n is a, c, t, g, unknown, or other
  misc_feature (6)..(6): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (197)..(197): n is a, c, t, g, unknown, or other
  misc_feature (838)..(838): n is a, c, t, g, unknown, or other
ggttnncccccccccccgggggtggatattttnnnnnngnnnnnnnnaaaactgggactccccgcggtggcggccgctctagactagtggatcccccgggctgcaggaattcgcacgagaccattacctagaacatcctaatcgaaaactctcgctcgccaggagaagcagccgccgttgctgctgccgcgtccacngaatggggggtttcgtgaagacccataacaccaatgcgtatttcaaacgtttcggagtgaaattcaagagagggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggcctccccccttggtctgaaccaactatgccgcctgcctactgcccctgaacttcgggtggcctcccccgtgtgcctaaagatcccgtggttttggataaaggacgtacgagggccattgtcccacgccccctgggcggaggaccttcctctgttgagccccacctgattgagagggaagggccattaccggggccttcgcttggaacggctcggccattctatccgggacctacctaatgggggaagcccggtggcccttctgggcggcccctcaaggggggaggcttttttggagtgggggggcctcgagaagtaatacccccaccacggcggccacaacaaggggttttgggccgggttatccctaggaagacn

SEQ ID NO: 41168 - protein, 103 aa, Zea mays
  misc_feature: Ceres CLONE 1435784-F
  misc_feature (27)..(102): Pfam Name: Ribosomal_L18p Pfam Description: Ribosomal L18p/L5e family
MGGFVKTHNTNAYFKRFGVKFKRGRAGKTDYRARIRLINQDKNKYNTPKYRFVVRFTNKDITAQIISASIAGDMVLASAYSHELPRYGLPPWSEPTMPPAYCP

SEQ ID NO: 41169 - DNA, 865 bp, Zea mays
  misc_feature: Ceres CLONE 1435785-F
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (446)..(446): n is a, c, t, g, unknown, or other
  misc_feature (719)..(719): n is a, c, t, g, unknown, or other
tggggggcccctcctgttgtnnnaanngaggggggggtngggnnnnnnnnnnnnaaaaaatgggactcaccgcggtggcggccgctctttactagtggatcccccgggctgcaggaattcgcacgagaccattacctagaacatcctaatcgaaaaatcgaaacaaaccctccgtctccaaaagagagcccaatcctaaattcccaatccctcaaaggaaggaggattcttcagcgtctcgcttgccggccccgaatcgcagtcgccgcccggatccgaggaaacaagtcgtcttcttggtccaccgtccgcccgccggcatgagcttcatctcgggcaagaagaagactcctggctgagctgctggcgggagaataagcggatgcttggacaaggcgcagccggggagaattgacagggagcaggcagggcttggctggtcctanaaaataaaatttctatcaaaggaagatcgaaaataggcggccccaacccccagttacaaaggccaggtttgtctatagtgtggccccccaacgagtctttattcctgcggcgaaggaagccgggagtccggagaggtttctgaggcaagtcgcgaggtcccccgatctacggaaggggcttatcccctccggatggcgtccgggagtcgggaagcgcgtgcgcgccgcgggccggcgccgcggcagcacccctggaagggggaggtggagaantaaacacccccagagcgaccccaaacgaacccggggcgcgtcttccgaacctcgccccccccggtccgctgccacaacacgccgagtccgagggggcccacgtgtcacgaggccaccccagccgaaaccccgcggtggcgcactcc

SEQ ID NO: 41170 - DNA, 587 bp, Zea mays
  misc_feature: Ceres CLONE 1435787-F
  misc_feature (206)..(206): n is a, c, t, g, unknown, or other
  misc_feature (211)..(211): n is a, c, t, g, unknown, or other
  misc_feature (218)..(218): n is a, c, t, g, unknown, or other
  misc_feature (238)..(238): n is a, c, t, g, unknown, or other
  misc_feature (439)..(439): n is a, c, t, g, unknown, or other
  misc_feature (456)..(456): n is a, c, t, g, unknown, or other
  misc_feature (460)..(460): n is a, c, t, g, unknown, or other
  misc_feature (461)..(461): n is a, c, t, g, unknown, or other
ggagctccccgcggtggcggccgctctagaactagtggatcccccgggctgcaggaattcgcacgagaccattacctagaacatcctaatcgaaaagttgtcttggcggctgcggcggagcacggaggcgaaggaggagcagcagcagcaggcggcgccgaggagcggcatcccactcagtgctttgcaccatggctaggggattngagangcacttngagagggctcatgcgccccnagcattgggattgctcgaacaaagctttgggcggagcctttttgctccccagccatctttctgggacctcccaggttcccgggaggggcccttcccccggacccccatctttgaggaaacggggcccagttttgcctcctgaaaccccccggggggggggtttttttttccccgggagagaccccccccccccggggtganttttttttttttttggngggnnggggggggggggggaggaaaaaaaaaaaccccccccccccccggggggggtaaaaaggagaaaatgtttttttttttccccccccccccccccccaacgggggggggggaaaaaaaaccccccccc

SEQ ID NO: 41171 - DNA, 916 bp, Zea mays
  misc_feature: Ceres CLONE 1435788-F
  misc_feature: Encodes the peptide sequence at SEQ ID NO. 41172
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ggggggtgggnnnntttgtttnttttnnaacnnnggggngggnnnnaaaaactggagctccaccgcggtggcggccgctcttttctagtggatcccccgggctgcaggaattttcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcgtctacggcggcgcccacgccacctacgggcagcagcagcagcctggaggaggcgggcgccccatgggtgagcagggtaagggcatgctccacgacttgggggccgacggcggtcccagggcgttgacggtggcggacgcttgtttccttttggcaaccccctgaagacagtgcgcacccccggggtttggattctatatttcccccccaccccggggggtcttggtttttctcccctcctcccgggtggtgccgtagttttatctatctccgtggagtttgggctccccccggctgacctgctttcattctcctcactccgtccgctcttttgtgtattttagcgccatgtgtcgcgcccgccccccaccgcgccccacagtgcttacgttgaaccgttctgagtggcctacatatactgtccttatatcgtgcccgtcgcctgtgtgtccgtcccgtggttgtaactttgggtagtatgcgatactcagatcaaaatccatcactagtctaagttatgtgccatatacatctgattagccgcatccagtgtatccaacctatacacctctctccatgactcaagatcctgttctcctacctatcaatcctcggacgcgcttgcgaaaactcccgcggc

SEQ ID NO: 41172 - protein, 62 aa, Zea mays
  misc_feature: Ceres CLONE 1435788-F
MADRDRSGVYGGAHATYGQQQQPGGGGRPMGEQGKGMLHDLGADGGPRALTVADACFLLATP

SEQ ID NO: 41173 - DNA, 667 bp, Zea mays
  misc_feature: Ceres CLONE 1435789-F
  misc_feature: Translation starting site: 117
  misc_feature: SWISSPROT Homolog: EC 2.7.11.1 Non-specific serine/threonine protein kinase
  misc_feature (308)..(308): n is a, c, t, g, unknown, or other
gctctagaactagtggatcccccgggctgcaggaattcgcacgagaccattacctagaacatcctaatcgaaaacatttccaggatttactagctgggtttaccatagcccgtaggatgtcgagcgatctccactcggcatcggacgtgatcgccggtcgccgcctcctctccaggctgcagcacctgagcgccagcttcatgagcttctcggcctgcacctccggccagggcccggcggacgcgtccagcacgctgtgcacggcgtccatcttcacccgctcgcgcgcctgctcggcgacgttgagnatcagcagccccgtgagcatctgcagaatcaccatgccgaacgcgtacacgtccgactccgttgtgagcttcgcggtcatgaagaacacggggtccatgtaccccgccgtgcccatcgggttcgtgcggcggcgatggtcctcttcctcaacggtttccgttcaccgcccgcgcctcccaaaatttccagccggttcgggttccgggttcagaagaattttggccacttccccccccctgaaagaggctggggcccccctgggggaagtccccagccaaaggccctctcccaaggatctaaacggtccttccaaagaggcccttggaaaccctcctttagccgcccttggggaggcctc

SEQ ID NO: 41174 - DNA, 796 bp, Zea mays
  misc_feature: Ceres CLONE 1435791-F
  misc_feature: Encodes the peptide sequence at SEQ ID NO. 41175
  misc_feature (12)..(12): n is a, c, t, g, unknown, or other
  misc_feature (13)..(13): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
gtggggggcccnncccccccccccgccgcccggcggtttattnttccccctnnaaaaactggggctccccgcggtggcggccgctctatactagtggatcccccgggctgcaggaattcgcacgagaccattacctagaacatcctaatcaaaaacttttcctagggtttcgtcgcttccagccgccgccgcgtccgcctcgccaagcgcagcagccgccgcagaacatcgctctcttgatctcagccatggcggaggtggagcagtaactggacacgccaaagctcttcaacagctggaccttcgatgatgtccagatgaacgacatctcgctgaacgactacctcgctgtaaacgctaccaaacacgcaatgtacctgccgcacaccggggggcgctactcctcgaagcggttcggccaggtgcactgcccgatcgtcgagcgccttactaaatccctcatgaagcacggtcgccacaacggaccaaaggtcctggcgtgtccccatccatgaagcaaacccctgcataatccttcaacctgcttcccctgatgcaaaccccaatcccgagcctggaacccaaatcctacccaatcaacccgcgggcccccgcggaaggaggccccgcccccatttcgcccccccttaggggctttgccagcaaaggccctggcacccggaataaacctcccccccctcagggaggggcggaaatgggggcttccatttcccctttacttggcctacaggttcccccaggcccagaaggaaccttccccggggaaatccccccc

SEQ ID NO: 41175 - protein, 65 aa, Zea mays
  misc_feature: Ceres CLONE 1435791-F
MNDISLNDYLAVNATKHAMYLPHTGGRYSSKRFGQVHCPIVERLTKSLMKHGRHNGPKVLACPHP

SEQ ID NO: 41176 - DNA, 693 bp, Zea mays
  misc_feature: Ceres CLONE 1435792-F
  misc_feature: Encodes the peptide sequence at SEQ ID NO. 41177
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaattcccctccctgcctcctcgtctcctcggtctcccctccctgtcttccagagacacagagcagggcgctcttcggtcggaggagaagcgcgaccacgaccatgggctttatctcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctggttagcatctaagtattgtttttttctgccatgcttaatgtcttgtgtttaaaaacataaagggcttatagaggtattngcaaaaaaaggtactaaatatactctcatatgtaatttactaaatgagtactctggcgcatttcctcaagtgagcatctggatgtcaagatttcttgtagcatgtcctctccacatcaaaactatttgcctcatttactg

SEQ ID NO: 41177 - protein, 94 aa, Zea mays; identical to SEQ ID NO: 13271
  misc_feature: Ceres CLONE 1435792-F
  misc_feature (1)..(94): Pfam Name: HR_lesion Pfam Description: HR-like lesion-inducing

SEQ ID NO: 41178 - DNA, 714 bp, Zea mays
  misc_feature: Ceres CLONE 1435794-F
  misc_feature: Encodes the peptide sequence at SEQ ID NO. 41179
aagctggagctccccgcggtggcggccgctctagtactagtggatcccccgggctgcaggaattcgcacgagaccattacctagaacatactaatcgaaaagaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccagtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatct

SEQ ID NO: 41179 - protein, 179 aa, Zea mays
  misc_feature: Ceres CLONE 1435794-F
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGTCGVGSTPILGQCVEFLRHQCSPTATPYCSPQCQSLRQQCCQQLRQVEPQHRYQAIFGLVLQSI

SEQ ID NO: 41180 - DNA, 677 bp, Zea mays
  misc_feature: Ceres CLONE 1435795-F
  misc_feature: Encodes the peptide sequence at SEQ ID NO. 41181
tggagctccccgcggtggcggccgctctataactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaaggactcggctggtgatggaactacaactgcctctgttctcgctagggagatcatcaaattgggcatgttgagcattacttcaggggcaaatccagtgtccgttaagaagggcattgatacgactgttcagaaattggtg

SEQ ID NO: 41181 - protein, 173 aa, Zea mays
  misc_feature: Ceres CLONE 1435795-F
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTKDSAGDGTTTASVLAREIIKLGMLSITSGANPVSVKKGIDTTVQKLV

SEQ ID NO: 41182 - DNA, 749 bp, Zea mays
  misc_feature: Ceres CLONE 1435796-F
  misc_feature: Encodes the peptide sequence at SEQ ID NO. 41183
  misc_feature (564)..(564): n is a, c, t, g, unknown, or other
  misc_feature (689)..(689): n is a, c, t, g, unknown, or other
  misc_feature (701)..(701): n is a, c, t, g, unknown, or other
  misc_feature (713)..(713): n is a, c, t, g, unknown, or other
tccccgcggtggcggccgctctagaactagtggatcccccgggctgcaggaattcgcacgagaccatacctagaacatcctaatcgaaaagtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgaatgggtggagtttctgctgctgtctccaaaacaactgctgctcctattcatatggtcaagcccatggataancacccccataaaccgcaaatgaaagaacaaatttatacgagcattttttctagaccgaaagccctccttgaggattatattcctggccccctaagcctgttcccacccccctcccggaaagcgcntttccctagggnattggtaaagcntccctcccaaccccctgaaagcaagaaaaagagtcc

SEQ ID NO: 41183 - protein, 108 aa, Zea mays
  misc_feature: Ceres CLONE 1435796-F
MADELRSTSVGQKFHGQSVLLSRISSYSAMNNPVFNNAYSAYNVPQRSYHGMNATAGLSSVMAPSPVFASAPKEKGFSGFMIDFMNGWSFCCCLQNNCCSYSYGQAHG

SEQ ID NO: 41184 - DNA, 682 bp, Zea mays
  misc_feature: Ceres CLONE 1435797-F
  misc_feature: Translation starting site: 149
aagctggagctccccgcggtggcggccgctctatactagtggatcccccgggctgcaggatttcgcacgagaccattacctagaacatcctaatcgaaaaaacactttgcctcttgcacaaaggtaatggtcctcgacgtcaataataatggcttctctttgtgctccttctgccctcgtggtaatttcttcgcctaggtccgtgcgtggcaataagctaatgttgaacaacaagctgagtgttgcacctgtttcccaatcaattgcgtctgtgcggtccgttgcatcggatccttagagaccaatctggttccctggaaccactcctccatagtggctcgacggatgcctccctggtgacttcggatttcatcttcttggactttcatctgacccctataatctaaaatgcacaccaccagcagacatagttcactgcctggtgggcaatgctacgtgcagccggaattattatctccgaagttctaaccaacatcaggatcctcaacacgccttcgtggtacactgtcggagagcaagagtatttcacggacaaaatcacactctttgtcattgaggtcatcttaataggatgggccgagggacttatatgggccgatatcattaagcccggtagggtcaacactgaccctatcttcccaaagaacaaactgacggggac

SEQ ID NO: 41185 - DNA, 749 bp, Zea mays
  misc_feature: Ceres CLONE 1435803-F
  misc_feature: Encodes the peptide sequence at SEQ ID NO. 41186
  misc_feature (446)..(446): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (548)..(548): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (657)..(657): n is a, c, t, g, unknown, or other
  misc_feature (724)..(724): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacaatgatgggcgccagcgggctgtacccctactcggagtacctgaggcagcctcagtgcagcccgctggcggcggcgccctactacgccgggtgtgggcagccaaacaccatgttccagccgggggggcggccccgccttttttttcttaaaaaaaaaaaaaaaaagngccccccccccccccggggtggtttttttcggggggggggggggggggggggggggagagggggggggggggggagggggggattagnnnntatttttttcncatttttannnntttttctnnncnnnnccccccccccccccccccccgggggggggggggttattttttttttttccccccacccccaccccccccatctttnnnnnanaaacaacaaaaacacaaacttttaattgtgttttttttttttgggggttgccgcccaccaccccccncacacatactcaccccatttttttg

SEQ ID NO: 41186 - protein, 175 aa, Zea mays
  misc_feature: Ceres CLONE 1435803-F
  misc_feature (98)..(98): Xaa is any aa, unknown, or other
  misc_feature (127)..(127): Xaa is any aa, unknown, or other
  misc_feature (128)..(128): Xaa is any aa, unknown, or other
  misc_feature (132)..(132): Xaa is any aa, unknown, or other
  misc_feature (135)..(135): Xaa is any aa, unknown, or other
  misc_feature (136)..(136): Xaa is any aa, unknown, or other
  misc_feature (139)..(139): Xaa is any aa, unknown, or other
  misc_feature (140)..(140): Xaa is any aa, unknown, or other
  misc_feature (141)..(141): Xaa is any aa, unknown, or other
  misc_feature (166)..(166): Xaa is any aa, unknown, or other
  misc_feature (167)..(167): Xaa is any aa, unknown, or other
  misc_feature (168)..(168): Xaa is any aa, unknown, or other
MKMVIVLVVCLALSAASASAMQMPCPCAGLQGLYGAGAGLTTMMGASGLYPYSEYLRQPQCSPLAAAPYYAGCGQPNTMFQPGGRPRLFFLKKKKKKXPPPPRGGFFRGGGGGGGGRGGGGGRGGLXXIFFXFLXXFLXXXPPPPPPGGGGVIFFFSPHPHPPHLXXXNNKNTNF

SEQ ID NO: 41187 - DNA, 768 bp, Zea mays
  misc_feature: Ceres CLONE 1435808-F
  misc_feature: Encodes the peptide sequence at SEQ ID NO. 41188
  misc_feature (447)..(447): n is a, c, t, g, unknown, or other
ggagctccccgcggtggcggccgctctagaactagtggatcccccgggctgcaggaattcgtacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctaccaacctggaagctccagttgttgttngtacaggtgcctctagaagggattgaaaacgcaactgctcctaccccttggaaaaagcaggatgcaaagggtctggtaaattaaggcccggtccttcaaaaaaggtttaaaaagggccccccaaaaaaattgaaacattctggggggggaaggctaactcccctttggaaggaaaagttttcacaaaaaaagctgaatgttaaagtccttatgaatgaaaagccttcttctaaaaataaagtggggaaaaccaaaaaattgggcctgggtaaaaataaatgggggggaaattaccccccaaaaccctatttatttgagaga

SEQ ID NO: 41188 - protein, 84 aa, Zea mays
  misc_feature: Ceres CLONE 1435808-F
  misc_feature: SWISSPROT Homolog: EC 1.1.1.100 3-oxoacyl-[acyl-carrier-protein] reductase
  misc_feature (77)..(77): Xaa is any aa, unknown, or other
MAAAAAAAAAVSSPIAPRAVAAAASRRGFVTFGGGAARSSPTLRSGRGFSGVQTHVAAVEQAVVKDATNLEAPVVVXTGASRRD

SEQ ID NO: 41189 - DNA, 776 bp, Zea mays
  misc_feature: Ceres CLONE 1435809-F
  misc_feature: Encodes the peptide sequence at SEQ ID NO. 41190
  misc_feature (22)..(22): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
tggggtgtttgcggcgggcggnacgcaaccctctnnngggggaannaaaaaactggagctccccgcggtggcggccgctctagattagtggatcccccgggctgcaggaattctacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcaaaagcgagtgccgcgagcggcacccccaacctgacgcgggcgaggacggcgacggcgacatgaaaccctaactctcccccctccgggaggggcaagtgcccggccccaatgcctgcgccgccccaaaggcccatcctttggaaaaccccggaagtggcttgagggggggcccccccccacaaaactgggcccccaaaatgggaaccagaaaaacggggcgcgggggtcgcaaaaacgccggggtaaatggcccgggaagaggggggggaggggcccccccccccccgggggaactgggggggaaaaaaggcccaccctttcccctggt

SEQ ID NO: 41190 - protein, 86 aa, Zea mays
  misc_feature: Ceres CLONE 1435809-F
MGKGSVGASWWAFLLLAGVLLVVAATAGAEDGVVERDRKEDLRWCKQACEWQYGKDTPRKRECKSECRERHPQPDAGEDGDGDMKP

SEQ ID NO: 41191 - DNA, 658 bp, Zea mays
  misc_feature: Ceres CLONE 1435811-F
  misc_feature: Encodes the peptide sequence at SEQ ID NO. 41192
  misc_feature (432)..(432): n is a, c, t, g, unknown, or other
  misc_feature (433)..(433): n is a, c, t, g, unknown, or other
  misc_feature (460)..(460): n is a, c, t, g, unknown, or other
  misc_feature (618)..(618): n is a, c, t, g, unknown, or other
  misc_feature (631)..(631): n is a, c, t, g, unknown, or other
  misc_feature (654)..(654): n is a, c, t, g, unknown, or other
agctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagacgggagagaaataggggacaagnntacaggacgcggcgggaggaagcaaanggaccccacccggggaaccgcccagggaggccccccccaaaggaaaggccccgggggaaaacaaaaaaaaaagggggccaaaaaaaaagaggccgccccccctgtggggaaaaggaaaaaaccccggggggggtgggggccaaaaaaggggcccccgnaaagaaacccctnaaggagggggggggggggggggntaaa

SEQ ID NO: 41192 - protein, 151 aa, Zea mays
  misc_feature: Ceres CLONE 1435811-F
  misc_feature (78)..(78): Xaa is any aa, unknown, or other
  misc_feature (87)..(87): Xaa is any aa, unknown, or other
  misc_feature (140)..(140): Xaa is any aa, unknown, or other
  misc_feature (144)..(144): Xaa is any aa, unknown, or other
MSRLMAAMLLGGARVAGAAKLTGNGNAAGMQALPMPACFLPPRPQAATWTRLCLQAAPRSSQAYDNAPEDGREIGDKXTGRGGRKQXDPTRGTAQGGPPQRKGPGGKQKKKGAKKKEAAPPVGKRKKPRGGWGPKKGPPXRNPXRRGGGGG

SEQ ID NO: 41193 - DNA, 699 bp, Zea mays
  misc_feature: Ceres CLONE 1435812-F
  misc_feature: Translation starting site: 308
aaagctggagctccccgcggtggcggccgctctagaactagtggatcccccgggctgcaggaattcgcacgagaccattacctagaacatcctaatcgaaaaatctcggggatccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggaacacaacagcttcgtcgtggccgaccccttcgcttctcgcagacgctcctgcccgcgcacttcaggcactcgaactttctcagcttcgtgcgccagctcaacacctaacggttcggaaaggtcaatccggaccggtgaagttccgcgacgttgtcttccttccgggcaaaaaccatctcctggcccaaattcccgccggaacaccgggggaaaaccaaaggaaaagggaaagggcccgggcccggctccccaaaaaaaaaaaccgtggcccggaaggggtcc

SEQ ID NO: 41194 - DNA, 701 bp, Zea mays
  misc_feature: Ceres CLONE 1435818-F
  misc_feature: Encodes the peptide sequence at SEQ ID NO. 41195
aaagctggagctccccgcggtggcggccgctctataactagagaatcccccgggctgatcgaattcaagggacaccattacttacaagatctaatcgagaaaagttttttctctttggttggtctgcacatgatggtatgccctttgctgatggcggcctccacatggggcttgagcctaccatcatctgtgtacatgattttcagtgcatggctaaccgcgactacgctcctcatccggttccaggtgcaggccgatcctcatcaacctcatatgtggtgccaagacccatgccatccctcagaacactctacgactgatgacgatggccgttcaagggcatccgcgactttgtcacatccaacccgccacctgatgaagatactcgcctgtatacacgggttggaaattggtgctgacgcaaacttgccttgcgacaatccagcatgcatcacttgctctaaatcatcgccagaacaagaggcacttcctcaggattataccattcatcgataggtcctgtgcaagtcaatcaacacatgttggacacgatctgcaatactctgaaaaagaacaacgttgctcttgacattgttcactatggcgaatcagatgatcaagagcctgacaaactggaagcattcatctctgctgcttacagcagtgatagcagtcccattgctcatgtccctcctggtgaa

SEQ ID NO: 41195 - protein, 54 aa, Zea mays
  misc_feature: Ceres CLONE 1435818-F
MLDTICNTLKKNNVALDIVHYGESDDQEPDKLEAFISAAYSSDSSPIAHVPPGE

SEQ ID NO: 41196 - DNA, 697 bp, Zea mays
  misc_feature: Ceres CLONE 1435826-F
  misc_feature: Encodes the peptide sequence at SEQ ID NO. 41197
aaagctggagctccccgcggtggcggccgctctagaactagtggatcccccgggctgcaggaattcgcacgagaccattacctagaacatcctaatcaaaaatcagatccctcccgcagtctcgcgcgctctcccccacccacccaccccctatccatccatccatcccacctcctgctccacatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtctctgcaggccgccgccgccgcacctgccgccggcgcggtcgacgaggagactcctgcctcctcccctccgtcagatgctagcaagggggtggagaacctggtgatcatcggctctgaccagccggttacaccgctgccatctacgccgcccgggcgaacctgaagcctgtcgtgtttgaagggtgccagatggggggtgtccccggcgggcagctgatgaccaccaccgaggtggagaatttccctggcttcccggacggtatacctgggcctgatctcatggacagaatgcgcaagcaagcggaa

SEQ ID NO: 41197 - protein, 39 aa, Zea mays
  misc_feature: Ceres CLONE 1435826-F
MGGVPGGQLMTTTEVENFPGFPDGIPGPDLMDRMRKQAE

SEQ ID NO: 41198 - DNA, 694 bp, Zea mays
  misc_feature: Ceres CLONE 1435828-F
  misc_feature: Encodes the peptide sequence at SEQ ID NO. 41199
aaagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagaccaaagaggtggcggctgtggaggctaacgaggaggaggaggaggcagcgcctgctgttgctgccactccctgagtcgcagcgaccgaggaag

SEQ ID NO: 41199 - protein, 144 aa, Zea mays
  misc_feature: Ceres CLONE 1435828-F
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVAAVEANEEEEEAAPAVAATP

SEQ ID NO: 41200 - DNA, 715 bp, Zea mays
  misc_feature: Ceres CLONE 1435830-F
  misc_feature: Encodes the peptide sequence at SEQ ID NO. 41201
  misc_feature (479)..(479): n is a, c, t, g, unknown, or other
  misc_feature (510)..(510): n is a, c, t, g, unknown, or other
  misc_feature (554)..(554): n is a, c, t, g, unknown, or other
  misc_feature (613)..(613): n is a, c, t, g, unknown, or other
ctggagctccccgcggtggcggccgctctagaactagtggatcccccgggctgcaggaattcgcacgagaccattacctagaacatcctaatcgaaaaacgcgcgcccaaaggcccccaaggccccaaccccaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcacttnccgccgcagctgccgggagggcatctgcggnagctgcgccatgaacatcgacggcgacaacggcctcgcctgccntcacaagatctccggcgccctcctcgcggtcacggtctcgccgcttccccactgtttcntcgtcaaggacctggtggtggacatgaccaacttctacgccagtaacaaaagcttccagccatggtttcaggccaagggaccacccccccgacaagggaaga

SEQ ID NO: 41201 - protein, 174 aa, Zea mays
  misc_feature: Ceres CLONE 1435830-F
  misc_feature: SWISSPROT Homolog: EC 1.3.5.1 Succinate dehydrogenase (ubiquinone)
  misc_feature (96)..(96): Xaa is any aa, unknown, or other
  misc_feature (121)..(121): Xaa is any aa, unknown, or other
  misc_feature (141)..(141): Xaa is any aa, unknown, or other
MAAALLRRSPAARALLSPALSSRLVASKPHSSSPAPPPPAKADSSTKTFSIYRWDPDSPSTKPHLKDYQVDLSDCGPMVLDALLKIKNEQDPSLTXRRSCREGICGSCAMNIDGDNGLACXHKISGALLAVTVSPLPHCFXVKDLVVDMTNFYASNKSFQPWFQAKGPPPRQGK

SEQ ID NO: 41202 - DNA, 722 bp, Zea mays
  misc_feature: Ceres CLONE 1435833-F
  misc_feature (405)..(405): n is a, c, t, g, unknown, or other
  misc_feature (414)..(414): n is a, c, t, g, unknown, or other
  misc_feature (497)..(497): n is a, c, t, g, unknown, or other
  misc_feature (510)..(510): n is a, c, t, g, unknown, or other
  misc_feature (566)..(566): n is a, c, t, g, unknown, or other
aagctggagctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctcccatcctgacgcagcggcgccagcctgcaggaagccagcccctattcgaganagttcgatncttgctgccttggcgagcttcagccgaatcaggtcgagcatggcggcgggcagtaaatagagcacccaaaacccttcaataangggagacctttgnagaaaccccgaccggccgccaaaccaggggccaatttcccattggcatggccctcntttttcttaagggttgggaaggccaggggcccaacccaaatgggcaaaaaagtgggcccccttttgaacccccccaaggaaaatgggtgtgggcccctttttgtaaaggggggccccaccccctccgggtttaaaaaacacctctccggggggaaa

SEQ ID NO: 41203 - DNA, 741 bp, Zea mays
  misc_feature: Ceres CLONE 1435834-F
  misc_feature (373)..(373): n is a, c, t, g, unknown, or other
  misc_feature (419)..(419): n is a, c, t, g, unknown, or other
  misc_feature (474)..(474): n is a, c, t, g, unknown, or other
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaagccacattttacatcccaccaccagcctccttcccctttccgttccccgaagcgagagcgaagccagcgcccatcttcttcttcctcctccttgttgttggatcgcagctccttcgtcgtagcgtccgatacgccaggtttcctttcgcgagcaacaatctttggcaatggcgtccacgtcgagctcgacgcccagcgccggttgaggtggacgagaggggccggaaagcgaagcgtgcggccggggacgaccccgcggcgcccggcgcanccgtccaagtgggcgacgcggcgcgagcacgagatctactcgtccnagctcctggaggcgatccgcctcgtgcgggcgggggccccccttcggcgcgccgnggggagggggggggcccccccccccaaaagggccctggccaagggggcaaaccggggctttccctttccggggggggggggccccaaatggaanccggccattctttgggtccccgccccccccccttcagggccgggacgggggggggcttccggccccccgttccccccccgggaaaaaagggggccccctcgcccccggggagaagggggcccccccccccccccctaaaaaaaaaaacaaagggtggggcgcctggttccccc

SEQ ID NO: 41204 - DNA, 723 bp, Zea mays
  misc_feature: Ceres CLONE 1435840-F
aaagctggagctccccgcggtggcggccgctctagaactagtggatcccccgggctgcaggaattcgcacgagaccattacctagaacatcctaatcgaagaattcactcctccctctgcctgtattcttcgtttcgcccctgggatcctcgtcacgactcacgccatccgcccccaccgccaccaccagccacaccatctctgttctccagtcacgccagacggccagaacccacaattttcatcacaccaaaccatccactcctcacctttccccccaaacaagtccaatctttacaacgacattgtcgccaactacaacccctttcccttctgggtgcctcaccagattacccactcaaatccagctaccaagcacaaaagctgcggcattttgcatactgtttcatccgcggaaacccatcttgccgccggatccttcgcaaaatccaacgaacgtgcttgctgcccctgttcagtccagactcaaaacatgctgtctgccccgggaaatcccagcgttgccaactaattccgctcggaaaccccccgaggaaatccccccgttcggaagaagcgaattccctcccgggggttccctgggtggtcgccccccccaagctccaggtgggaaccggaactttccccaaaacgggggggttttggcccccccgagggggggcgccctgggagaaggggcgggggcccccctcttggtaaggg

SEQ ID NO: 41205 - DNA, 713 bp, Zea mays
  misc_feature: Ceres CLONE 1435841-F
  misc_feature: Encodes the peptide sequence at SEQ ID NO. 41206
  misc_feature (470)..(470): n is a, c, t, g, unknown, or other
aagctggagctccccgcggtggcggccgctctagaactagtggatcccccgggctgcaggaattcgcacgagaccattacctagaacatcctaatcgaaaacttcttcatctgttgttggtctcctccaaggctcagtaagttacagacaagaccatccaacaagcagtggcaatggtatctataatggcggaaacaatggtccagctgccaaggccaactcaacgaactccatgcaatcaaatggaccggcgtcgtttccctcgccagcaccctcagcatcaaacggcaatatgatgcctgctccccagcactctagccaaatgaattcgccgaccatgccatcaagcctacctcctatgcaaacgcctgcaggtcggcctcaagaacccgagccaaacgagccctcaagctcagtccagaggaatactgcagacctgatgatgcagtcccatattaacagcgtttggncccagtggaagcaatatgaagacagcaaacccggtacctcctggtcctaacgggtgcaactccttagctggcaatcccatgacaaatacccctggaatcatcaacggaatgggaattcgggcctatgggtggccctggtcaaccaaaaaaaccgccatggggaaacacccctttgcaaataacgaaagccccggcccctgaaacacagcccgcatgacttggccaccttgaccccccccccgc

SEQ ID NO: 41206 - protein, 61 aa, Zea mays
  misc_feature: Ceres CLONE 1435841-F
MKTANPVPPGPNGCNSLAGNPMTNTPGIINGMGIRAYGWPWSTKKTAMGKHPFANNESPGP

SEQ ID NO: 41207 - DNA, 703 bp, Zea mays
  misc_feature: Ceres CLONE 1435843-F
  misc_feature (518)..(518): n is a, c, t, g, unknown, or other
cgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagaacgagagccgagatcggagatctaatcacacagctcgagtccaagaccctacnacagctccccacgatgctctctttcttctcaacgggaatggatcctcgcgaaacatcgttcgttggtttgtccccgtggctttccgaggatcgtgccgtttagtaaagtccacaaaactcacagactattgatcgggaaaacttcccgggcgagaactctgtttctgtcccctggtccgttacta

SEQ ID NO: 41208 - DNA, 724 bp, Zea mays
  misc_feature: Ceres CLONE 1435845-F
  misc_feature: Encodes the peptide sequence at SEQ ID NO. 41209
  misc_feature (350)..(350): n is a, c, t, g, unknown, or other
  misc_feature (359)..(359): n is a, c, t, g, unknown, or other
aagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccnaagaagcgntccgcaaggcgcagtgcccgatcgtcgagcgccctcacaactccctcatgatgcacgggcgcaacaacgcaaagaggtcatggctgccgcatcatcaagcataccctggaaatcatcacctgctcacgaatgccaccccctccaggtcgtccgtcacccgatcatcaacaggggacccccggaggatgccccccgtattggttcccctttggtttgggaagaggcagccccgatatttccccccccgggagggggaaaccggggcctttccccccccccccggggggcacggaaagggttttccggaaaattaaaaccttttccaaaggcctttaaaaaaaattaaaaacccccccccgggggcc

SEQ ID NO: 41209 - protein, 159 aa, Zea mays
  misc_feature: Ceres CLONE 1435845-F
  misc_feature (53)..(53): Xaa is any aa, unknown, or other
  misc_feature (56)..(56): Xaa is any aa, unknown, or other
MAEVEQQQDTPKLFNRWTFDDVQVNDISLNDYLAVNATKHAMYLPHTAGRYSXEAXRKAQCPIVERPHNSLMMHGRNNAKRSWLPHHQAYPGNHHLLTNATPSRSSVTRSSTGDPRRMPPVLVPLWFGKRQPRYFPPREGETGAFPPPPGGHGKGFPEN

SEQ ID NO: 41210 - DNA, 728 bp, Zea mays
  misc_feature: Ceres CLONE 1435849-F
  misc_feature: Encodes the peptide sequence at SEQ ID NO. 41211
  misc_feature (270)..(270): n is a, c, t, g, unknown, or other
  misc_feature (623)..(623): n is a, c, t, g, unknown, or other
ggagctccccgcggtggcggccgctctagaactagtggatcccccgggctgcaggaattcgcacgagaccattacctagaacatcctaatcgaaaaatccccctgtgctctcctctcgtggccttgtttcctggcggcgacggctggtcgagcggcgccgcccttggctaggtcttcgctgggtccttccccggcgacgagcgtccatctggggtcgactgaactgagcaggcagtaggaagagacactatgttgttcttctcctacttncaggagctggtggggaaggaggtgacagtggagctcaagaatgacttggcgatccgcgggacgctcccactcgttgaccagtacccctcacatcagctcgagaacacccgcgtagtcgaccagggacagtatccccacatgctttcagtgcgggactgcttcatcagggggttcgttgtggcggacttgctgctcccgcaggaagggttgaatttgaattcctccccgaaccccccaaaagggaggcccccgaagcttatcctgatccccccccctccccccccgggggggggcctgtttccccccattttacaaaacttctttgtcccgggggtgggaaaacaaaccccccntttttctttggggggccgcccgcaaaaaaatttccggggggggagaaagcccccccccccgcgaattttttttgtcttaaaaagagggggtggtggggggggggg

SEQ ID NO: 41211 - protein, 159 aa, Zea mays
  misc_feature: Ceres CLONE 1435849-F
  misc_feature (5)..(72): Pfam Name: LSM Pfam Description: LSM domain
  misc_feature (7)..(7): Xaa is any aa, unknown, or other
  misc_feature (125)..(125): Xaa is any aa, unknown, or other
MLFFSYXQELVGKEVTVELKNDLAIRGTLPLVDQYPSHQLENTRVVDQGQYPHMLSVRDCFIRGFVVADLLLPQEGLNLNSSPNPPKGRPPKLILIPPPPPPGGGLFPPILQNFFVPGVGKQTPXFSLGGRPQKNFRGGRKPPPPRIFFVLKRGGGGGG

SEQ ID NO: 41212 - DNA, 656 bp, Zea mays
  misc_feature: Ceres CLONE 1435850-F
  misc_feature: Encodes the peptide sequence at SEQ ID NO. 41213
  misc_feature (429)..(429): n is a, c, t, g, unknown, or other
  misc_feature (437)..(437): n is a, c, t, g, unknown, or other
  misc_feature (542)..(542): n is a, c, t, g, unknown, or other
  misc_feature (554)..(554): n is a, c, t, g, unknown, or other
tccccgcggtggcggccgctctagaactagtggatcccccgggctgcaggaattcgcacgagaccattacctagaacatcctaatcgaaaaattccagtcttttcagaacgagattgcatcgaggaaactacagaaaagggaccaaatcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcgnagacaagntcgaggctgttgtgcccttcatgggtgaatctgtaactgatggaactcttgctaacttctaaagaaagctggagacagagtcgaggccgatgaccccatagcgcnaatgaaactgantagtcactatagatgtcccaagtcctgaagcttgtgttattgaaaagctcattgctaggggagggcgaccagttactcggggcactaaggttgaaatcatat

SEQ ID NO: 41213 - protein, 94 aa, Zea mays
  misc_feature: Ceres CLONE 1435850-F
  misc_feature (72)..(72): Xaa is any aa, unknown, or other
  misc_feature (75)..(75): Xaa is any aa, unknown, or other
MASRVASGLLRRRAVATLGLLRSHTHVRNYSSQLSALIPATSQCSNLTRRRYYLPNPSLYQVWSRSFASDSXDKXEAVVPFMGESVTDGTLANF

SEQ ID NO: 41214 - DNA, 843 bp, Zea mays
  misc_feature: Ceres CLONE 1435853-F
  misc_feature: Encodes the peptide sequence at SEQ ID NO. 41215
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (332)..(332): n is a, c, t, g, unknown, or other
nnnnnnnnnnnnnnnnnnnnnnnnnnnggaggcagggctcccccccccttttatggggctccacgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacggccggggcggaggacggagtggtcgaacgggaccgcagggaggacctgcggtggtgcaagcaggcgtgcgagtggcaggacggaaaggacacccccgcggaaagaggaaatgcgaaagcaagtggctgtgacccccacccggcaagctgaacgcggggcaaggaacggccaacagcgggtgtgggaccccctacgttctgccttttccgggaagggggtaaagtggccgcgcaccaggtggcttggcccccccccccgagggggtcagcccggggggagagaaccccgggaaggggtgtgggggccggggccccgcgccccccggaaacgggcccgccggacatggggatcaaaaagttcggggtccggcgtgattagaaaaggcccggttccaaagtggcccgggaaaagggtggaaagagggtaactcttttgggggtatatgttgggataaaaggttcgtcttctgggcggggatggtacgtgctaaatccccgggggac

SEQ ID NO: 41215 - protein, 75 aa, Zea mays
  misc_feature: Ceres CLONE 1435853-F
  misc_feature (24)..(24): Xaa is any aa, unknown, or other
MGKGSVGASWWAFLLLAGVLLVVXATAGAEDGVVERDRREDLRWCKQACEWQDGKDTPAERGNAKASGCDPHPAS

SEQ ID NO: 41216 - DNA, 719 bp, Zea mays
  misc_feature: Ceres CLONE 1435861-F
  misc_feature: Encodes the peptide sequence at SEQ ID NO. 41217
ccccgcgggggcggccgctctaaaactagggaatcccccgggctgcaggaattcgcacgagaccattacctaaaacatcctaatcaaaaaccccgctcgccatcggcccgtctcaacgggcacgcgccctaccctctccacaaccaaccccagtaccccacgagatctgctcccatctcttcttctcccccatcgcacgaggtttgcgcccctccccgctcgccgtcggcctgtctcagcccctgaccctccaccgccaccgactccctctcttgccaccgagggaatttggatctaggagccgatgccactacagctctcccccgcccacgattagccctcggctcgggagatgctgacgcccatcgcgaccacgatttgctccctcgtgtcctcggcctcttcctccactctcatcctccctcctccccccgtcctcggttattctcgtcgcctccgccgcgcgttccgctctccccacagcctttgtccgccacatgaccgtcggctgctggatgtaccagtacccgaggcggacgtacccgacgggccgtgaccagacccgacactgtcaaggagagttgcgcctctagcgcccgcgataccaaggatgcagcacagtaccgcatcgatcaggcgagggaaacttgagagaaaacacaaactcgagcggacagggcgcgcgacctccttcgaccactgacaggcccgacgacatt

SEQ ID NO: 41217 - protein, 67 aa, Zea mays
  misc_feature: Ceres CLONE 1435861-F
MLTPIATTICSLVSSASSSTLILPPPPVLGYSRRLRRAFRSPHSLCPPHDRRLLDVPVPEADVPDGP

SEQ ID NO: 41218 - DNA, 693 bp, Zea mays
  misc_feature: Ceres CLONE 1435867-F
  misc_feature: Encodes the peptide sequence at SEQ ID NO. 41219
aagctggagctccccgcggtggcggccgctctagaactagtggatcccccgggctgcaggaattcgcacgagaccattacctagaacatcataatcgagaaattcacctctcggtcgcgtgcgcttcacgcagcggctcagtcagtcctcacaccacgcatctgattctgatcgcaccgccgtcggcccaccgcttcagttggcagttgcgagtggctccaacaatccaccggcaccaacccagcgcggcgccaccggcgacccgtaccccctcccccggagagcgatggcgacggagctgacggcggcgcagctgcgcgcgtacgacggcaccgacccgtccaagcccatctacgtctccgtccggggcaaggtctacaacgtcacctccggccgcggcttctacggccccggcggcgcctacgccgtcttcgcgggccgcgaggccagccgcgccctcggcaagatgtccaaggacgaggccaacgtctccggggacctctccgggctcaccgacaaggagctcggcgtcctcgccgactgggagatcaagttccagccaagtaccccgtcgtcgctcgactcgccgacgacgactgaactcgtcagtctcagactaaattactctgtcctgcctcttgcggagtcagagctgtgcttgactgcttgttgctagttgctttgctaccaata

SEQ ID NO: 41219 - protein, 129 aa, Zea mays
  misc_feature: Ceres CLONE 1435867-F
  misc_feature (4)..(84): Pfam Name: Cyt-b5 Pfam Description: Cytochrome b5-like Heme/Steroid binding domain
MATELTAAQLRAYDGTDPSKPIYVSVRGKVYNVTSGRGFYGPGGAYAVFAGREASRALGKMSKDEANVSGDLSGLTDKELGVLADWEIKFQPSTPSSLDSPTTTELVSLRLNYSVLPLAESELCLTACC

SEQ ID NO: 41220 - DNA, 686 bp, Zea mays
  misc_feature: Ceres CLONE 1435872-F
agctccccgcggtggcggccgctctagaactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccaactcccagctgaccgcgacctacctcgccgtcagcttcgcgctcttcctcgccacgctaccgtcgggcaccgagcctcgccacatggcctctctccagtcgcggggcctcctcctctcctcgagcctgctggccgccgaggaccagctgcggcagctgcgcgcgcgccgcctcgaggacacccacgccaacgcccgccccgccgagatcttcgcgggccaccgcgccgcctggatggaggccgagcgccgcctgcaggcccgcgcctccgccaccgcggaccagccgcctccctctgggcgagctcacctagaccaaggccgaccccgctgggcttcacgcccgcgccaaggaactcgagcgcggagccctcctatctgtatgacctgcttcaccggctcttcgcggccacatcgggggccggggtctcccggggg

SEQ ID NO: 41221 - DNA, 669 bp, Zea mays
  misc_feature: Ceres CLONE 1435880-F
  misc_feature: Encodes the peptide sequence at SEQ ID NO. 41222
  misc_feature (391)..(391): n is a, c, t, g, unknown, or other
  misc_feature (392)..(392): n is a, c, t, g, unknown, or other
  misc_feature (576)..(576): n is a, c, t, g, unknown, or other
  misc_feature (593)..(593): n is a, c, t, g, unknown, or other
  misc_feature (597)..(597): n is a, c, t, g, unknown, or other
caaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttnncacatcgccagccctatctttggtgcagtcattggtacaaacatcagggcacagcagctgcagcaactcgtgctacctgtgatcaacaagtagctctggcaaacctttctccctactctcagcaacaacaattttctccatttcaccaactgtcttacattgaacgggctgcttaattgcagcnacactattacatttagncagntaggtactggctactctagaaaaaaaaattcttccatttaacaaatgggccgactgaaccccgttgcttatt

SEQ ID NO: 41222 - protein, 100 aa, Zea mays
  misc_feature: Ceres CLONE 1435880-F
  misc_feature (74)..(74): Xaa is any aa, unknown, or other
MATKIFSLLMLLALSACVANATIFPQCSQAPIASLLPPYLPSMIASVCENPALQPYRLQQAIAASNIPLSPLFXTSPALSLVQSLVQTSGHSSCSNSCYL

SEQ ID NO: 41223 - DNA, 734 bp, Zea mays
  misc_feature: Ceres CLONE 1435883-F
  misc_feature: Encodes the peptide sequence at SEQ ID NO. 41224
  misc_feature (289)..(289): n is a, c, t, g, unknown, or other
  misc_feature (381)..(381): n is a, c, t, g, unknown, or other
  misc_feature (382)..(382): n is a, c, t, g, unknown, or other
tccccgcggtggcggccgctctagaactagtggatcccccgggctgcaggaattcgcacgagaccattacctaaaacatcctaatcgaaaaacaaaaccctagctttccctcctcccctgttttgcggcgcgccacgaactcgcgacgctctcgagagatccatggatcggcgcaagggcggcaaccgcgacgccaacggcagcctggtcgaggccacggcgtcgcggctgagggtcgaatccgacgaggaggcggaagaggtggggatggaggtggaagagagcttcnacgcgggggtggaagacgagcaggcggcggcggaggtgattggaagcgaaaagaccagcgccgactactacttcgactcctactcccacttnncgtatcatgaagaaatgctaaaagatgtcgttcgggacaaaacatatcaaaatggtatcacccagagtagctttcttatcaagaaacaagtagtcccttgatgttggtggctggactggaatttctttcctctttctgggcaaaggcaggagctaaacatgtctatggcatggatggtccccgagggcaaaactgcgccgggaaattttaaaaccaatgggatttccaaaggcccaacgggaataaagggaaagggaaaaaaaaaaccttcccgcccccaatagtggtcctcccccaaggggggggggttttccccccggtccaaaaattttaaaacccttcctatgcccgg

SEQ ID NO: 41224 - protein, 106 aa, Zea mays
  misc_feature: Ceres CLONE 1435883-F
  misc_feature (43)..(43): Xaa is any aa, unknown, or other
  misc_feature (73)..(73): Xaa is any aa, unknown, or other
  misc_feature (74)..(74): Xaa is any aa, unknown, or other
MDRRKGGNRDANGSLVEATASRLRVESDEEAEEVGMEVEESFXAGVEDEQAAAEVIGSEKTSADYYFDSYSHXXYHEEMLKDVVRDKTYQNGITQSSFLIKKQVVP

SEQ ID NO: 41225 - DNA, 728 bp, Zea mays
  misc_feature: Ceres CLONE 1435899-F
  misc_feature: Encodes the peptide sequence at SEQ ID NO. 41226
  misc_feature (140)..(140): n is a, c, t, g, unknown, or other
  misc_feature (143)..(143): n is a, c, t, g, unknown, or other
  misc_feature (144)..(144): n is a, c, t, g, unknown, or other
  misc_feature (146)..(146): n is a, c, t, g, unknown, or other
  misc_feature (368)..(368): n is a, c, t, g, unknown, or other
  misc_feature (369)..(369): n is a, c, t, g, unknown, or other
  misc_feature (383)..(383): n is a, c, t, g, unknown, or other
  misc_feature (515)..(515): n is a, c, t, g, unknown, or other
aaagctggagctccccgcggtggcggccgctctagaactagtggatcccccgggctgcaggaattcgcacgagaccattacctagaacatcctaatcgaaaaaccctacactgagaaccgcagaagacagggcgtctttncgnntnactttcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccgggtgacagaccattgnngggagtgatgatgncttcaacaccttcttcagtgagactggcgctgggaagcagtccccccgtgctgttttttgtgaccttgacccactgtcatcgatgaaggtgaggatggggacctaacgccaagttcttccattttgaggagnttatcagggggaaggaggatgcagcccacaacttccgttcggggccccaaaccatttgggaaggaaatttgtaactttggcccttgaccccctccggaaacttggaaaaaaattcgctgggttccgggggtttcccccctttacaaccttttggtggaaaaaaaggttttcggggttttgtttccccccccggggcgccgtttcttttttata

SEQ ID NO: 41226 - protein, 38 aa, Zea mays; identical to SEQ ID NO: 17326
  misc_feature: Ceres CLONE 1435899-F

SEQ ID NO: 41227 - DNA, 601 bp, Zea mays
  misc_feature: Ceres CLONE 1435912-F
  misc_feature (206)..(206): n is a, c, t, g, unknown, or other
  misc_feature (207)..(207): n is a, c, t, g, unknown, or other
ggagctccccgcggtggcggccgctctagaactagtggatcccccgggctgcaggaattcgcacgagaccattaactagaacatcctaatcgaaaaatcgcacatattattgagaccaactagcaacatagaaagcacaatagtgtaccaacaatggcagccaaaatattttgcctccttatgctccttggtctttctgcaagtgnnctgctacggcgaccattttcccgcaatgctcgcaagctcctatagcttcccttcttcccccgtacctctcaccagcggtgtcttcggtatgtgaaaaacccaattctttcaacccctacaggaatccaaacgggcaatcccagctggcattctaccttaatcacccttgttcctccaaaattcatcaagccctttaaaaaaagtaccttgggggctttttttggccaaaaaaactccgggggccaaaaaacttcaaaaaaattttttgtttaaaaaaaacatttttggccactctccaaaaaaaaaaagttttttttccctttccccaaccaaaaggtgtctttaaaaacccccccccttttttttttttgcaaaaccaaacaaccccccctca

SEQ ID NO: 41228 - DNA, 691 bp, Zea mays
  misc_feature: Ceres CLONE 1435916-F
  misc_feature: Encodes the peptide sequence at SEQ ID NO. 41229
  misc_feature (1)..(1): n is a, c, t, g, unknown, or other
  misc_feature (389)..(389): n is a, c, t, g, unknown, or other
  misc_feature (390)..(390): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (420)..(420): n is a, c, t, g, unknown, or other
  misc_feature (423)..(423): n is a, c, t, g, unknown, or other
  misc_feature (428)..(428): n is a, c, t, g, unknown, or other
naaagctggagctccccgcggtggcggccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtggggaacgaaaaggnncccccaaaaagaagnnnnnnannnaccccntgnaccangctaggcgcagcagcatgggcgccgggatcagggtcctggcggcgctcttggcggcgctcgcggcagccaccgccggcgtgacggcgcagctgcggcaggactactacgcggcggtgtgcccggacctggagagcatcgtgcgcgccgcggtgtccaagaaggtgcaggcgcagcccgtcgccgtgggcgccaccatccgcctcttcttccacgactgcttcgtcgagggctgcgacgcgtcggtgatcctggtgtccacggg

SEQ ID NO: 41229 - protein, 82 aa, Zea mays
  misc_feature: Ceres CLONE 1435916-F
  misc_feature: SWISSPROT Homolog: EC 1.11.1.7 Peroxidase
MGAGIRVLAALLAALAAATAGVTAQLRQDYYAAVCPDLESIVRAAVSKKVQAQPVAVGATIRLFFHDCFVEGCDASVILVST

SEQ ID NO: 41230 - DNA, 675 bp, Zea mays
  misc_feature: Ceres CLONE 1435921-F
  misc_feature: Translation starting site: 192
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgaggtgaggtttagcccgttgcgatctagccgattcgttgcttcgttaggattgtctcctcttatggaatctgttggattggttctgtcgctctgttctgttcgtgtccgcgaattcgatattgaaatctgagacgcaacctgttgggtctgtctggctgcagatgattgtagaggcgatcgcctgccctcaaggagaggaaggggtcgagctcggtggccatcancaagtacgtcgaggggaagcacggcggcaagctccccaccaacttccgcaagcagctcaccgtgcagctgaagaagctcgc

SEQ ID NO: 41231 - DNA, 685 bp, Zea mays
  misc_feature: Ceres CLONE 1435923-F
  misc_feature: Encodes the peptide sequence at SEQ ID NO. 41232
ctccccgcggtggcggccgctctagaactagtggatcccccgggctgcaggaattcgcacgagaccattacctagaacatcctaatcgaaaaaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaaggtatggatctcgctcgccttactcgagaagcacaaggtaccgaagtcgctctaggagtgtcgactctagtgatgctgaaaaccctgggaacaacctgtatgtgactggtttgtcagctcgtgtaacggatcgagatctggagaagcacttctccactgagggtgaggtgattgatgcaagcgttgtatatgatccttggacaagggaatcacggggttttggttttgttaccatggctgctgttaaagatgcagatcgctgcatcaaatatctggaccgttctgtgttgcaaggtcgggtcataactgttgagaagattttgttgacagcaacagggtagatgttggtagctgctctgcaacaaactgatacaacctaacaccaaaccatgccaacctcagccaaagggttgtatgccctacattgcaaagagaagacgaggtagaaccccaacacctg

SEQ ID NO: 41232 - protein, 120 aa, Zea mays; identical to SEQ ID NO: 39865
  misc_feature: Ceres CLONE 1435923-F
  misc_feature (40)..(111): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase

SEQ ID NO: 41233 - DNA, 648 bp, Zea mays
  misc_feature: Ceres CLONE 1435932-F
  misc_feature: Translation starting site: 210
  misc_feature (426)..(426): n is a, c, t, g, unknown, or other
  misc_feature (442)..(442): n is a, c, t, g, unknown, or other
  misc_feature (481)..(481): n is a, c, t, g, unknown, or other
  misc_feature (545)..(545): n is a, c, t, g, unknown, or other
  misc_feature (613)..(613): n is a, c, t, g, unknown, or other
  misc_feature (624)..(624): n is a, c, t, g, unknown, or other
  misc_feature (644)..(644): n is a, c, t, g, unknown, or other
  misc_feature (645)..(645): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcttaatcgaaaagcgaggtcgaaatccccaaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcaggggtcagagtaccctacccagcagaccagcaaatgctcatataccaagggaaaattctgaaggatgagaccactttggaaagcaacggagttgctgagaacagcttccttgttantatgctgtccaaggcntaggcatcgtcaagtggagcttccaccgctactgctgcnaaagctcctgcaactccagcccaacctgctgcccctggcacatcagttgtaagaacacctacancagctcctggtgccacagctgaaacggcaccctccagtgcacagactcaggctgctccagctgctacngctgctgcatncgatgatgctgatgggtacnnccn

SEQ ID NO: 41234 - DNA, 672 bp, Zea mays
  misc_feature: Ceres CLONE 1435937-F
  misc_feature: Encodes the peptide sequence at SEQ ID NO. 41235
aaagctggagctccccgcggtggcggccgctctagaactagtggatcccccgggctgcaggaattcgcacgagaccattacctagaacatcctaatcgaaaaaagtcgccgactagactggctcacgccatgacttcgatgggtggcttacgtggtgcgcctcacgctctccatagcaatgaatcaaaccgtctgagcatctctagagacagggctgggtcacacagaaccgggcttgtgatcagggctcatcataaccagtctgggacggatagaagaccccgggcactgaatgggctcgaagcagctggcttaaaaggtggctcgttcgttaagtctgccgtggccgctcaaactcttgctattagagttggacatcctcctcctccttgcggtggtctacctgaaacatataactcacacctaccactacacttttctctgagcttgagagacccgtgttacctacagccattggctccctgataccctgcagctagagtcaaataatctgctcattagatcatccacgttaagactttgatcgacgaataagcttggacggacgtacaagaggatctgcgctcaataccatcatacctccattacgatctaagcaccgctgtctccgctaaacctatgcaacacaaccaagcctcccagagctcgctg

SEQ ID NO: 41235 - protein, 118 aa, Zea mays
  misc_feature: Ceres CLONE 1435937-F
MTSMGGLRGAPHALHSNESNRLSISRDRAGSHRTGLVIRAHHNQSGTDRRPRALNGLEAAGLKGGSFVKSAVAAQTLAIRVGHPPPPCGGLPETYNSHLPLHFSLSLRDPCYLQPLAP

SEQ ID NO: 41236 - DNA, 652 bp, Zea mays
  misc_feature: Ceres CLONE 1435950-F
  misc_feature: Encodes the peptide sequence at SEQ ID NO. 41237
  misc_feature (572)..(572): n is a, c, t, g, unknown, or other
  misc_feature (586)..(586): n is a, c, t, g, unknown, or other
tggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatctctaattccccataccgtccaccggtcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcggggacatcacgatgatgccttcagcaccttcttcagccagactggtgctgggaagcacgttccccgtgcaatcttcgttgatctagaacccactgtgatcgatgaggtgcgcactggcacgtaccgccagctctttccacctgagcagctcatcagtgggcaggaggatgccgctaacaatttcgccgtggncactacacaattgncaaagagattgttgatctgtgccttgaccgtatccgcagcttgctgacaactgcaccgccctccag

SEQ ID NO: 41237 - protein, 93 aa, Zea mays
  misc_feature: Ceres CLONE 1435950-F
  misc_feature (74)..(74): Xaa is any aa, unknown, or other
  misc_feature (79)..(79): Xaa is any aa, unknown, or other
MAKCLEIRPRGHHDDAFSTFFSQTGAGKHVPRAIFVDLEPTVIDEVRTGTYRQLFPPEQLISGQEDAANNFAVXTTQLXKRLLICALTVSAAC

SEQ ID NO: 41238 - DNA, 662 bp, Zea mays
  misc_feature: Ceres CLONE 1435962-F
  misc_feature: Encodes the peptide sequence at SEQ ID NO. 41239
  misc_feature (164)..(164): n is a, c, t, g, unknown, or other
  misc_feature (369)..(369): n is a, c, t, g, unknown, or other
  misc_feature (372)..(372): n is a, c, t, g, unknown, or other
  misc_feature (394)..(394): n is a, c, t, g, unknown, or other
  misc_feature (397)..(397): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagaagcgcagaagaaacccnattcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccgggtcaccctgcgccgccggtccanccntgcacgccgggtcatgtgccgnccnccngttcatctgcccgccgccaccatgccactaccctactcaaccgcccccgggctcagcctcatccccagccacacccatggcccgtgccaacaggcgcaatcaagccccgtgccagctgcagggaaactggccgggtttggagaccccccaatcctggggcaatgcctccaagtcctgagggttaaggggaagcccgaagggaacccccctattggtccccctcaggccacatttttggaaaacatgtttccccccacctcgg

SEQ ID NO: 41239 - protein, 136 aa, Zea mays
  misc_feature: Ceres CLONE 1435962-F
  misc_feature (65)..(65): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
MRVLLVALALLALAASATSTHTSGGCGCQPPPPVHLPPPVHLPPPVHLPPPVHLPPPGHPAPPVXPCTPGHVPXXXSSARRHHATTLLNRPRAQPHPQPHPWPVPTGAIKPRASCRETGRVWRPPNPGAMPPSPEG

SEQ ID NO: 41240 - DNA, 683 bp, Zea mays
  misc_feature: Ceres CLONE 1435995-F
  misc_feature: Encodes the peptide sequence at SEQ ID NO. 41241
aagctggagctccccgcggtggcggccgctctagtctagtggatcccccgggctgcaggaattcgcacgagaccattacctagaacatcctaatcgaaaaaacgacttcctgcagtcctgcgctgcgcccctcctttccgcctccacgctgccgacgtccaccacacagcacggtcgagtcacccgatccctccatggcggcggcggtggcggcggtcgcggctgccacgacggcggaggacgaggcgcgcctgctgcgtctggaggagcaggcggagcacggcggcggcggcgcctgggactacctctgcctcgcccgccggctccgcgcccgccgccccgcccacgtcctccgcgtcggcctcgctctcctcaacaacggctccgctcgctccggtctcgcctcagaacagtggacgctctacgagcaagtggccacggcggccatggattgccagcgtctccatgtggcaaaggactgtaatggaatcctttacaagccattttctgggagcacccgggttgcccgggtaaaagctcttctgttttgaagcgaaaagggaatggggcttgaacctgaaaaaaacttacccccaaattcctggaaaactaattccttttggccccaaattgttccaccagaaggaaaaaattcctttttgccaaaaacccccaaggcatat

SEQ ID NO: 41241 - protein, 118 aa, Zea mays
  misc_feature: Ceres CLONE 1435995-F
MAAAVAAVAAATTAEDEARLLRLEEQAEHGGGGAWDYLCLARRLRARRPAHVLRVGLALLNNGSARSGLASEQWTLYEQVATAAMDCQRLHVAKDCNGILYKPFSGSTRVARVKALLF

SEQ ID NO: 41242 - DNA, 822 bp, Zea mays
  misc_feature: Ceres CLONE 1436004-F
  misc_feature: Encodes the peptide sequence at SEQ ID NO. 41243
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
tggtgtggggcgcggggggggcgcgccctccgttctgccccccggtgggtggtgttgcggcggcgggggtccccccgnnntnnnntaaagctggagctccccgcggtggcggccgctctataactagtggatcccccgggctgcaggaattcgcacgagaccattacctagaacatcctaatcgaaaaaaccatattattgagaccaacaagcaacatagaaagtggagtccagtagcaacaatagagcaacagtggcgaccaagatattttccctccttatgctccttgctctttctgcatgtgttgataacgcgacaattttccctcaatgctcacaagctcctatagcttcccttcttccccccataccttccatcaatgatagcttcagtatgtgaaaacccagctcttcaaccctatagggtgccacaaagcaatcgcagcaagcaacataccctttatccacccttggttgtcacaatcccccaagcccttatcttttggtgctgctcgttggttacaaatcatccggggtgtcgagaagcctggcgccaacttgggtggctaccttggggaaccaacccagggtagccttcttgggcaacacccttttcttccgtagcttctccgggaacaaacaattttctttccattttccaccctacgggtccaccccttggaacgggggccgggcatttcctgcccgctagccaccccgttaaccatttggcgcccagccttgtgctgcgggtctttaactcgtcccggcaacagaagaagccgcccgtccaaattatcaacccggtttgggtgtcggccg

SEQ ID NO: 41243 - protein, 39 aa, Zea mays
  misc_feature: Ceres CLONE 1436004-F
MLLALSACVDNATIFPQCSQAPIASLLPPIPSINDSFSM

SEQ ID NO: 41244 - DNA, 647 bp, Zea mays
  misc_feature: Ceres CLONE 1436013-F
  misc_feature: Encodes the peptide sequence at SEQ ID NO. 41245
  misc_feature (449)..(449): n is a, c, t, g, unknown, or other
  misc_feature (492)..(492): n is a, c, t, g, unknown, or other
  misc_feature (499)..(499): n is a, c, t, g, unknown, or other
ctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctcccagtgttgttgttacangtgcctctagagggattggaaaggcaactgctctagcccttgnaaaagcnagatgcaagggtctggtaaattatgctcggtcttcgaaagaggctgaagaggtctccaaaggaattgagcatctggtggtgaggctatcaccttgggagagatgtttcaaaagaactgatgtaaagtctatgatgaaagccgctctaa

SEQ ID NO: 41245 - protein, 144 aa, Zea mays
  misc_feature: Ceres CLONE 1436013-F
  misc_feature: SWISSPROT Homolog: EC 1.1.1.100 3-oxoacyl-[acyl-carrier-protein] reductase
  misc_feature (79)..(79): Xaa is any aa, unknown, or other
  misc_feature (93)..(93): Xaa is any aa, unknown, or other
MAAAAAAAAAVSSPIAPRAVAAAASRRGFVTFGGGAARSSPTLRSGRGFSGVQTHVAAVEQAVVKDATKLEAPSVVVTXASRGIGKATALALXKARCKGLVNYARSSKEAEEVSKGIEHLVVRLSPWERCFKRTDVKSMMKAAL

SEQ ID NO: 41246 - DNA, 702 bp, Zea mays
  misc_feature: Ceres CLONE 1436016-F
  misc_feature: Encodes the peptide sequence at SEQ ID NO. 41247
aagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgacccacagcgttcccccttctcccattgcttctctcatttctcaccaccgccgccgctacgccctttcgacaacaccatgagggagtggatctcgatccacatcggccaggccggtatccaggtcggaaacgcgtgctgggagctgtactgcctcgagcatggtattcaggctgatggtcagatgcccggtgacaagaccattgggggaggtgatgatgctttcaacaccttcttcagtgagactggcgctgggaagcacgtcccccgtgctgtttttgttgaccttgagcccactgtcctccatgaggtgaggactggcacctatcgccagctcttccatcctgagcagctcatcagtggcaaggaggatgcagccaacaacttcgctcgtggtcactacaccattggccaggagattgttgacctgtgccttgaccgcatcacgaagcttgcacataattgcactggtctccagggcttccacttcttcgactgctttaggtggaggaacgggctctgggcttggttctctcctcctggagcgcctgtct

SEQ ID NO: 41247 - protein, 158 aa, Zea mays
  misc_feature: Ceres CLONE 1436016-F
  misc_feature (49)..(155): Pfam Name: Tubulin Pfam Description: Tubulin/FtsZ family, GTPase domain
MREWISIHIGQAGIQVGNACWELYCLEHGIQADGQMPGDKTIGGGDDAFNTFFSETGAGKHVPRAVFVDLEPTVLHEVRTGTYRQLFHPEQLISGKEDAANNFARGHYTIGQEIVDLCLDRITKLAHNCTGLQGFHFFDCFRWRNGLWAWFSPPGAPV

SEQ ID NO: 41248 - DNA, 665 bp, Zea mays
  misc_feature: Ceres CLONE 1436018-F
  misc_feature: Encodes the peptide sequence at SEQ ID NO. 41249
  misc_feature (477)..(477): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaagtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccgccgccgccgccggaagcaacaaggctgaggaggtggacgacctccagtaccttattgacaactccgaagacatcccacccaacgaccctgacggggccccctgagggcggcgcgggncgccgactaccaacaacnaccttctcttccaagatcaggaccaggacctcccagactacgagccgcagatcgacgagacccacgtcgtggtcctcaccgccgccaacttctcctccttcctcgccgccacccgccatgtcatggttgagttctacgccccctggtgtggccactgccgcgagctcgcc

SEQ ID NO: 41249 - protein, 55 aa, Zea mays
  misc_feature: Ceres CLONE 1436018-F
MGSTRTSHPSFPVLLLFLLATAAAAGSNKAEEVDDLQYLIDNSEDIPPNDPDGAP

SEQ ID NO: 41250 - DNA, 806 bp, Zea mays
  misc_feature: Ceres CLONE 1436030-F
  misc_feature: Encodes the peptide sequence at SEQ ID NO. 41251
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (57)..(57): n is a, c, t, g, unknown, or other
gaacgcaaccaccttacannnnnnnnnnnnnnnnnntttttnnnnnttcagagtggngctccccgcggtggcggccgctctagaactagtggatcccccgggctgcaggaattcgcacgagaccattacctagaacatcctaatcgaaaatacggcataccacactagagccgccgccgccgccgccgctgccgtttcgcgcaccgtaccctagccctcgtcagcggcggcttcgagctcctccagccatgacgttcaagcggaggaatggcggacgcaacaagcacgggcgcggtcacgtcaagtacatccgctgctccaactgtgccaagtgctgccccaaggataaagctatcaagcggttcttggtgaggaacattgttgagcacgctgccgtgagagatgtgcaggaggcctgtgtacaggatggatatgttctccccaatttgtatgccaacccccctcactggggcctcatgggcaaaccatgcgcaccttgggccgggtccccccctcgggaggaacaggaggaactgggagccccccccagggcctcccaaccccgggaatggagggcccacggcccgggtcaggggccgccccccggcccaggcggggggacgtttctggcggccgccacctgcggccagcctccttcggacatagaggttgtggggatccccgctccgggcctttcccgtgtggccggccccattcccgcggccgttaggaccgccgctgtcctctgtttgccccccgcatatcctcacgcgataccctccccccgccgtttgtgccggtccccg

SEQ ID NO: 41251 - protein, 186 aa, Zea mays
  misc_feature: Ceres CLONE 1436030-F
  misc_feature (1)..(115): Pfam Name: Ribosomal_S26e Pfam Description: Ribosomal protein S26e
MTFKRRNGGRNKHGRGHVKYIRCSNCAKCCPKDKAIKRFLVRNIVEHAAVRDVQEACVQDGYVLPNLYANPPHWGLMGKPCAPWAGSPPREEQEELGAPPRASQPREWRAHGPGQGPPPGPGGGTFLAAATCGQPPSDIEVVGIPAPGLSRVAGPIPAAVRTAAVLCLPPAYPHAIPSPRRLCRSP

SEQ ID NO: 41252 - DNA, 697 bp, Zea mays
  misc_feature: Ceres CLONE 1436033-F
  misc_feature: Encodes the peptide sequence at SEQ ID NO. 41253
agagctggagctccccgcggtggcggccgctctagaactagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgagaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctgccgtgttatagccagattaaagaaggaaagagatgacgctagagcacttttggctcaagctgagagacagattcctgcgtcagttgcaggagctgctcctgcagctgttgtttccaatggaaaaagagtaattgaagatgaaattggccctgacgggaagaagatccgtcc

SEQ ID NO: 41253 - protein, 122 aa, Zea mays
  misc_feature: Ceres CLONE 1436033-F
  misc_feature (18)..(87): Pfam Name: Prp19 Pfam Description: Prp19/Pso4-like
MDDIVPVKTNTIVKPRPLQAASIPGLLGIFQNEWDALMLSNFALEQQLHTARQELSHALYQHDAACRVIARLKKERDDARALLAQAERQIPASVAGAAPAAVVSNGKRVIEDEIGPDGKKIR

SEQ ID NO: 41254 - DNA, 684 bp, Zea mays
  misc_feature: Ceres CLONE 1436034-F
  misc_feature: Encodes the peptide sequence at SEQ ID NO. 41255
  misc_feature (460)..(460): n is a, c, t, g, unknown, or other
ctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaagggtctggtggaactccggcgtcaagtccatcccgtccatcttccaccacccgccggaagccctgagcgacataatttctccggcgcctctgccgccgtcgccgccctcgggcgcccgcatccggtggtggacctctcggtgacgcggcgcgaggacctagtcgagcaggtgaggcacgcggccgggaacggtgggcttcttctgcctggtgaaccacgantgcccgaagacctgatgggcggcatgctccccggggggcgccagtccaacaagggccccggggagggaaaacaaggcctcttctcagggaaactgtttggaaactgggctttccccccaatttaaacttttaaaggggtgttgcgccaaaatggccaaccccctcttttgggggggggccccaaaaccccccccgcggggaggatcccccaacccctccagaaa

SEQ ID NO: 41255 - protein, 53 aa, Zea mays
  misc_feature: Ceres CLONE 1436034-F
MAPTTATKDDSGYGDERRRELQAFDDTKLGVKGSGGTPASSPSRPSSTTRRKP

SEQ ID NO: 41256 - DNA, 641 bp, Zea mays
  misc_feature: Ceres CLONE 1436037-F
  misc_feature: Encodes the peptide sequence at SEQ ID NO. 41257
agagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgaaactgagactgagaccaaggaggccgaggccgttgctgagccgacccgagcagagccccagggaaccaaaaccgggagggcccccccccccggcgccaaaaacggggggtccagggaaacccaaaaaccgggggccccccccccccccgggaaaaaaaaaaacgaaagggggttttttttccccccccctgtagaaggggtctcgttttacccccaaaaaaaaaccccccccccaaaaaa

SEQ ID NO: 41257 - protein, 133 aa, Zea mays
  misc_feature: Ceres CLONE 1436037-F
MAAVEVQVPTAAPVEEAAQLAAASAVETPNEETAAPAVETEVVVAKEPEPVEAETETETKEAEAVAEPTRAEPQGTKTGRAPPPGAKNGGSRETQKPGAPPPPGKKKNERGFFFPPPVEGVSFYPQKKTPPPK

SEQ ID NO: 41258 - DNA, 734 bp, Zea mays
  misc_feature: Ceres CLONE 1436041-F
  misc_feature: Encodes the peptide sequence at SEQ ID NO. 41259
  misc_feature (370)..(370): n is a, c, t, g, unknown, or other
tggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccactggccgcgcaatgccgccctctgtcgatgcaatgccggcccccggagacgccgcgggcggcggcgacgtgcgcatgatctcctccaaggagctcgctctcacgcggtccgacgacgacctctggatctccatctccggcgacgtgtacgacgtcacgccctgtgctccccccacaaccgggcnggcaacttcccggctcctaccctgggccgggcaaggaaccccccgaaacccttcccccgctaacaccccgcccttgggggggcccgctccccccgccggttttttttgtgggggcgcctttccgaattagggcggttcccccccggggtccccgaaataccccccccctccccggcgaagtttacccccgcggggggctttttaaaaagggtgggccccccccccaaggggggaacctttgcttatgggggggctccccttttttaaggcgggtgttattcattttttctcggggtggggagaagggggtgggggcccccctccccggggggggggacacaccccctccctaggagaaaaaaac

SEQ ID NO: 41259 - protein, 100 aa, Zea mays
  misc_feature: Ceres CLONE 1436041-F
  misc_feature (58)..(58): Xaa is any aa, unknown, or other
MPPSVDAMPAPGDAAGGGDVRMISSKELALTRSDDDLWISISGDVYDVTPCAPPTTGXATSRLLPWAGQGTPRNPSPANTPPLGGPAPPAGFFCGGAFPN

SEQ ID NO: 41260 - DNA, 705 bp, Zea mays
  misc_feature: Ceres CLONE 1436042-F
  misc_feature: Encodes the peptide sequence at SEQ ID NO. 41261
agagctggagctccccgcggtggcggccgctctagaactagtggatcccccgggctgcaggaattcgcacgagaccattacctagaacatcctaatcgaaaaaccctcccccatttttcccttggttggccgtcccctctcctcccatggcagccgcccaccatttcttcctcctccatagatctccccctcccccatgcagcaaggatcgagaagaggaggagcaagatggattgaagaggaagagaggatcaaggagatgttctacccccccatctattgcagattttcttggggaaactctaggtacttgattcatgttgggaatgaggggagtagcagcacgtccaccttcactctcataataacgctgcccaggcacaaccatgatttaattagaaacttcttgtcaaaggatgtttgtctttaactagtcatgcacactagttaattcaattcatgtcgttatggttatcttctcattgctagccgattattaatgtctattatgttttcttatcatgatatctgcttatactctgttgcttccacgtttatgcaaattttcaaaggagatgctgtcaaaattttatatatgaatgttagttgtgtagtttagtagcatttcaagatgtttgtggatccctgggtgttacagaagacgagagctataatattgcttttcacaacctacgaacaaaagtt

SEQ ID NO: 41261 - protein, 55 aa, Zea mays; identical to SEQ ID NO: 16588
  misc_feature: Ceres CLONE 1436042-F

SEQ ID NO: 41262 - DNA, 683 bp, Zea mays
  misc_feature: Ceres CLONE 1436043-F
  misc_feature: Encodes the peptide sequence at SEQ ID NO. 41263
  misc_feature (414)..(414): n is a, c, t, g, unknown, or other
  misc_feature (467)..(467): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcgaaaaaaccgagacaccgcgtgcgaaccaagcagaccccagcagaagaagcgaagtcgtagccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaactttcccgagttaaagcctgaggaggttgctgggatgataaaggactttgatgaacctggaactcttgcaccaactggtctttttgttggaggtacgaagtacatggtgatccnaggtgaacccggagttgtcatcccgagaaagagggcactggagcattactatncagaaactggcatgtccnttgatatcgtatctatgatgagcccatgactccagggcatgccatatggtggtggaaaagctcggcgattcctgatcgaacagggcttcaaagtttgccaaagggctttttggccatgggcccctaaatttcccctcctttggttccaaaaaatgggggctttggcacaggcttgggcatattcccccggggaaaaat

SEQ ID NO: 41263 - protein, 108 aa, Zea mays
  misc_feature: Ceres CLONE 1436043-F
  misc_feature (2)..(106): Pfam Name: Profilin Pfam Description: Profilin
  misc_feature (76)..(76): Xaa is any aa, unknown, or other
  misc_feature (94)..(94): Xaa is any aa, unknown, or other
  misc_feature (100)..(100): Xaa is any aa, unknown, or other
MSWQAYVDDHLLCDIEGQHLSAAAIVGHDGSVWAQSENFPELKPEEVAGMIKDFDEPGTLAPTGLFVGGTKYMVIXGEPGVVIPRKRALEHYYXETGMSXDIVSMMSP

SEQ ID NO: 41264 - DNA, 897 bp, Zea mays
  misc_feature: Ceres CLONE 1436065-F
gaacccccctcaacattctccactttcgtgaatcgccccaccttccctctccttaaactggcactccccgcggtgggggccgctctagaactagtggatcccccgggctgcaggaattcgcacgagaccattacctagaacatcccaatcgaaaaagagagagaaactctaaggggagaggacagacgacggacatacacgttaatttttaggtaccagatcatctgatttctcacacgccaaaatgttgtttggagctcattaacaccatcctgtaatgcctgtgattttacgggaaatggaggatcctcctgtccatcccatgtctaagtctaaccatggctccttgtcaggaaagggtcacgagatgaaacatttatgccatatagttctgcgataggtattccacgcatcggagccagaccgggctgccccccccaaccttcttccatcaatctgagacgcagttcaaataaacccccccacccggcttcaatcacaaccaacgaattacaaattatttggaaaaggaatattcccgcggcgcccgccggaatattcaccacttttacaccccccgcgaaaaagcactgttctccccccctttcttttgcccccccgaaccaaaacatataccagacccccacccttaaatccctgagcaatcccccttttaaaccagctgggattggatatatctcaaattcgtgcgtggccgggggttcccatcacccgagatgatacttcctcccaccattgcccaacccggtgcgcgcgtttcccccccctacaacgcggttaaaatatatataataaattcttccgcctatgcttttccatcgggtgcgacccgccgcagaaccaaaccacgctatttcatgttctccacactttaca

SEQ ID NO: 41265 - DNA, 687 bp, Zea mays
  misc_feature: Ceres CLONE 1436066-F
  misc_feature: Translation starting site: 195
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
aaagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaaaagnnncaaacggcgatgtacctgccgcacaccgcggggcgctactccaagaagcggttccgcaaggcgcagtgcccgatcgttgagcgccctacaaactcccctcatgatgcacgggcgcaacaaccggaaagaaggtcatgggctgtccccattcatcaaggcatacccctgaaaatcattcaccttgctccccgaagcccaaccccatccagggtcgtccgtccaacccgatcatcaaacagggggccccccggggagggatgcccccccgcaaattggtttccccctcgggggttttttgaaaaaaggcaaggccccgggaaaaatcctcccccccctggaagggaggggggaaaacacagggcccttttctc

SEQ ID NO: 41266 - DNA, 693 bp, Zea mays
  misc_feature: Ceres CLONE 1436073-F
  misc_feature: Encodes the peptide sequence at SEQ ID NO. 41267
aagctggagctccccgcggtggcggccgctctagaactagtggatcccccgggctgcaggaattcgcacgagaccattacctagaacatcctaatcgaaaacttcaaaaatcaagttgattatgcggataccgcaaacactgcaaattcggttgttccctacccttctagagtaatctctccacacacacactcacacgctgctgccggctgccctcctcccgccccactcgtcccctccgaaccaagtccgatccatccatccccaaatttctcctctcagcgcgtggggcagtggcggcggcagcgtgggcgcgcggaccgctacgggcacgggagcagcggtggctgcgcaggcagctgtcagcatgcggcatggtgactacgggagcccaggcggcgccggtgcggctgcagccggcggcgggcgaccgtgaggcggctgcgggagcggtgaagtccggtggcgcctgctttgttttgtgttcctatttttgatttgcgaaaggatccaagagagagaggagggggagaaggcgagaatccaagacaagagcgagcatggagtttgctacgggtgccatgggtaccctcctccccaagctgggcatgctgctgcaggaagaactccacctgaagaataatgtgaaggaggggatcaagagcctcactgccgagcttgagagcatgcaag

SEQ ID NO: 41267 - protein, 44 aa, Zea mays
  misc_feature: Ceres CLONE 1436073-F
MEFATGAMGTLLPKLGMLLQEELHLKNNVKEGIKSLTAELESMQ

SEQ ID NO: 41268 - DNA, 702 bp, Zea mays
  misc_feature: Ceres CLONE 1436083-F
  misc_feature: Encodes the peptide sequence at SEQ ID NO. 41269
aaactggagctcccagcggtggcggccgctctagaactagtggatcccccgggctgcaggaattcgcacgagaccattacctagaacatcctaatcgaaaaactagccgtctgccgagccgagtgttcctttctagccttcacttctcagcgcggcagccttcgatcccccgactgcagccgccagccgcaccatggagcaagccgccatgccgcaggttccccgcgtcaagctcggcatccaggggcttgaggtgtcaaagctggggttcgggtgcatggggctcacgggcacctacaacgcgccgctcggcgacgaggccgtcgccgccgtcgtcgcgcacgccttccgccgcgggatcaccttcttcgacacctccgatgcctacgggccccgcaccaacgagaccctcctggggaaggcgctcaagcagctgccgagggagcaggtgcaggtggccaccaagttcgggataggccagggcgccgctggcatgaccgtgtgcggcacgcccgagtacgtacgcgccctccttgtgaggccaagccttgcgccgacttcaaccccgggttacatcaacctctaaataccggcacccggggcgaacactacccgtcccccctcgaggaatacccatgggtgaacccccaaaaaaatcggtggaaggaaagggaaaaggtccaatttcactccccccttttc

SEQ ID NO: 41269 - protein, 130 aa, Zea mays
  misc_feature: Ceres CLONE 1436083-F
  misc_feature: SWISSPROT Homolog: EC 1.1.1.107 Pyridoxal 4-dehydrogenase
MEQAAMPQVPRVKLGIQGLEVSKLGFGCMGLTGTYNAPLGDEAVAAVVAHAFRRGITFFDTSDAYGPRTNETLLGKALKQLPREQVQVATKFGIGQGAAGMTVCGTPEYVRALLVRPSLAPTSTPGYINL

SEQ ID NO: 41270 - DNA, 725 bp, Zea mays
  misc_feature: Ceres CLONE 1436086-F
  misc_feature: Encodes the peptide sequence at SEQ ID NO. 41271
  misc_feature (450)..(450): n is a, c, t, g, unknown, or other
  misc_feature (471)..(471): n is a, c, t, g, unknown, or other
  misc_feature (474)..(474): n is a, c, t, g, unknown, or other
  misc_feature (489)..(489): n is a, c, t, g, unknown, or other
aaagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgccctggagaagtggacnggaggccgtggagctacctgntgnacggtggggccctcnaaggggaagagcaggggcggggcccgtccccgctggggccgccgtcaggggcctgccgctgcaatccccgcctttccgcctgccgaggaaataattggcattccaaaaaacataagggggggcctaaaggggtttccaaaaaggggttcctccctccattggacccttaaaaggcccggagggggttctaaaaattttctttggggggagccaattggggagtgtttcccaaaaag

SEQ ID NO: 41271 - protein, 133 aa, Zea mays
  misc_feature: Ceres CLONE 1436086-F
  misc_feature (65)..(65): Xaa is any aa, unknown, or other
  misc_feature (72)..(72): Xaa is any aa, unknown, or other
  misc_feature (73)..(73): Xaa is any aa, unknown, or other
  misc_feature (78)..(78): Xaa is any aa, unknown, or other
MAPAVGLKRSATQTITLPPPDTRLAVRDVMRSTIPSQPAVAPASTERQAPAAALQGFLCPGEVDXRPWSYLXXGGALXGEEQGRGPSPLGPPSGACRCNPRLSACRGNNWHSKKHKGGPKGVSKKGFLPPLDP

SEQ ID NO: 41272 - DNA, 860 bp, Zea mays
  misc_feature: Ceres CLONE 1436089-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (322)..(322): n is a, c, t, g, unknown, or other
  misc_feature (325)..(325): n is a, c, t, g, unknown, or other
  misc_feature (332)..(332): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (396)..(396): n is a, c, t, g, unknown, or other
  misc_feature (398)..(398): n is a, c, t, g, unknown, or other
  misc_feature (401)..(401): n is a, c, t, g, unknown, or other
  misc_feature (408)..(408): n is a, c, t, g, unknown, or other
  misc_feature (490)..(490): n is a, c, t, g, unknown, or other
  misc_feature (491)..(491): n is a, c, t, g, unknown, or other
  misc_feature (494)..(494): n is a, c, t, g, unknown, or other
  misc_feature (496)..(496): n is a, c, t, g, unknown, or other
  misc_feature (499)..(499): n is a, c, t, g, unknown, or other
  misc_feature (502)..(502): n is a, c, t, g, unknown, or other
  misc_feature (509)..(509): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (533)..(533): n is a, c, t, g, unknown, or other
  misc_feature (534)..(534): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (551)..(551): n is a, c, t, g, unknown, or other
  misc_feature (552)..(552): n is a, c, t, g, unknown, or other
  misc_feature (572)..(572): n is a, c, t, g, unknown, or other
  misc_feature (596)..(596): n is a, c, t, g, unknown, or other
  misc_feature (597)..(597): n is a, c, t, g, unknown, or other
  misc_feature (600)..(600): n is a, c, t, g, unknown, or other
  misc_feature (611)..(611): n is a, c, t, g, unknown, or other
  misc_feature (614)..(614): n is a, c, t, g, unknown, or other
  misc_feature (653)..(653): n is a, c, t, g, unknown, or other
  misc_feature (655)..(655): n is a, c, t, g, unknown, or other
  misc_feature (671)..(671): n is a, c, t, g, unknown, or other
  misc_feature (683)..(683): n is a, c, t, g, unknown, or other
  misc_feature (684)..(684): n is a, c, t, g, unknown, or other
ggggggcccccnnnccccccccccnncnnnaggggggggggggaccccnnnnnacaactggagctccaccgcggtggcggccgctctagtactagtggatcccccgggctgcgggaattcgcacgagaccattacctagaacatcctaatcgaaaatagcatcatctaatcctgatgagcaaagcgggagtgcgtatagaggatcgtcgaacagaacagcatgaagatggtcgtcgctctcgacgggtgggtggctctgtcagctgccagcgcttctggcaggcagatgcgctgcccctgctaggggctgcaggggttgtanggnggtggcnccggggtgacaacgatgatgggcggcaggtgggatagtacccaatnnnnaatatattgtaggancntanctgcatncacgctgggggggggaggtttttgagtggggctgtgggggggcgaagcgctatggttgtggcttgcttcagagcaaatttgnntgncnacntcnggatganggtggatgggacggagcannnccnngtccgtctctcgnnngnncgatttttgaaggcgggctnaggggcgggggcgggggggaattnnatnttggcacccgnggnggggagcgcgagggaccggaaggtctgctactcactggntngtgtggcagggatgcncccctcggtttnntccgacgctcggagggggtgtgccttatttagggccccccgtagaatcgggcagggcgcttgggcggggggactggtcgcgtggcgcggctggacggccccggtcggcgagcagtgaagctagcggggactggggggagcgcccgggccggaatgagcgtgaagctgcagaagtaa

SEQ ID NO: 41273 - DNA, 673 bp, Zea mays
  misc_feature: Ceres CLONE 1436093-F
  misc_feature: Encodes the peptide sequence at SEQ ID NO. 41274
tggagctccccgcggtggcggccgctctagaactagtggatcccccgggctgcaggaattcgcacgagaccattacctagaacatcctaatcgaaaaatatgagtcgttgcctcgcagtttatatccctactgtttcggactttcgggttttggccgacacccgacaatcttaacatcaaactcgtcgtccacgcctcctcggcaaggttgcgtacggcgtggccctaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctaccacaccgccccgggcgccctgcaacccacgagggggacccgactgcgccgcccgcaggggctgatagcagcgggggcacaaacaagatgcggcgcggctgcttgaggaaaagccatgctccgcgcccgactccagatgacctcccgctcctgggtgagctcccggggcgcccctggttttcaggagtgcccttctgaactttacaaccaattggtgggggggggccaaaaaggtaaccttcccttgcccctcctccaaaaattacgggagaagcccccccccccacttaaggaaaaaacctc

SEQ ID NO: 41274 - protein, 63 aa, Zea mays
  misc_feature: Ceres CLONE 1436093-F
MTLGSAAHKIPLEVAHTLVEIAEVARYAYHTAPGALQPTRGTRLRRPQGLIAAGAQTRCGAAA

SEQ ID NO: 41275 - DNA, 665 bp, Zea mays
  misc_feature: Ceres CLONE 1436096-F
  misc_feature: Encodes the peptide sequence at SEQ ID NO. 41276
agagctggagctccccgcggtggcggccgctctagaactagtggatcccccgggctgcaggaattcgcacgagaccattacctagaacatcttaatcgaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaataatgccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcagaagatgctgttcagatcataacaaatatggctgctgccaatggagtaagacgtgtttgggttgaacaaaacaatctcatgtctactccagctgtatctgctgtcatccgtgaaagagttggtgcacatggatcaaaggctactggtgccttcatcttag

SEQ ID NO: 41276 - protein, 121 aa, Zea mays
  misc_feature: Ceres CLONE 1436096-F
  misc_feature (16)..(121): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTNNATTPFDGQKPGTSGLRKKVTVFQQPHYLQNFVQSTFNALPVDQVRGATIVVSGDGRYFSEDAVQIITNMAAANGVRRVWVEQNNLMSTPAVSAVIRERVGAHGSKATGAFIL

SEQ ID NO: 41277 - DNA, 642 bp, Zea mays
  misc_feature: Ceres CLONE 1436097-F
  misc_feature (296)..(296): n is a, c, t, g, unknown, or other
  misc_feature (370)..(370): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtgggcagaatcangagagagatagcaggggggctagctagctgagctcgtgcgacgaaaaatgggcgggaatgggcaggaacatggntgcgcccgctcctggtgctcaacctcatcatgtaaatcatcgccatccgctttcccgagggtggaacttgaacccacttcattcaagggggaaaacaaattaaccccgggggggggccgggaacnggccgaacctttaaatttccggggggtccccaatccctgccccgcgctggtggggcccccggctccaaaaattgggggggggtgggaccccattgggcccccctgggccccccaaaaaactttgggccccacaaaccccggggtttg

SEQ ID NO: 41278 - DNA, 666 bp, Zea mays
  misc_feature: Ceres CLONE 1436099-F
  misc_feature: Translation starting site: 320
aaagctggagctccccgcggtggcggccgctctagaactagtggatcccccgggctgcaggaattcgcacgagaccattacctagaacatcctaatcgaaaaatcccgtaatcgcagcctcgccccgctcgcatcttcctctccctctcagcgctggtgctcaatctacaggtcgtcccgctccctacacacccgccctccggtgtgaacctccatgacgtccacaaccactctccgatctgctgtcgtgacctcatccagccgtgctgtggcagtggatcggagttcgctccagctctgattggaattccactactatatgtgccacttgaagttgttatgttcaaataatatggtgaaaacgagcgtctattgggatctattttttatcttgcaaatgatcttcctgaaggaggtaatatattcttagatgaggtatatatcgtaatacttatagcataaacactcaagccactacaaactgccttcgtccccttcatcactgctgatgaccgtgacttggagacccgacagcgaccctcgacgttgtcgccgccgagcccatgctggttccaccagtggtccaccgcccggatgtggcccgccaagacgagcaggaacggtggcagcgaggcgaggtggtagatccagcaccgcctctgcacg

SEQ ID NO: 41279 - DNA, 687 bp, Zea mays
  misc_feature: Ceres CLONE 1436102-F
  misc_feature: Translation starting site: 137
aaagctggagctccccgcggtggcggccgctctagaactagtggatcccccgggctgcaggaattcgcacgagaccattacctagaacatcctaatcgaaaaatcttcgtgaggaccttcaaccatctcaggcggaatggcggcttctggtgagggcgcgtcgctgccgtctccggcgggcggggaggatgcgcaccgccgccgcgtcagctatttctacgagccgtcgatcggagactactactacgggcaaggtcacccgatgaagccccaccgcatccgaatggcgcactcgctggtggtccactacggcctccaccgcctcctcgagctctcccgcccctacccggcctctgaggccgacatccgccgcttccactccgacgactacgtcgccttcctcgcgtccgccaccggaaacccgggtgtcctcgacccgcgcgccattaagcgctttaacgtcggtgaggactgccccgtgttcgacggtctcttccctttctgcaggcctccgctggggggagcatcggcgcccgccgtcagcttaaccgcggggacgccgacatcaccgtcactggggcgggcggcctcccacacgccagaagagcgaggcctcggggttctgctacgttaacgacatcgtcctccccatcctcaagctcttcaggtccccaggcttgtgctatt

SEQ ID NO: 41280 - DNA, 726 bp, Zea mays
  misc_feature: Ceres CLONE 1436108-F
  misc_feature: Encodes the peptide sequence at SEQ ID NO. 41281
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (62)..(62): n is a, c, t, g, unknown, or other
  misc_feature (80)..(80): n is a, c, t, g, unknown, or other
  misc_feature (107)..(107): n is a, c, t, g, unknown, or other
  misc_feature (429)..(429): n is a, c, t, g, unknown, or other
nggggtgccccnnagaannnttanannnnttttnntnnggggtgtgggttgttcatggtggngctcccctcgggggcggncgctcgttcctaacggggttgggggcngcagggtttcttaaaccgggttggggagaacatcctaatcgaaaaatgatgactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcgcataatgagctcgccagtggagaggtgattcgtcaggctggtatcaagttcctagnccatggtgcctggatgagcagtagagatgctactggccgtggaaggaggagggttcttctcgtcttcagctacaggttacagccatggcctcgccctcttgctgctcggacgcaaagctgaggagaagcccgtaaaggtctcgccgtggaaccagtaccggctagtcgaccgggagaccgagcaggtgtaccacctggcctccgccaagggacaggctcctggggaaaagtgctcccctttgtctggcttcggatgcacgggctaatgggcctcgaggggggcgtcccctcccaaaa

SEQ ID NO: 41281 - protein, 79 aa, Zea mays
  misc_feature: Ceres CLONE 1436108-F
MLLAVEGGGFFSSSATGYSHGLALLLLGRKAEEKPVKVSPWNQYRLVDRETEQVYHLASAKGQAPGEKCSPLSGFGCTG

SEQ ID NO: 41282 - DNA, 640 bp, Zea mays
  misc_feature: Ceres CLONE 1436109-F
  misc_feature (421)..(421): n is a, c, t, g, unknown, or other
aagctggagctccccgcggtggcggccgctctagaactagtggatcccccgggctgcaggaattcgcacgagaccattacctagaacatcctaatcgaaaactctcgcgccgccacttccctcccgacccactagcccaaaaccgtagcgcccgccgccggcgttgcgagctccccatcttgctccgtcaaccatggggacccagatcagcatagaagaaagaagttcgtcacgcgacggacgtgttctacgccgagctcaatgagatgctgacgcgtgagctcgcggatgacggctactcccggcgtggagggtgcgcgtcacaccgatgcgcacggagatcatcatctcgcgcacgctcacgcagaaaatgctctgctaagacggccgcaggatcagggagctcacgtctgtcgtcaanaaagaggtccacttccccgagtagggggtctagctctacgccgagaagggtgtccaaaccccggggctttgggcccaatgggggaaggggggggagtccccccccccaaaaaaaagtccttctggggggtgtttttctccccccgggggggggggcccccaaaagggggcgccctctttttttttttttttattagaaaaggggggcggcccccctgtg

SEQ ID NO: 41283 - DNA, 686 bp, Zea mays
  misc_feature: Ceres CLONE 1436114-F
  misc_feature: Translation starting site: 199
  misc_feature: SWISSPROT Homolog: EC 5.3.1.1 Triose-phosphate isomerase
  misc_feature (393)..(393): n is a, c, t, g, unknown, or other
  misc_feature (428)..(428): n is a, c, t, g, unknown, or other
  misc_feature (478)..(478): n is a, c, t, g, unknown, or other
aaagctggagctccccgcggtggcggccgctctagaactagtggatcccccgggctgcaggaattcgcacgagaccattacctagaacatcctaatcgaaaaacaagcagcgaaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatggtgctgctcanaactgctgggtgaagaagggaggtgcttcactggntgagtcagtgctgagatgctcgtcaaacttggtggtccctgggtcattcntggacactctgaagggaaaactctgctgggaaaatcaatgaattttgtggaaaaaaagttggctatgccctgcctcaggaataaagggctttgcttgggttggggaaaacctttgaccaagggaggctggggccacccggggaggttgtggctgccaaaaaaaaaaatatttgggaaaaaataaaggaggtgggaccccctttttttt

SEQ ID NO: 41284 - DNA, 703 bp, Zea mays
  misc_feature: Ceres CLONE 1436117-F
  misc_feature: Encodes the peptide sequence at SEQ ID NO. 41285
  misc_feature (269)..(269): n is a, c, t, g, unknown, or other
  misc_feature (296)..(296): n is a, c, t, g, unknown, or other
  misc_feature (487)..(487): n is a, c, t, g, unknown, or other
  misc_feature (594)..(594): n is a, c, t, g, unknown, or other
ggagctccccgcggtggcggccgctctagaactagtggatcccccgggctgcaggaattcgcacgagaccattacctagaacatcctaatcgaaaagatggtctcgtactcttgtcacgttccttcctgactgcccccacttctcctccggcggcgcggcggcgggttacctcccaacagcccgaccatggaagccgacatcgctttcaggtatgagatcccccggaccgcccagttcctccgcgacggcgcctacaccagggtcgcgnctccagttccccgacgagatgctgaangatgctgctgcggtggcgagggcgttgcggcgggagcttgcctccggcggcgccgacagtgggggtagggtgttcgtgatggccgacacggcgtacaactcctgctgcgtggacgaagtgggcgcgtcccacatcgatgcgcagtgcgtcgtccactacggccacgcctgcatgagcccacatcaaatttngcagctttctttgtatttgggaagcaccgttggatgtccacgcatgtgccgcacattgctggagtgctcaaggaaagcaatagcgcattctggtttatatggactanagtacgcatatgcattggatgaccttagaagactttcatgaagtcatgtaaatcaaattctggcatcatgaagtcagtatgcaaaggtcctatgttcagtatgagccat

SEQ ID NO: 41285 - protein, 115 aa, Zea mays
  misc_feature: Ceres CLONE 1436117-F
  misc_feature (3)..(3): Xaa is any aa, unknown, or other
  misc_feature (67)..(67): Xaa is any aa, unknown, or other
  misc_feature (103)..(103): Xaa is any aa, unknown, or other
MLXDAAAVARALRRELASGGADSGGRVFVMADTAYNSCCVDEVGASHIDAQCVVHYGHACMSPHQIXQLSLYLGSTVGCPRMCRTLLECSRKAIAHSGLYGLXYAYALDDLRRLS

SEQ ID NO: 41286 - DNA, 777 bp, Zea mays
  misc_feature: Ceres CLONE 1436118-F
  misc_feature: Translation starting site: 224
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
  misc_feature (53)..(53): n is a, c, t, g, unknown, or other
gggggtgggggggccccccgggcggcccccctcctccctccannnnccaaannaacaaaactgggactccccgcggtggcggccgctctaaaatagtggatcccccgggctgcaggaattgcgcacgagaccattacctagaacatcctaatcgaaaaaaaaatatccgcgcgaccccgacctcccccctcccactccgggcagcagccagcagccagcaggcatggggatacccgtggtggttcccgtcgcggcggcctactcgtgctcctcctccctcgccgcgccaccgagggccgccgccgccgcggcgagggcgccgagccgcgcgcacgtcgcggcggccgggatgtcctccaggggcgtcctccttcggcgggggcaccggatgcgacctcgcggcgggggccgcgtcggtaggcggcgcgcccagaacccccccctccccccgacgcgggggggtgcgggttaaaatggcccctcccccctaccgctgcccccaccccccgcgggcaccgccgcggggcggcggcgctccgggtgtccgcccccaagcaggcttcggcgagggtggggcccggcggcttcggtcggaggccgggggagggagcctcccagcgaggggcggcggcaaggagtctcggaaagcgggacccgcaaagaggagggccggggggaaaggctggggcaacctcccccccccccccggccaacttcccccccgccttcacacaactccccgcccaacgaaaagaggggtggtttggggggcggtgg

SEQ ID NO: 41287 - DNA, 704 bp, Zea mays
  misc_feature: Ceres CLONE 1436119-F
  misc_feature: Encodes the peptide sequence at SEQ ID NO. 41288
  misc_feature (459)..(459): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccaccccggtgttcctgatnctcagccccgtgctcgtccccgccgcgctgctcatcgggacggccgtcatggggttctcacgtcgggcgcgctggggctcgggggcctgtcctcgctcagtggctccgcaacccggggcgggaaggggttcccgcccaacccggaaatacctggaggaagccccccccaagaatagggggaggccccgggcccccccggcccaaaaaaccccccaggggggccagcctctccggggaagggccga

SEQ ID NO: 41288 - protein, 166 aa, Zea mays
  misc_feature: Ceres CLONE 1436119-F
  misc_feature (44)..(162): Pfam Name: Oleosin Pfam Description: Oleosin
  misc_feature (85)..(85): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLXLSPVLVPAALLIGTAVMGFSRRARWGSGACPRSVAPQPGAGRGSRPTRKYLEEAPPKNRGRPRAPPAQKTPQGGQPLRGRA

SEQ ID NO: 41289 - DNA, 664 bp, Zea mays
  misc_feature: Ceres CLONE 1436123-F
  misc_feature: Encodes the peptide sequence at SEQ ID NO. 41290
aaagctggagctccccgcggtggcggccgctctagaactagtggatcccccgggctgcaggaattcgcacgagaccattacctagaacatcctaatcgaaaaacatcgacccagccatcttctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgctagagcgagtgccccgagcggcaccagcaagctgacgcgggcgaggacggcgacagcggcgtggacgcctacgtctcccgctccgggaggggcgagtgccggcaccagtgcctgcgccgccacgagggccagccgtgggagacccacgagtgcatggagcggtgccccccgccgcggactggccggtcgacatgggagcaaagagtaccgggcgccggccagcagaaaagccccgggccaaaactgcccgggaaaaaaggt

SEQ ID NO: 41290 - protein, 63 aa, Zea mays; identical to SEQ ID NO: 13484
  misc_feature: Ceres CLONE 1436123-F

SEQ ID NO: 41291 - DNA, 781 bp, Zea mays
  misc_feature: Ceres CLONE 1436124-F
  misc_feature: Encodes the peptide sequence at SEQ ID NO. 41292
  misc_feature (12)..(12): n is a, c, t, g, unknown, or other
  misc_feature (19)..(19): n is a, c, t, g, unknown, or other
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
ggggtttgggcnccgcccnncccaccacaaaaaataaaannnggggggnngnncagagtggggctccccgcggtggcggccgctctagaatagtggatcccccgggctgcaggaattcgcacgagaccattacctagaacatcctaatcgaaaaaagaccaagatagaccacccaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctaccacctcttgtgcatctccctcgtgactaacctcctcggccgcatctactacaccgtggaggggtccgcgacggccgggagtgtaggggcgcacgtgggcgcgtccttcaggggtgtggccccccccccccacggtggggggggaggctattgttcgggctggctggggcgagcagcttcggggggcaagaaccgtccaaggggatggaggcctccgggctcaggggccccctggtatccgtcgcgggtcggggggtgcggtgttgggccagcagccccgggggtgcggctcaggggagagggcgtgggcgttagtggcgggtatacgggcgcgggggggacgggcaagccggcgggcggacagagcgggcgcggtggggcgggacgacgcgcggtgcggggggtcggaccaagccgcggaggaggccgccgcgggggccg

SEQ ID NO: 41292 - protein, 183 aa, Zea mays
  misc_feature: Ceres CLONE 1436124-F
MAAGDLEVLTALDTAKTQWYHFTAIVVAGMGFFTDAYHLLCISLVTNLLGRIYYTVEGSATAGSVGAHVGASFRGVAPPPHGGGGGYCSGWLGRAASGGKNRPRGWRPPGSGAPWYPSRVGGCGVGPAAPGVRLRGEGVGVSGGYTGAGGTGKPAGGQSGRGGAGRRAVRGVGPSRGGGRRGG

SEQ ID NO: 41293 - DNA, 636 bp, Zea mays
  misc_feature: Ceres CLONE 1436133-F
  misc_feature (241)..(241): n is a, c, t, g, unknown, or other
  misc_feature (242)..(242): n is a, c, t, g, unknown, or other
  misc_feature (276)..(276): n is a, c, t, g, unknown, or other
  misc_feature (285)..(285): n is a, c, t, g, unknown, or other
  misc_feature (286)..(286): n is a, c, t, g, unknown, or other
aagctggagctccccgcggtggcggccgctctagaactagtggatcccccgggctgcaggaattcgcacgagaccattacctagaacatcctaatcaaaagtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccnnttaggcggctgtactttcaaaactttcaaaaagntaaaccctnnagggtgggggacccctaatcttattgtttcaaagaaagggggggaaaagaaccccggaaattttcccccgcggaagggggggccccaaatttttaaattcccccctaaaacggggaaaaatttttaaaacgggggggggaaaaaaaaaaccccccgggagaaaaaccccccgggagagggggccccccgggagggggggtttcttctttcgcgaaggggggggggccccccccccccaaaaaggggggggggctccccccccccaaaaaaaaaaaaaaaaaaaaaaaacggcccccccccccccccccccccccttaaaaaaaaaaaaaaaaaaaatggccgcccccccc

SEQ ID NO: 41294 - DNA, 733 bp, Zea mays
  misc_feature: Ceres CLONE 1436138-F
  misc_feature: Translation starting site: 213
  misc_feature (271)..(271): n is a, c, t, g, unknown, or other
  misc_feature (281)..(281): n is a, c, t, g, unknown, or other
  misc_feature (423)..(423): n is a, c, t, g, unknown, or other
  misc_feature (424)..(424): n is a, c, t, g, unknown, or other
  misc_feature (437)..(437): n is a, c, t, g, unknown, or other
  misc_feature (535)..(535): n is a, c, t, g, unknown, or other
  misc_feature (560)..(560): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (619)..(619): n is a, c, t, g, unknown, or other
  misc_feature (733)..(733): n is a, c, t, g, unknown, or other
aaagctggagctccccgcggtggcggccgctctagaactagtggatcccccgggctgcaggaattcgcacgagaccattacctagaacatcctaatcgaaaaaaaaaaactccactgctttcatcaactccggcgacttggagaatacgaagttccagaatccgatcggaagtttggtgctcgcgccttgacggattgatttcggtgcgccgatggggcaggcgttccgcaagctgttcgatgccttcttcggcaccagcgagatgagggnttgtgatgcnttggtctggatgccgccggtaaaaccaccatattgtacaagctgcatatcggggaggttttgtcgactgttcccacgattggttttcacgtcgagaaagttcatacaagaatgtgatgtttactgtgtgggatgttggtggnnccagaaagttgangccctttgtgaggcactactttcacatactgatggcctgatctacgtagttgattcgttggatcgggagagaattggaaagccaaagctgaatttcanggcataatcaaagatcctttgatgncttacagtgtaatactggtacttgccannntagcagatatgaaagggggcatgacaccnatggggagtgtgtgagggtcttggcctctacgatttgaagaaccgcatctggcaacatcaaggctcttgtgcgctccaaaggtgatggcctttatgagggcttggactggctgn

SEQ ID NO: 41295 - DNA, 665 bp, Zea mays
  misc_feature: Ceres CLONE 1436140-F
  misc_feature (211)..(211): n is a, c, t, g, unknown, or other
  misc_feature (216)..(216): n is a, c, t, g, unknown, or other
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (238)..(238): n is a, c, t, g, unknown, or other
  misc_feature (270)..(270): n is a, c, t, g, unknown, or other
  misc_feature (272)..(272): n is a, c, t, g, unknown, or other
  misc_feature (273)..(273): n is a, c, t, g, unknown, or other
  misc_feature (323)..(323): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccnaccgngggngnntggcgaacgaggagnggtggcgggggggctacggcgaaacctccagncnngcgggggggggcggggcaattggccaaccggggcggaaaggcccgccaanccaagccaacccaaaaaaccccaggggcccgccccattttgaaattgaaccgggcggcccctttccaaaggggcccccgcgaaaaagggggcccgccaaaacctttttggggggggggggtaaaaaaaccccgggggggggttttccccgcggggggttgttaataccttggggcccgggggggcccccctttaatatttcccccccccctcccaccgggggggggggccccccccccccccggggggggggggggagaaaaatttttccccccccccgggggggtttgggtggggggggggggggggggggcggccccacatcaaacccgccggggggggg

SEQ ID NO: 41296 - DNA, 684 bp, Zea mays
  misc_feature: Ceres CLONE 1436141-F
  misc_feature: Encodes the peptide sequence at SEQ ID NO. 41297
  misc_feature (459)..(459): n is a, c, t, g, unknown, or other
  misc_feature (517)..(517): n is a, c, t, g, unknown, or other
  misc_feature (607)..(607): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatnctcagccccgtgctcgtccccgccgcgctgctcatcgggacggccgtcatgggttccntcacgtcgggcgcgctggggctcgggggcctgtcctcgctcacgtgcctcgccaacacgcgcggcaggcgtccagcgcacccggactacntgaaagagcgccacccaggatggcggaggcgccgcgcacgcgggcacagaacgcccaggaggcaagccatcagggga

SEQ ID NO: 41297 - protein, 160 aa, Zea mays
  misc_feature: Ceres CLONE 1436141-F
  misc_feature (44)..(152): Pfam Name: Oleosin Pfam Description: Oleosin
  misc_feature (85)..(85): Xaa is any aa, unknown, or other
  misc_feature (105)..(105): Xaa is any aa, unknown, or other
  misc_feature (135)..(135): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLXLSPVLVPAALLIGTAVMGSXTSGALGLGGLSSLTCLANTRGRRPAHPDYXKERHPGWRRRRARGHRTPRRQAIRG

SEQ ID NO: 41298 - DNA, 659 bp, Zea mays
  misc_feature: Ceres CLONE 1436146-F
  misc_feature: Encodes the peptide sequence at SEQ ID NO. 41299
  misc_feature (474)..(474): n is a, c, t, g, unknown, or other
  misc_feature (479)..(479): n is a, c, t, g, unknown, or other
  misc_feature (491)..(491): n is a, c, t, g, unknown, or other
  misc_feature (492)..(492): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatctcagccgtggctgggtgccggccgcatcgcgctgcgctcatggcgncgggntcgtcactcggnnggcccggggtccctgccttgtccgggttctcctggatgacaaatacctgaggggaaagccccggccggggccaaaccactggacccccaaggggaagtgtggggtccaaggcccccaaatcaaggagcgncaaaacccccttttaacaagggaagggggcttggaaa

SEQ ID NO: 41299 - protein, 114 aa, Zea mays
  misc_feature: Ceres CLONE 1436146-F
  misc_feature (93)..(93): Xaa is any aa, unknown, or other
  misc_feature (99)..(99): Xaa is any aa, unknown, or other
MADHHRGATGGGGGYGDLQRGGGMHGEAQQQQKQGAMMTALKAATAATFGGSMLVLSGLILAGTVIALTVATPVLVISAVAGCRPHRAALMAXGSSLGXPGVPALSGFSWMTNT

SEQ ID NO: 41300 - DNA, 670 bp, Zea mays
  misc_feature: Ceres CLONE 1436152-F
  misc_feature: Encodes the peptide sequence at SEQ ID NO. 41301
aaagctggagctccccgcggtggcggccgctctagaactagtggatcccccgggctgcaggaattcgcacgagaccattacctagaacatactaatcgaaaagaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccagtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttgccagcagctcaggcaggtggagccgc

SEQ ID NO: 41301 - protein, 164 aa, Zea mays
  misc_feature: Ceres CLONE 1436152-F
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGTCGVGSTPILGQCVEFLRHQCSPTATPYCSPQCQSLRQQCCQQLRQVEP

SEQ ID NO: 41302 - DNA, 641 bp, Zea mays
  misc_feature: Ceres CLONE 1436154-F
  misc_feature: Translation starting site: 167
aagctggagctcaccgcggtggcggccgctctagaactagtggatcccccgggctgcaggaattcgcacgagaccattacctagaacatcctaatcgaaaaaactccctcccccccgcctccactaccccactcccaggcgccgcacaggtacgtcgccggcggcgatgacgacgcgcttccagaagaacccgcagaagcgcgggcacgtgtccgcccgggcacgggcgcatcggcaagcacggaaagcatccccgaggtcccggtaacccccggtggcatggaccacccccgcattctctttcaaaaatacccttcccgggtacttttggtaaggggggattggcctatttccccaaaatcccccaaaagtttttattgggccccggggcaaaataaaagcccccctgggggaaagggggcccccccccaaaaagggggggaaaaacccccggggaaaaaaacccccccccaaaaaaaatcttctccccccccccgaaattttaaaaaaggctcccccaaaagagggggggggtggttgccccaaaacccccttttttttttaagggaaaaaaccacccccttcccccaggggcgcccaaaaaaaaaaaaaaaaaaaaccccccccccccgggccccccc

SEQ ID NO: 41303 - DNA, 652 bp, Zea mays
  misc_feature: Ceres CLONE 1436156-F
  misc_feature: Encodes the peptide sequence at SEQ ID NO. 41304
  misc_feature (345)..(345): n is a, c, t, g, unknown, or other
  misc_feature (346)..(346): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
aaagctggagctccccgcggtggcggccgctctagaactagtggatcccccgggctgcaggaattcgcacgagaccattacctagaacatcctaatcgaaaaaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcggggtgggcgctggggcanngcgaagcacccagaagctgggccgnncncacgggcttcggttccgccccctggtgccccggccaacacagggcctgtcccggataaattcccccccttaattgaaaccccccaaaccccccgggccaaccggggccctaatgcccccttttttaaaaaacagggtttggacccccaccccccaggtttccctccctttaaccgggggccccccgcccccctgaaaacctaaaggaaaccgggggggggcaaaaaaaaacccaaaaaatttttccccccacaaaacggggggcggaaaatttcttat

SEQ ID NO: 41304 - protein, 93 aa, Zea mays
  misc_feature: Ceres CLONE 1436156-F
  misc_feature (61)..(61): Xaa is any aa, unknown, or other
  misc_feature (70)..(70): Xaa is any aa, unknown, or other
MATHRHCLPLLLVAAALALAAVPARAALGGGRGPLLGGWNPIPDVSDSHIQELGGVGAGAXRSTQKLGRXHGLRFRPLVPRPTQGLSRINSPP

SEQ ID NO: 41305 - DNA, 701 bp, Zea mays
  misc_feature: Ceres CLONE 1436165-F
  misc_feature: Translation starting site: 418
aagctggagctccccgcggtggcggccgctctagaactagtggatcccccgggctgcaggaattcgcacgagaccattacctagaacatcctaatcgaaaaaatgcagcagtagccgtctgcctcctcgctttccctttcgtccgtacgccgccgcctcgcaccggcgacagtcctcagtccagaactccagatcgagcctccctctccccagatcgggtcctaggctacagcagccgccgcatccgtcaccttcacaccgcgtgcgtgctctctctccccctccccctctccgtgcgacgactgggtgggctaccgccgccctacgcaaggtgccgagaacttcggcgatatctgcgccggagaagagcgcccaccagatcaggcgcttagaaggcgcgctggccggtggatgactatggcgggtggcgagggactgaactggtcttcatcgatggtgcagctgccgccagcagagctgcttgacgatctctgcaggcggttccttctgaatgtgccaaggaggagctgcagtcgttcgagcggatcctgttcctgctgggacaagtcactgggtctatgaggacaactcgtttgaagacacccgaacctaaaggccttttctttcaggatttcccttccatgtggtaaaaagggtgctggggttctcggccccttaaattctgccccccgggggggaaa

SEQ ID NO: 41306 - DNA, 727 bp, Zea mays
  misc_feature: Ceres CLONE 1436170-F
  misc_feature: Encodes the peptide sequence at SEQ ID NO. 41307
  misc_feature (347)..(347): n is a, c, t, g, unknown, or other
  misc_feature (528)..(528): n is a, c, t, g, unknown, or other
  misc_feature (531)..(531): n is a, c, t, g, unknown, or other
  misc_feature (532)..(532): n is a, c, t, g, unknown, or other
  misc_feature (574)..(574): n is a, c, t, g, unknown, or other
  misc_feature (575)..(575): n is a, c, t, g, unknown, or other
  misc_feature (586)..(586): n is a, c, t, g, unknown, or other
  misc_feature (641)..(641): n is a, c, t, g, unknown, or other
  misc_feature (652)..(652): n is a, c, t, g, unknown, or other
  misc_feature (705)..(705): n is a, c, t, g, unknown, or other
  misc_feature (716)..(716): n is a, c, t, g, unknown, or other
  misc_feature (727)..(727): n is a, c, t, g, unknown, or other
aagctggagctccccgcggtggcggccgctctagaactagtggatcccccgggctgcaggaattcgcacgagaccattacctagaacatcctaatcgaaaaaccctacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgancagaccattgggggaagtgatgatgctttcaacaccttcttcagtgagactggcgctggggagcacgtcccccgtgctgtttttgttgaccttgagcccactgtcatcgatgaggtgaggactggcacctacccgcagctcttccatcctgagcagctcatcagtggcaaggaggatgcangcnnacacttcgctcgtggtcactacaccattgccaaggagattgnntgactgtgccntgaccgcatcaggaagcttgcagataattgcactgggtctcagggcttcctcgtnctcaacgctgntgggtgaagaacgggctctgggctttggtctctcctcctggagccgctgtctngtgactatggncagaagtccan

SEQ ID NO: 41307 - protein, 114 aa, Zea mays
  misc_feature: Ceres CLONE 1436170-F
  misc_feature (39)..(39): Xaa is any aa, unknown, or other
  misc_feature (100)..(100): Xaa is any aa, unknown, or other
  misc_feature (101)..(101): Xaa is any aa, unknown, or other
MRECISIHIGQAGIQVGNACWELYCLEHGIQADGQMPGXQTIGGSDDAFNTFFSETGAGEHVPRAVFVDLEPTVIDEVRTGTYPQLFHPEQLISGKEDAXXHFARGHYTIAKEI

SEQ ID NO: 41308 - DNA, 574 bp, Zea mays
  misc_feature: Ceres CLONE 1436174-F
  misc_feature: Encodes the peptide sequence at SEQ ID NO. 41309
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (83)..(83): n is a, c, t, g, unknown, or other
  misc_feature (84)..(84): n is a, c, t, g, unknown, or other
  misc_feature (90)..(90): n is a, c, t, g, unknown, or other
  misc_feature (92)..(92): n is a, c, t, g, unknown, or other
  misc_feature (172)..(172): n is a, c, t, g, unknown, or other
  misc_feature (173)..(173): n is a, c, t, g, unknown, or other
  misc_feature (184)..(184): n is a, c, t, g, unknown, or other
  misc_feature (287)..(287): n is a, c, t, g, unknown, or other
ggggggtgggtttttctcgtttgttngnngggggtgggtggggctttttgccccccgccttcccctctcctccnnnnnnnttnngggggntngttcaaagctggactccccgcggtggcggccgctctagaactagtggatcccccgggctgcaggaattcgcacgaaaacnncattacctagnaacatcctaatcgaaaaacatattattgagaccaactagcaacatagaaagcacaatagtgtaccaacaatggcagccaaaatattttgccctccttatgctnctgggtctttctgcaagtgctgctacggggaacattttccccgcatgctcgcaggtccttaaggttcccttttttccccgggaccttttaccagggggggtttttcggttgggaaaacccattttttaaccctccggggatcaaagggggattcccgggggggcgcttttacctttttaacccccctttgtggccccccaaaattttccgcccccttaaaaaaaaaggaccctctgggggggtttttttggggaggaaaaaaaaagggggggcaaaaacacccccac

SEQ ID NO: 41309 - protein, 44 aa, Zea mays
  misc_feature: Ceres CLONE 1436174-F
MLLGLSASAATGNIFPACSQVLKVPFFPRDLLPGGVFRLGKPIF

SEQ ID NO: 41310 - DNA, 720 bp, Zea mays
  misc_feature: Ceres CLONE 1436179-F
  misc_feature: Encodes the peptide sequence at SEQ ID NO. 41311
  misc_feature (375)..(375): n is a, c, t, g, unknown, or other
  misc_feature (433)..(433): n is a, c, t, g, unknown, or other
  misc_feature (510)..(510): n is a, c, t, g, unknown, or other
  misc_feature (692)..(692): n is a, c, t, g, unknown, or other
ggagctccccgcggtggcggccgctctagaactagtggatcccccgggctgcaggaattcgcacgagaccattacctagaacatcctaatcgaaaaatatcacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaaccaattcttcaccctacaggatccacaggcaatcgcagctggcatctacctttatcacccttgttcctccnacatcatcagccctattacagcagttacctttggtgcatttattggcacaaacatcanggcacaacaaaactacacacttgtgctagcaaaccttgctgcctactctcagcaacagcagtttcttccattcaccnactagctgcattgaactctgctttctattttgcacacaacaactaccattcagccagctatctgctgcctacccccagcaaattcttccatcaacaactgacagcattgaactctcctgctttttacagcagcaacaactactaccatcaaccagctagctggtgtgaaccctgctaccttnctgacacaccacagtttgtgcccgtcta

SEQ ID NO: 41311 - protein, 118 aa, Zea mays
  misc_feature: Ceres CLONE 1436179-F
  misc_feature (74)..(74): Xaa is any aa, unknown, or other
  misc_feature (93)..(93): Xaa is any aa, unknown, or other
MAAKIFCLLMLLGLSASAATATIFPQCSQAPIASLLPPYLSPTVSSVCENQFFTLQDPQAIAAGIYLYHPCSSXIISPITAVTFGAFIGTNIXAQQNYTLVLANLAAYSQQQQFLPFT

SEQ ID NO: 41312 - DNA, 734 bp, Zea mays
  misc_feature: Ceres CLONE 1436185-F
  misc_feature: Encodes the peptide sequence at SEQ ID NO. 41313
  misc_feature (355)..(355): n is a, c, t, g, unknown, or other
  misc_feature (487)..(487): n is a, c, t, g, unknown, or other
  misc_feature (519)..(519): n is a, c, t, g, unknown, or other
  misc_feature (520)..(520): n is a, c, t, g, unknown, or other
  misc_feature (583)..(583): n is a, c, t, g, unknown, or other
  misc_feature (593)..(593): n is a, c, t, g, unknown, or other
  misc_feature (594)..(594): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (649)..(649): n is a, c, t, g, unknown, or other
  misc_feature (653)..(653): n is a, c, t, g, unknown, or other
  misc_feature (654)..(654): n is a, c, t, g, unknown, or other
  misc_feature (677)..(677): n is a, c, t, g, unknown, or other
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaaaaggcaactcagccaagctcgtgagagcagaggaactctctttcctcacactccaaagcagcaagaccatctggcaaagctgcgctagaggccagcatcaggccataataggccagagagcagacgaggcatggcgacgtccgtggcctgcgccttcttcttcttcgacgcggcggagccgctgggcgagggcgggcggcggcggcagcggcaagcgctggacgcctgcgcgctctgctccagccgctggcccngcacagcgacatcttcatgtacaggggcgacaccccgttctgcagcgaggactgccgctacgagcagatgcaccacgacgcggcggccacggcctacgcgcggcatcaggccagcagcccggcgaagcagcnagcgagcaggggcggctctgtgtccgccacgnnagcgacgtgtacgtggccagctagagtaagagcaaagcgcagtgcaagcgccgcgaggccaangatggtgaanngcgtgcgctgcctggttcagcaagagaatcccgtcnnngtggagtggaagcccangcgnnctgcgctcccgggtggctgcccngcactgcgncccacggagctttgtgagcggggggtgggatcctgaaggagtcgacag

SEQ ID NO: 41313 - protein, 116 aa, Zea mays
  misc_feature: Ceres CLONE 1436185-F
  misc_feature (39)..(39): Xaa is any aa, unknown, or other
  misc_feature (50)..(50): Xaa is any aa, unknown, or other
  misc_feature (71)..(71): Xaa is any aa, unknown, or other
  misc_feature (74)..(74): Xaa is any aa, unknown, or other
  misc_feature (75)..(75): Xaa is any aa, unknown, or other
  misc_feature (87)..(87): Xaa is any aa, unknown, or other
  misc_feature (93)..(93): Xaa is any aa, unknown, or other
  misc_feature (95)..(95): Xaa is any aa, unknown, or other
MYRGDTPFCSEDCRYEQMHHDAAATAYARHQASSPAKQXASRGGSVSATXATCTWPARVRAKRSASAARPXMVXXVRCLVQQENPVXVEWKPXRXALPGGCPALRPTELCERGVGS

SEQ ID NO: 41314 - DNA, 821 bp, Zea mays
  misc_feature: Ceres CLONE 1436186-R2
gggccccccctcgaggtcgacggtatcgataagcttttttttttttttttttgcatgctaccaaagcaacatatataataataaaatatcaacagttaacactactagttcgtctctgagaactgtgaagccattcacagctacgctggtgcatcctcttactcgtacaaacaaataaaggcaaaaaaaaaaacaaataagccgaaaaaagtagtagctaccattaacctatacatttactccctctaaataactgaggctgagatccaggtgaatcaactaatttgacttatcaatcgtcccggccgtgcggcagcatcttgagcgcctggaggaaggtgttcttgaggcggcccaggtgcggccgcacgttctgcttgtccaggtacgtggtcttgagcgcgttccacccctgcttgtggatggccatggggtccctcagcaccgggtgatcgctcgggtactgctcgctcagcgtcgtctcgtccagctgcaccacgtactccaggtagtggacctccatccccgccgacagctccgcgaacgtgttccgcgccagccactccagccgcccgtacggcaccacctgcaccaccacggcgccgggcagcaggaacaccaatgttggtgagccccggcgccgtggacgcccaccatcacgtcgcacgaagtcaccagccgcgcgaaacttggacgtgtcggttgctggtgtctgggctcccccatcggcacgtcgaaaccccaggctgggcggccatgtccgccatggcgcgcttcttttcatgtaaggccccccccccgggaaggccggccccaaaata

SEQ ID NO: 41315 - DNA, 841 bp, Zea mays
  misc_feature: Ceres CLONE 1436186-R
tgtcgagtagaggatgactagagtagctgcgataggagttcagctctgagagctgtgaagccattcacagctacgctggtgcatcctcttactcgtacaaacaaataaaggcaaaaaaaaaaacaaataagccgaaaaaagtagtagctaccattaacctatacatttactccctctaaataactgaggctgagatccaggtgaatcaactaatttgacttatcaatcgtcccggccgtgcggcagcatcttgagcgcctggaggaaggtgttcttgaggcggcccaggtgcggccgcacgttctgcttgtccaggtacgtggtcttgagcgcgttccacccctgcttgtggatggccatggggtccctcagcaccgggtgatcgctcgggtactgctcgctcagcgtcgtctcgtccagctgcaccacgtactccaggtagtggtaactcatccccgccgaacggctcgcgtacgttgtccggcgcagccactccagcccgcccgtacgggacccaccggcaccacacggggcccggaaggaaggaaacccatgttggtgaaccccgggcccttgggacccccaacatttagttcgaaaaattttccccaaccccgccaaaactttgaaaatttccggggccgtggggtttggggccccccatatccccgggtgtaaaaaccccagggtggggggccccttgttccccccagggggggccccccctttttttaaaaaaagggccccccccccggaaaaaaggggggggggccaaaataatttttaaaaaaaacccgggggggggccgcccccccaaaaaatatttcctcccccgcgcggc

SEQ ID NO: 41316 - DNA, 687 bp, Zea mays
  misc_feature: Ceres CLONE 1436211-F
  misc_feature: Encodes the peptide sequence at SEQ ID NO. 41317
aagctggagctccccgcggtggcggccgctctagaactagtggatcccccgggctgcaggaattcgcacgagaccattacctagaacatcctaatcgaaaactccattagtaaccgacgtattgacagcatttgaagcctgcggcaccccatgacctccctggcagactcttcttctcccctccttctctctataaatggggacagcagagctctctcttctctcctgcctacccaagcgccccatctctctagctcaccattgcactgctcgacgccgtcgttcgttgctgttcgccggagttcgccgctcgttgccggagcccgtggagttcgccggagtgtgccgttcgtcgccggagttcaccggagccgcgtactagctgtccgtagtcgagccccgctctccgtcgatccgtccccgtcacacgcacgaacccgagaagcggattgtgcggtagacgatccgaactcgttcgaagacgatccgcaggacccgcttgagcaagagggtgatgctggagactttgatggagattttatcgacgacgatgatttctaagtctaacgatgcgccggtcatcttcctgtgggagattgcccagttgtttatttccgctttactttgatgtgatacttggtaaagatacaatgtttcagatgatgtaataaagtattatactctctt

SEQ ID NO: 41317 - protein, 37 aa, Zea mays
  misc_feature: Ceres CLONE 1436211-F
MLETLMEILSTTMISKSNDAPVIFLWEIAQLFISALL

SEQ ID NO: 41318 - DNA, 646 bp, Zea mays
  misc_feature: Ceres CLONE 1436217-F
  misc_feature: Encodes the peptide sequence at SEQ ID NO. 41319
tggagctcaccgcggtggcggccgctctagaactagtggatcccccgggctgcaggaattcgcacgagaccattacctagaacatcctaatcgaaaaaacaacgcacgagacaaagggcctcacgctttccacatcgacacaaaaccaaccgccgccacctccatccgctcgcgctagctgtgtgcgtgccttgtctgccacaactccagcacttggagtcttcgaccacgacgacgacggcaggggaggagaaacaggcaggcgggtcatccatggagacggaggaagagacgacgcccaaggcgaagaagcggccgcagtcgctgctcgggagcctgcgggaggcgatcaccaaggtccggttcctgctctcctccagcgcgacgcggtggatgctgctcaggtccctggcccgcggcggcggcggcggcggcgccccggcgcggcgcctcagcttcgacgcgcggccgggcctgctcgacaccatcgccgcgtcgccggactcctcctcctgcagctccaggacctccaggtcggccagcctgggcacggcgaccacccggaccctgtcgcgggccagcagcgccgcgtcgccggaggccctgacgagggcctcgtcgtcgtccggcggccgctccccggcgt

SEQ ID NO: 41319 - protein, 124 aa, Zea mays
  misc_feature: Ceres CLONE 1436217-F
METEEETTPKAKKRPQSLLGSLREAITKVRFLLSSSATRWMLLRSLARGGGGGGAPARRLSFDARPGLLDTIAASPDSSSCSSRTSRSASLGTATTRTLSRASSAASPEALTRASSSSGGRSPA

SEQ ID NO: 41320 - DNA, 590 bp, Zea mays
  misc_feature: Ceres CLONE 1436222-F
  misc_feature: Encodes the peptide sequence at SEQ ID NO. 41321
tggagctccaccgcggtggcggccgctctataactagtggatcccccgggctgcaggaattcgcacgagaccattacctagaacatcctaatcgaaaacccgtcgcgctttctcctagtgaggctactgggtgaccgccgcctctgccgccctacgccaggttccaggtcttcgtcactccctttcattatcttcgtcgtctcattcgccggcgacgagcacccaccagaaatcatagctgctttgggtatggaggcgctgtttgggagcaataacccatggcggccacaaggcccgcttgatttgggctcgccttataattaccccaggtttgccttggaaggtgccgaggttactttgggccccccttggcctggattctgccaaaatgaaaatccttttacatccgggggggaaaaccaaaaaattttgattaacaaaggaaatttcgggggccaaaaagccgaaaaaaataaaaaacctaatccccctgaaaaaacaaaaaaatatagttggggggaagctcccccaaaagaaagaaaaaaaattggggtggttttttaaagggggaaacaccccttttttttttg

SEQ ID NO: 41321 - protein, 104 aa, Zea mays
  misc_feature: Ceres CLONE 1436222-F
MEALFGSNNPWRPQGPLDLGSPYNYPRFALEGAEVTLGPPWPGFCQNENPFTSGGENQKILINKGNFGGQKAEKNKKPNPPEKTKKYSWGEAPPKERKKIGVVF

SEQ ID NO: 41322 - DNA, 661 bp, Zea mays
  misc_feature: Ceres CLONE 1436284-F
  misc_feature: Encodes the peptide sequence at SEQ ID NO. 41323
  misc_feature (473)..(473): n is a, c, t, g, unknown, or other
  misc_feature (489)..(489): n is a, c, t, g, unknown, or other
ggagctccccgcggtggcggccgctctagaactagtggatcccccgggctgcaggaattcgcacgagaccattacctagaacatcctaatcgaaaacaaggagaagtatgggaatccaacgatctacataacggagaacggaatggaccagcctggaaacttgacccgagaccagtacctgcgcgacgccacgagggtgcggttctacaggagctacatcggccagctgaagaaggccatagaccagggagcgaacgtggctggctacttcgcctggtctctcctcgacaacttcgagtggctggcagggtactcgtccaagttcggcatcgtctacgtggacttcaacacgctcgaacgccacccgaaggcgtcggcctactggttcagggacatgcttcagaagcattgagatctccagagccgagcctgagcacggaaggtaccatttttgtcagcttcgcctagtgttngggatggccccatggntcaaatccggctcagtggctggctacaaaatggggaacaaggacagctacccccgatcaatggggatgtggggggttgggggaatggtcccccctggagatttgaactgggggtaatttaaccgggtgggtaaaccgggtttaaatgcttaaaaaaaaaaaaaaaactttcc

SEQ ID NO: 41323 - protein, 89 aa, Zea mays
  misc_feature: Ceres CLONE 1436284-F
  misc_feature: SWISSPROT Homolog: EC 3.2.1.21 Beta-glucosidase
MDQPGNLTRDQYLRDATRVRFYRSYIGQLKKAIDQGANVAGYFAWSLLDNFEWLAGYSSKFGIVYVDFNTLERHPKASAYWFRDMLQKH

SEQ ID NO: 41324 - DNA, 664 bp, Zea mays
  misc_feature: Ceres CLONE 1436337-F
  misc_feature: Encodes the peptide sequence at SEQ ID NO. 41325
aaactggagctccccgcggtggcggccgctctagaactagtggatcccccgggctgcaggaattcgcacgagaccattacctagaacatcctaatcgaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaggcggtgggcggcgggcagtgcccggccctggggtgcgcggcggacctcaacgccgggtgcccgccctcgcagcgcgtgccgggggccgggggcggcgtggtggcgtgcaag

SEQ ID NO: 41325 - protein, 173 aa, Zea mays
  misc_feature: Ceres CLONE 1436337-F
  misc_feature (34)..(173): Pfam Name: Thaumatin Pfam Description: Thaumatin family
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPQAVGGGQCPALGCAADLNAGCPPSQRVPGAGGGVVACK

SEQ ID NO: 41326 - DNA, 546 bp, Zea mays
  misc_feature: Ceres CLONE 1436355-F
  misc_feature (158)..(158): n is a, c, t, g, unknown, or other
  misc_feature (211)..(211): n is a, c, t, g, unknown, or other
ccccgcggtggcggccgctctagaactagtggatcccccgggctgcaggaattcgcacgagaacattacctagaacatcctaatcgaaaaaactcaggaacagtgcctcttcggtcaaaatattcttgtacctgcatctcgacctcacggcgtccggncggtgtatcacgatggtgccgttgctgggccggcgatcggggttggtgcgganctgcccctttcaccccctcgggggtttcggatccccttttctcccccaaatcctttgaaaatccccctcttccccccaaaaatttatttttttccaaaaaataatgccccattaaaaaaaaaaaaagccctttttaaggctttgttttaaaaaaaaccctttttttggggtttttttcccccaaaaggggccaaaaaaaaagggcctcttttttaaaaaatggggggggggcccccccccctttttttttccaaaaaaaaccccgggggggttaaaaaaaaattttttcccccccccaagaaaaaaagaggggtgtttttttttttccggggggg

SEQ ID NO: 41327 - DNA, 1205 bp, Zea mays
  misc_feature: Ceres CLONE 1436416
  misc_feature: Encodes the peptide sequence at SEQ ID NO. 41328
aacccaaaacgaaacgaaacgaagctactccagctagggccacacgcttcccttcccccccgccccgctcccaaactgaaaaccaaactagtctccatctcggcatctcgtctctctcttccccatctccggcctcccccatccgcctcctcccatgtggctgccctgggtcaagacgcgctcctcctcccccacctccgcctcccccgcctccacctgctcctccacggcgctcgccgccgcctcgccgcgcctctccttcaactcgccctccctcaaggatctccaggccctcctccgctccgaccacgccgcgccctccccttctcccccgccgccgcacacggccccgtgctccccctccgccgcccgcgtcttccaccgcgtccgcgtggccgcctccgccctccgcgcgctccgcaccctccaggcgccgcccgtcgccgccgaggccgaccgccgcgtcgtgctctactacacctccctccacgtcgtccggggcacctacgaggactgccgcgccgcgcgcgccatcctgcgggggctccgcgcctccgtcgacgagcgcgacctcgccatggacgcgcgctacctcgaggagctcacggcgctgctcccgcgcgcccgccggatcacgctcccccaggtcttcgtcggcggccgccacctcggcggcgccgaggagctccgccgcctgcacgagtcgggcgagctgcggcgcgtcgtggccggcgccgcgccgctcgccgcctgcgcgcggtgcggcggcgagcgctacgtgctgtgcggcagctgcgacgggagccacaagcggtacagcctcaagggcggcggcgggttccgcacctgcgccggctgcaacgagaacggcctcgtccggtgcccggactgctccccgccggccgtctgatccagattcaaaaaggttccaatccactgatgacctgtactcagtagtactagattttaatttcctagttgtaccaaaatcgctccctttcatgaaggtttcgtcttgcttgtggcatgtccggtgatggattttcgagacttgggacatcatttcggttcaggttgcttctcttggtcatggtaatttagctatgtgttgtagcttatgtttgaaccgagtatgtcatgtatctctactccggacaccatgtttacgtcatctttggttgtgccgtgtaaaaaaaaaaaaaaaa

SEQ ID NO: 41328 - protein, 251 aa, Zea mays
  misc_feature: Ceres CLONE 1436416
  misc_feature (105)..(172): Pfam Name: Glutaredoxin Pfam Description: Glutaredoxin
MWLPWVKTRSSSPTSASPASTCSSTALAAASPRLSFNSPSLKDLQALLRSDHAAPSPSPPPPHTAPCSPSAARVFHRVRVAASALRALRTLQAPPVAAEADRRVVLYYTSLHVVRGTYEDCRAARAILRGLRASVDERDLAMDARYLEELTALLPRARRITLPQVFVGGRHLGGAEELRRLHESGELRRVVAGAAPLAACARCGGERYVLCGSCDGSHKRYSLKGGGGFRTCAGCNENGLVRCPDCSPPAV

SEQ ID NO: 41329 - DNA, 663 bp, Zea mays
  misc_feature: Ceres CLONE 1436419-F
  misc_feature (222)..(222): n is a, c, t, g, unknown, or other
  misc_feature (223)..(223): n is a, c, t, g, unknown, or other
ggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctnnaacgcgaccatttttccctcaaatacctcacaaagcttccctataaggttggccccttctttccccccccaataacctttcccataaaaaggaaccccccttttctgtatatggggaaaaaaaacccgcgcccccttttttaaccccttttaaaggggggcgccccaacaaaaaagagaaatttccccacaacaaaagggaaaaattttttctcttttttttctccccccccggggggggtttttttttttaaaaaaaaaacccccccccccccccccccttttttttttttgtggggggggtgggcccccctctcttttgtggggttataaaaaaaaaaacacctcccatgtgtgggagggagggaaaaaaaaaaacaaaaatatcatttttgtcgtttaataaaagggcaaaacagccaaatactatgtttttatata

SEQ ID NO: 41330 - DNA, 705 bp, Zea mays
  misc_feature: Ceres CLONE 1436508-F
  misc_feature: Encodes the peptide sequence at SEQ ID NO. 41331
ggagctccccgcggtggcggccgctctagaactagtggatcccccgggctgcaggaattcgcacgagaccattacctagaacatcctaatcgaaaactcttctgaatccggcagcaccatgcagaaccccgtcgcgaaccctttcactgcggccgccgccgctgcggcagggaacggcgtccaagcatcgggggctggaggggagcggccggaggacgcgtcgaagcagaacctggcgcaggtgacgagctcgatccagaagacgctgggcctgctccaccagctcaacctcaccgtctcctccttcaactctgcctcccagctccccctcctccagcgcctggcctacggaagcatcttcttgaggagcttgaacaagctttccctgaggacgtagaagcatacagggagatacgtgctacttctgctgctgaggcaaagcggttggctcagtcccagggtactttgcctaatggagatgtcaaaatgaaagctgagcattgagcgaatggtacgactacagagggcaagttttgtatctctgcttagttttggggatggctttgtaaccagaaacatgcatatctttctattgcacgtcccctgatcagtgaatgtgtacatactatcgtagcatgtgtggcccattggatcaactaaactaataacttcaaaaagattccgggacaattcgactaccgatag

SEQ ID NO: 41331 - protein, 92 aa, Zea mays
  misc_feature: Ceres CLONE 1436508-F
MQNPVANPFTAAAAAAAGNGVQASGAGGERPEDASKQNLAQVTSSIQKTLGLLHQLNLTVSSFNSASQLPLLQRLAYGSIFLRSLNKLSLRT

SEQ ID NO: 41332 - DNA, 684 bp, Zea mays
  misc_feature: Ceres CLONE 1436510-F
  misc_feature: Encodes the peptide sequence at SEQ ID NO. 41333
  misc_feature (502)..(502): n is a, c, t, g, unknown, or other
  misc_feature (535)..(535): n is a, c, t, g, unknown, or other
  misc_feature (547)..(547): n is a, c, t, g, unknown, or other
  misc_feature (643)..(643): n is a, c, t, g, unknown, or other
  misc_feature (684)..(684): n is a, c, t, g, unknown, or other
tccccgcggtggcggccgctctagaactagtggatcccccgggctgcaggaattcgcacgagaccattacctagaacatcctaatcgaaaaaactcatgtcagaccagagctccaccctcgcctcgaagggcaaagcctcgacggctggcggcggccgaagcgatgtcgcggcggccgttggagtgtcatcttgcggcgtaagacccggactaccacccactggccagacgacggaggaggaggaggcgcgcgtcaggcgcgaggcggagaaagccgagctcgaggaggagatcgccacattgaaggcggagatcttcgccctggaggaagagttggccaggatggatgccgccgccgccgctacgcgcgcgagcgcttctcactctcgtgtttcagctaggccactgtgattggctggagctgttgtcgtagatctcggaggtaggtagatggaattccccattgcaattacttcaggtcatgttctgctgaaacagctgncacgttctcgaattttattgccccttagcacgnatggtttgggantatcccaatcaagaactggtctgcacaccttcagaacaaaaacaggcgtcatggtgtgggggggaggccacagagcagtattgtccgccaatgcancaggaaaacacgctcgtttggtcttttgtccggggaactgn

SEQ ID NO: 41333 - protein, 104 aa, Zea mays
  misc_feature: Ceres CLONE 1436510-F
MSDQSSTLASKGKASTAGGGRSDVAAAVGVSSCGVRPGLPPTGQTTEEEEARVRREAEKAELEEEIATLKAEIFALEEELARMDAAAAATRASASHSRVSARPL

SEQ ID NO: 41334 - DNA, 698 bp, Zea mays
  misc_feature: Ceres CLONE 1436511-F
  misc_feature: Encodes the peptide sequence at SEQ ID NO. 41335
ggagctccccgcggtggcggccgctctagaactagtggatcccccgggctgcaggaattcgcacgagaccattacctagaacatcctaatcgaaaaattccgtcaagtccttcgacttcgtcaaggtcagcctcggctacggcggcaacaagaagctcgacggccgccactcccagggccagcttatgcagatgaccatgatggttccaccttcgttaccgcgagaacactctctgaacaaggaggacagactgcttcgcttttgctggctggttgtgaagcacagagacgcggtatatggactggagttcgtcaatgaggatggcgggaggaacgagctgagcggtttcagccttgctcatagaaaggatgactacgatactgaacttgcctcggacgatgaagattcggatagcgattcagacacgacgagtatgcggtcgaggaggagaagtagaactgcttggctaggtttctgcagtctcatttgtgttggcagatgcattttctgcagtctcatcgagtacgtgaatttattattattataatatagtagtagcataggatgagagtcagaacctatcaacttgattctaacacacttttgcagtgtcgagcatatgcttgtcattagatgtttaaggcgtgttctgcttctttcaatcatggtgtataacgttccgggtagtgagttaatg

SEQ ID NO: 41335 - protein, 116 aa, Zea mays
  misc_feature: Ceres CLONE 1436511-F
MMVPPSLPREHSLNKEDRLLRFCWLVVKHRDAVYGLEFVNEDGGRNELSGFSLAHRKDDYDTELASDDEDSDSDSDTTSMRSRRRSRTAWLGFCSLICVGRCIFCSLIEYVNLLLL

SEQ ID NO: 41336 - DNA, 881 bp, Zea mays
  misc_feature: Ceres CLONE 1436512-F
  misc_feature (36)..(36): n is a, c, t, g, unknown, or other
  misc_feature (470)..(470): n is a, c, t, g, unknown, or other
  misc_feature (474)..(474): n is a, c, t, g, unknown, or other
  misc_feature (498)..(498): n is a, c, t, g, unknown, or other
  misc_feature (539)..(539): n is a, c, t, g, unknown, or other
  misc_feature (540)..(540): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (585)..(585): n is a, c, t, g, unknown, or other
  misc_feature (586)..(586): n is a, c, t, g, unknown, or other
  misc_feature (808)..(808): n is a, c, t, g, unknown, or other
tcgcgcgggtccccccccggttcacccggcggtgcnccccccccctttttataattggagctccccgcggtggcggccgctctatactagtggatcccccgggctgcaggaattcgcacgagaccattacctagaacatcctaatcgaaaaaatagaagcgagcgagcgagcagcagtaggcagcggcgcgggcgaggagcagaccagcacccagcagccctcgtcggggggcgggagctgcaccttcaccagccgccgcctttccccgtctcctctgcctctgcctctccccctaacccccttccatttctccaccccacgccggtcccgcgtccgcttcctcgccacttcgttcgttccgcacccgccgccccggctgcgttcgcattggggggcccgcatggagccctcccgagaagggggaaaaagatcggggggaggggcactgtaccggggtgggtggtacaangggntcttgggcgagggcgcaccgaccnagcacaaagcgccgcctccaaaaaaaaatccctcccttccnnccctggaatgaacccagccgcgccgcnnnnnnnnnnnnnnnnatnnaaacctctccccccccgggatggtaggaggcgcgggcggaggtatgcgccgcggctagtctagggtgtctacgcggcagggagggccatgggcccccgccgacctcgacccaaagcgtggctcttgggtccagacttgttggcggggagtcgtcgggtaggcgcgccgatataggtgggggagtgaccccccgccgggaagcgagtggggcgccgtggtgcntctgcaacccccgctgtcccgaagtgcgcccgcggggcgcccccgagcccgccgaaccgcggaatcaggatcg

SEQ ID NO: 41337 - DNA, 699 bp, Zea mays
  misc_feature: Ceres CLONE 1436513-F
  misc_feature: Pfam Name: Trm112p Pfam Description: Trm112p-like protein
  misc_feature: SWISSPROT Homolog: EC 2.7.1.130 Tetraacyldisaccharide 4'-kinase
tccccgcggtggcggccgctctagaactagtggatcccccgggctgcaggaattcgcacgagaccattacctagaacatcctaatcgaaaaacaatcttgtttgttgttattgttagtttttagaaaaacaagttcattttaccttcctcaatatcatgaaagcccaggtcatccaattttaagagcggagagaaaaaaatattttgtgatagttaggaaggtaaagttaattttttagttagttttttttctgagagaaaccccctttgttgttgagcggcggggctagccgtttatacctggcaaccactacacgacgagggcaatgaggcgaacggcggcgttgctatcggcccactgcggccgcagcatcccgttggcgctcgccgacgtgctcgtctgcccactctctaagcaacctcttaggtactgcgaggtcaacgggtctttggtcagcgactccgctggggtggcctttccagtacttgatgggattccttctcttgtaccaaaagatggaaagttactcgacgaccaagaagtgaaatcagaacaagagtccagcactagggattcttctggttgaatccttgtctatgcaacatctaattgaagcaatatgttgtagtaaatcgacggtaataaacccagtgcttcttgtcggaaatcgtcaccatattgccctagaagatgaggtg

SEQ ID NO: 41338 - DNA, 731 bp, Zea mays
  misc_feature: Ceres CLONE 1436514-F
  misc_feature: Encodes the peptide sequence at SEQ ID NO. 41339
tggcggccgctctagaactagtggatcccccgggctgcaggaattcgcacgagaccattacctagaacatcctaatcgaaaaaggacctgctctgtttctcggcgagtttttcccacttccacctctccgtccctgccgagctgcggcggccgcatcgactgttagggcgaaaatccgttctagtctctcggcgattttcggcaggcggaggcagcaggatctgcgggaaggatttcgtgtcgagatggctgggcgcaaggaaactgcactcgacctggcgaagttcgtcgaacagggcgtccaggtgaagctcaccggcggccgccaagtgacaggaactctaaagggatatgaccaactactcaacttagtgctagatgaaccattttgagattgaagaaagcaagatgatccctttgaactattcaggaaaactagacaccttggcctttttggtgggcaaaaggcacgcaatcctgctggtcctcccccactgaggggacttgagaaattcccccaaccttttccccccggaagggaactaactttgcccccccccgaacaaattttcccctggggaaaaaaaaaccggttttcccgggaaccgtgtaaacccggggccccttgggcggttttttagggggggtttaaaagcccccaaaatctaaaaatgtggggccaaaaatttttgggggagaacctcccccctcccccgcccggggggcccaat

SEQ ID NO: 41339 - protein, 48 aa, Zea mays
  misc_feature: Ceres CLONE 1436514-F
  misc_feature (9)..(47): Pfam Name: LSM Pfam Description: LSM domain
MAGRKETALDLAKFVEQGVQVKLTGGRQVTGTLKGYDQLLNLVLDEPF

SEQ ID NO: 41340 - DNA, 700 bp, Zea mays
  misc_feature: Ceres CLONE 1436515-F
  misc_feature: Encodes the peptide sequence at SEQ ID NO. 41341
tccccgcggtggcggccgctctataactagtggatcccccgggctgcaggaattcgcacgagaccattacctagaacatcctaatcgaaaagcaaatcgggagaaggggtttttatgcctcctcgcccgctccgaatcagctcgaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggcgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggacgtgggcgtggccgtggtcgtgggcgcggtcggggtcggggacgttgagcatgctagctgcttttggaaattgcattgcgtgcatctgcagtgtaacctacattcctatcaattgtacgaagtatgcctttgattatgcaaccatgtatcaattggttttttttttttgccgtggatttatggtgatgagggtaccatgtgg

SEQ ID NO: 41341 - protein, 114 aa, Zea mays; identical to SEQ ID NO: 37056
  misc_feature: Ceres CLONE 1436515-F
  misc_feature (5)..(70): Pfam Name: LSM Pfam Description: LSM domain

SEQ ID NO: 41342 - DNA, 775 bp, Zea mays
  misc_feature: Ceres CLONE 1436519-F
  misc_feature: Encodes the peptide sequence at SEQ ID NO. 41343
tccccgcggtggcggccgctcttgaactagtggatcccccgggctgcaggtattcgcacgagaccattacctagaacatcctaatctaaaagaagaacatcaaatacatactggctcactcgtgattccttcacccagcagttcgtaaccacctgctaaatcatcaaaaagatgcccccctgcaaagtagcagcagccttactcctgttgatcatcacaacaatttctgtcaacaccgtaactgggtcgcgatgtaacgctcaggagaagaaccagattgtgagcttgtgccaaatgtacatccagagaggaaccctcgttcagctcccatcccaaactgggccatgcttggcggccattgaaaaagctgggagagggacacccagggtaattcaaattaaaatgccccccccaaatctatgaacggtgggagaatccacggaaaccccgcatccaccaaaaaacacagccctttgggcattttctcggtacacttaaacatgtgttcgggttaatacccccccctcccccccttgattcttttataaaagggcctccctctaaaaggccccacgatgggcttgcaatagtaatccctggttaaaaaaaagttccccaaaaaaaaacaaatttccctcgacctctttagaaaaaacccttcccgggggggaaaattttcggcgcgagggggtttttaatgcgaaaaaaaaaactgggggtccttttattgggggcaaaaacagaaaaaaaaaaaaatattttattcccctcccag

SEQ ID NO: 41343 - protein, 83 aa, Zea mays
  misc_feature: Ceres CLONE 1436519-F
MPPCKVAAALLLLIITTISVNTVTGSRCNAQEKNQIVSLCQMYIQRGTLVQLPSQTGPCLAAIEKAGRGTPRVIQIKMPPPNL

SEQ ID NO: 41344 - DNA, 803 bp, Zea mays
  misc_feature: Ceres CLONE 1436520-F
  misc_feature: Encodes the peptide sequence at SEQ ID NO. 41345
gctctagttctagtggatcccccgggctgcaggaattttcacgagaccattacctagaacatcctaatcgaaaaatcactccaccatgtccgccgccacctcggcggcagcggccgtctcctcgtcgcgcccgtatcccctcctccaacccgcctccagccccaccctcgtttccttccctcggagacagcttccatccacctcggttgccctgtccgcgccctcccagctgtcgtcgcggggctcgccgctggcgccggcggccaacccgaagtaccacaacgctaaggtggactcctgtagacgagggacccggacggtgaggagctcctgcgggtggttcccgttggcaagtggccccccgcggggcgtccatggatgaagatcaaggcgggggccccaccccacaatggaacccccgggaaaaaagccttaagctccaaggggggggccccgggtgtctctttgccggaacccgcccggaaagggcgcttcccaggggcgcccattattctcttatcaaaacaaaggaaacacgaggggcctccaggggagtccgggaccgaagggagcaacacgtcaccccccgtgggggaacctctcctgtggagagaaagagtggcctcccctaatacttcaaaagggcgggggtaaggggggtttcccacaaaaatttaaaacgggtgttttttttctataaagaaaatattctgggggggaaaaattctttaaatttttcgtttgttacaccaaaaaagaggggtgcccaacgttgtttgcgcctcccgtaaggggtgccaaag

SEQ ID NO: 41345 - protein, 98 aa, Zea mays
  misc_feature: Ceres CLONE 1436520-F
MSAATSAAAAVSSSRPYPLLQPASSPTLVSFPRRQLPSTSVALSAPSQLSSRGSPLAPAANPKYHNAKVDSCRRGTRTVRSSCGWFPLASGPPRGVHG

SEQ ID NO: 41346 - DNA, 848 bp, Zea mays
  misc_feature: Ceres CLONE 1436522-F
  misc_feature: Encodes the peptide sequence at SEQ ID NO. 41347
  misc_feature (29)..(29): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (107)..(107): n is a, c, t, g, unknown, or other
  misc_feature (848)..(848): n is a, c, t, g, unknown, or other
aggttcccctccctctcccccgttctttntntcccnnncaataacnnnnaaataatggggctccacgcggtggcggccgctctataatagtggatcccccgggctgnaggaattcccacgagaccattacctagaacatcctaatcgaaaaaaagcgaaaggagagaaggaatccgatccatccaagccaagccaaggcagataagaagaagaagaggaggaagaagaagcatcggcagcatgtcggaggggactgccaactgcgtggacatcctgatcgccatcatcctgcctccgctgggggtgttcctcaagtacgggtgccgccacgagctctggatctgcctcctcctcaccttcctcggctacatccccggcaccatctacgctatctacgccatccccgaaaaacaactatttagtcatcctgtggcccgacgaggatcccggtttcctggactcggcgtcctgtcccccatccctggacgccgacattggcgcctgcgtagtatcgcgtcgggacactcggctccggcttttgctaactgcgccccggcctccgcggtgttgatcccgggcgacccgcccccccccctctaattcttctctgttccctccgaagtttacgccgaattggagtcctccgctttgtctccgccacgaagtcctgtgtcgcgatgccctcccccatttccccatcggcgtgaaccagccgatattcataattccgcccgcgtgtaggcagatgcgatattgaacgcgcagtcgatcgccccccgtcctcccgcttttttctgtttcgccccttgtctccgcccccaatactccccgcacactattattataan

SEQ ID NO: 41347 - protein, 119 aa, Zea mays
  misc_feature: Ceres CLONE 1436522-F
  misc_feature (6)..(56): Pfam Name: UPF0057 Pfam Description: Uncharacterized protein family UPF0057
MSEGTANCVDILIAIILPPLGVFLKYGCRHELWICLLLTFLGYIPGTIYAIYAIPEKQLFSHPVARRGSRFPGLGVLSPIPGRRHWRLRSIASGHSAPAFANCAPASAVLIPGDPPPPL

SEQ ID NO: 41348 - DNA, 722 bp, Zea mays
  misc_feature: Ceres CLONE 1436525-F
  misc_feature: Encodes the peptide sequence at SEQ ID NO. 41349
gctcttccctagtggatcccccgggctgcggttttcgcacgagaccattacctagaacatcctaatcgaaaaatacagaatccgacgcgatccagaagaagccaaggcctcttcagatcctcccgcctccctctgcgaggttcccagaccgagccatcgccggcgctaggctcggggatcttgtcgggtcccgtcccgtcctaccacttcgccggcgctgcgtcgccgtcactcgtcagtcaggactcaggatccccaagatggcttcttcaaacggtgaggctgagcaacaatggatagagaatatcaagtcaggaggaacagttccctgtctaccacctgaaaactgtcctaatggctgggctactcctcccggtgattcatttatggtcagaggcccagaacatcttacaaacaatggaaaaataccacgtggagagtatcttctgaatgctctcggctttgattggatcaaaggaccagcaaaactctgtgagatcctgaaagacagtaaccctccaagttagaaaagctttcgacgaggtaggtttcccgtgggtaacccggtctctctggtctgggccattccaatcttgtcacctgccccaagggaacaactttccagtggccacaatttctttgtttccctttgtcgccttggttatgccttatccccccgagccggccccccgcctttaatgcgaccacagtttttctttgtg

SEQ ID NO: 41349 - protein, 88 aa, Zea mays
  misc_feature: Ceres CLONE 1436525-F
MASSNGEAEQQWIENIKSGGTVPCLPPENCPNGWATPPGDSFMVRGPEHLTNNGKIPRGEYLLNALGFDWIKGPAKLCEILKDSNPPS

SEQ ID NO: 41350 - DNA, 741 bp, Zea mays
  misc_feature: Ceres CLONE 1436536-F
  misc_feature: Encodes the peptide sequence at SEQ ID NO. 41351
ggagctccccgcggtggcggccgctctagaactagtggatcccccgggctgcaggaattcgcacgagaccattacctagaacatcctaatcgaaaaagctgatctgagcggccgcgcttccggtgggaggatggagaaggctctcaccaaactgggcagcttcaccatctcccgcaaggccaagcaggagctctccgccatcggcgacgacatctctcgtttttcgagcacggtggaggagaaggcaaaatgggtcttcgaaaagctcaaaggacacaagaagtccctctctgatctactgcgcgagcacaacctccctccaggcctcttccctcgtaacatcatctgctatgagtacgacgaatcgacatcgaagctgatggtgcacctgtccaagccctgcgaggtgagcttcagggattcctccgcgatacggtatgctcctcgcgtcaaggcgactctgccccgagggaagcttttctggggttgaaggattgaaaaccaagtggctggttttggttaaaggtgttaacctttgcatccacagctaccattccaaaaaaatatgctttctccccggggggaaaaaacctaagccaaaggatgcttataggggccctcccgaaaccccctccgtttaaaaattcgaaaccccaatgaatccccccaaccgcgaaaaaacttcgttcccgcctttttttgtgggccccccgccccccgcaactgtctcccccgcccctt

SEQ ID NO: 41351 - protein, 119 aa, Zea mays
  misc_feature: Ceres CLONE 1436536-F
  misc_feature (32)..(120): Pfam Name: DUF538 Pfam Description: Protein of unknown function, DUF538
MEKALTKLGSFTISRKAKQELSAIGDDISRFSSTVEEKAKWVFEKLKGHKKSLSDLLREHNLPPGLFPRNIICYEYDESTSKLMVHLSKPCEVSFRDSSAIRYAPRVKATLPRGKLFWG

SEQ ID NO: 41352 - DNA, 730 bp, Zea mays
  misc_feature: Ceres CLONE 1436538-F
tggcggccgctctagaactagtggatcccccgggctgcaggaattcgcacgagaccattacctagaacatcctaatcgaaaactctactgtaactctggtggttcgctcttcttcctcccagtcgcggctggacgcggaggtggaggtcctggcagcggcgctgctgctgctggcgacaagaacccggacggcaacaagccgggtgaggaggagccaggtgacgacaacggtgccgccgggactaagccacacgaggagaagcgtggccccgccctccactccgccctgcaggagggtgcgcacgcaaagaggccccgcaacaacgacagcaagaccgtggacaccttgaagatctacttcttacatgagctgaacgactcgcacgcggacatcgcaatctccactcaggccatgtcccctatgagtgcggtgtttacctacgtctgcgaaaaactcgcccccgagactgccaagatatcacgtgaccctggaaccccaccgtaacctcctgtgacatccaaacgtccgtgcgccgcgccttcccaggggagctcccccagcccgctcatcatacgacgtcacctacggccggtcctcaagcttcaacacctgccctaggactggaagggagctgcctgcttggcagccatctcccgcctaaatgaatcccctttgtcccttggtggtccccttcccggtgcgtgccttgcggtccggtggcaccccccc

SEQ ID NO: 41353 - DNA, 751 bp, Zea mays
  misc_feature: Ceres CLONE 1436561-F
  misc_feature: Encodes the peptide sequence at SEQ ID NO. 41354
tggcggccgctctataactagtggatcccccgggctgcaggaattcgcacgagaccattacctagaacatcctaatcgaaaaagaagaaaggaaagtgctactgggcattggctactggcctactgccaactacccgtggggtcccgtggaagagaagagagcatcgccggagttggggtcggcgcgccgacgaggaacaaaagaagacggcggtggggcggagatggggagtcctctgggcgggtggccgtctttacacccgcacaacttcagccagctcgtcccggccgacccatccgcacagcccttcgatgtcacaccagcccacttatgttgcgacccacaggactgattccgcccccccagtcaggtgataaccagcggagtcgagggaaccttctggctgaaggcctttctacccgaaatccccaaaaactgagggcccaaaaaaccttgccccggaaaaacttcctttccgggaaaaaaaacccgggaaacacaaagcccccccgggggaccggttccccaaccttcggtggggcttccccccggcgcgaaaaactttaacccccccgtggggggcccccccacccccccccgcggcgggggtgttttcccccctgggggggttcccccagtaaaaaggaaaaagaaaaaacccccccgtgtttttctcctttcccccccccccccggtgggggccccccccccaaagggccccccccctttttggggggggggggctccccc

SEQ ID NO: 41354 - protein, 42 aa, Zea mays
  misc_feature: Ceres CLONE 1436561-F
MGSPLGGWPSLHPHNFSQLVPADPSAQPFDVTPAHLCCDPQD

SEQ ID NO: 41355 - DNA, 722 bp, Zea mays
  misc_feature: Ceres CLONE 1436567-F
  misc_feature: Encodes the peptide sequence at SEQ ID NO. 41356
  misc_feature (241)..(241): n is a, c, t, g, unknown, or other
  misc_feature (492)..(492): n is a, c, t, g, unknown, or other
  misc_feature (493)..(493): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
tccccgcggtggcggccgctctagaactagtggatcccccgggctgcaggaattcgcacgagaccattacctagaacatcctaatcgaaaaaaacccaaactaacccttctaatccaaggctgtgaagggagctgctagccgccaccagccgccatgtctggagggatcgcgcgcggccgcctcgccgaggagcgcaaggcctggcgcaagaatcacccccacggtttcgtggcgaggccngagtcgctgaccgacgggtccgtgaacctcatggtctggaactgtaccatctccgccagcacgggaccgattgggaaggggggactacccacttacctttcttttcggggaaaataacccagccaccctcccaagggcaatttcccaagggttttttccccccaggtgtttccccgggaagctgtgcccttcttttgaaaaaaaaaacttttggacccctcttctctttaaaaaatttttgggaagggggnnttttttttttaccccccccccctaattctccaaaaaggggttccccccttccccccccccccaaaaaaaaaggagttttttttgggaaaaaaaccccgcggggggggaaaaaaaaacccaatactnnnnncctccccccccccggggggaaaaaaacctcttctttataaaaaaaaaaaaattgggggggccccgcccccacccaccttttttgtgtggggggcgccaa

SEQ ID NO: 41356 - protein, 67 aa, Zea mays
  misc_feature: Ceres CLONE 1436567-F
MSGGIARGRLAEERKAWRKNHPHGFVARPESLTDGSVNLMVWNCTISASTGPIGKGGLPTYLSFRGK

SEQ ID NO: 41357 - DNA, 682 bp, Zea mays
  misc_feature: Ceres CLONE 1436569-F
  misc_feature: Encodes the peptide sequence at SEQ ID NO. 41358
cgcggtggcggccgctctataactagtggatcccccgggctgcaggaattcgcacgagaccattacctagaacatcctaatcgaaaacataaccacgagccaagcgcgacggatcccaatccatcttctcctcatccccaccacgaccaaaaaaaatccggtcgccgatgccgtctgctgcctgacatcggtcagccagggtagatcgcgcaggcaggcagccccacacacatacgaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatccccgacgccgacctcgcgcgcctccacccgtgggacctcctccccgccgccgcaccagggggatccggagccgacgccgacggggagcgcttcttcttccaccgcccggcgacgcagtgctggcgcaagggcggcggcgcggccagggcggccggcaccggcgtctggaggccgtccggcaaggagaccctcgtcctgtcccgcgctgcaagcgcccgtcggcaccagcggacgctcgtatctgccccccgcgcggcgcgccgcaccactgggcatg

SEQ ID NO: 41358 - protein, 137 aa, Zea mays
  misc_feature: Ceres CLONE 1436569-F
  misc_feature (13)..(135): Pfam Name: NAM Pfam Description: No apical meristem (NAM) protein
MEGRRPGAPVAGLPIGFRFRPTDEELLLHYLRRKALACPLPAGVIPDADLARLHPWDLLPAAAPGGSGADADGERFFFHRPATQCWRKGGGAARAAGTGVWRPSGKETLVLSRAASARRHQRTLVSAPRAARRTTGH

SEQ ID NO: 41359 - DNA, 680 bp, Zea mays
  misc_feature: Ceres CLONE 1436575-F
  misc_feature: Encodes the peptide sequence at SEQ ID NO. 41360
tggagctccccgcggtggcggccgctctagaactagtggatcccccgggctgcaggaattcgcacgagaccattaccagaacatcctaatcgaaaaacccaccgttgctgctgctataccaccatcaccagtcaccaccaccggataaggacacggcagcactagctcgtagagggtcggccagagtcagcaaaacagaaaaagggagaggggatgggggccgatcggttcccgagcgcggcggagggcggcctcggcggcgaggcgctctactgcgcggtcatcctgtggctgtccgtgacgtcgtggatcatcttcacctgggccggcgacggcggggaaggcgggaggaggcggcggggcggcggccgcagccgcgggagcccagcgttcgtcggcgcgtcggggctctgcgacggcaccgggcccaaatgcagcggcggctacggcatctgcggcacctgcctcgactagctagccgcgcgcctgctctgctactagtaagtttgtgtgagcgtgtttgtagcatctacatgtcgtcgtcgtcgtcgtcgatccgtggcatcgatcgaaccggagcagctcccctgtgttatgaacctagtcagtctacttcgatcttgcatcggttgcgcaaactgagagttgttgtatgttagcacctttttttttttttttgc

SEQ ID NO: 41360 - protein, 86 aa, Zea mays
  misc_feature: Ceres CLONE 1436575-F
MGADRFPSAAEGGLGGEALYCAVILWLSVTSWIIFTWAGDGGEGGRRRRGGGRSRGSPAFVGASGLCDGTGPKCSGGYGICGTCLD

SEQ ID NO: 41361 - DNA, 708 bp, Zea mays
  misc_feature: Ceres CLONE 1436603-F
  misc_feature: Encodes the peptide sequence at SEQ ID NO. 41362
  misc_feature (371)..(371): n is a, c, t, g, unknown, or other
ccccgcggtggcggccgctctagaactagtggatcccccgggctgcaggaattcgcacgagaccattacctagaacatcctaatcgaaaactaggtcattccacttccaccaatctgtctcccaatctttcttgctgctccaatccgctctctttactcggccagcggaaggggagaggagggcgagatgacggtggagaaggtggacgcggggctttccgacttcgaagcccacttcgatcgcctcttcgcttccccggacgccgcctccgacggcaaggtgaagctgctgctcttcctggccgaccgcaagcctgactcctccctctcctggtgccccgactgcaacgtggcggagccggtgatctacnagcgggctggagcactggaggggcaagaccgcgtgctcctgcccgcctacgtcggggaccagcccacttggcgcgaaccgccgcacccgtggagggtggaccccaggtcgggctcagggcgtgccacccttatcccctgggaggaaggccccccccccccccccttcgggaacaaaaggcccccccagggcaaggttaaccctccctcgccgggggggaactggatctggcttcggacaaacccggttcccccttcgggtcccccttcgggaaggggcctaaaaaaaaacgggggcgggatttctcccccctctgccccaacaaaaattggggaaat

SEQ ID NO: 41362 - protein, 173 aa, Zea mays
  misc_feature: Ceres CLONE 1436603-F
  misc_feature (9)..(119): Pfam Name: DUF953 Pfam Description: Eukaryotic protein of unknown function (DUF953)
  misc_feature (62)..(62): Xaa is any aa, unknown, or other
MTVEKVDAGLSDFEAHFDRLFASPDAASDGKVKLLLFLADRKPDSSLSWCPDCNVAEPVIYXRAGALEGQDRVLLPAYVGDQPTWREPPHPWRVDPRSGSGRATLIPWEEGPPPPPFGNKRPPQGKVNPPSPGGNWIWLRTNPVPPSGPPSGRGLKKNGGGISPPSAPTKIGE

SEQ ID NO: 41363 - DNA, 700 bp, Zea mays
  misc_feature: Ceres CLONE 1436618-F
  misc_feature: Translation starting site: 152
  misc_feature: Pfam Name: DUF1279 Pfam Description: Protein of unknown function (DUF1279)
tccccgcggtggcggccgctctagaactagtggatcccccgggctgcaggaattcgcacgagaccattacctagaacatcctaatcgaaaaaccgcacccccgcaaagagaccaaaaccctagccgtcaccccgtaacctcactggcggccatggcgttctccggcaggatcaagcagctcgtgaagaagtacggcaaggtggccgcgggcgtccatctatccgtctcctttgcctccatcttcggcctctacgctgccatcaacaacaacgtcgacgtcgaagccgtcttccggagatttggcatctcccccggcgttgccgtcgacggggaggcctcaccctcacccgcccctgtctcccgcgatgagcacctgcaacacgcctccctaccgccctgtcctagtgaggtactgcaagaagagtcggagcagcggcagcccccgcaacaggacgatggagctcgtgccgttgagtggaggcccgctcgggctcgccctcctctgcaaacaggcactgttgcccgtgagaatccccttcactatcgggctcacccgccccgttcccagggcccttacccctggaaacctcggctaaacctaattttgaagcccgttttccccttctcaaaccccctcgtgggttttaggggccaaacccaatttttagccccccttcttttctaccggcgtgggggaagg

SEQ ID NO: 41364 - DNA, 774 bp, Zea mays
  misc_feature: Ceres CLONE 1436622-F
  misc_feature: Encodes the peptide sequence at SEQ ID NO. 41365
  misc_feature (487)..(487): n is a, c, t, g, unknown, or other
tccccgcggtggcggccgctctataactagtggatcccccgggctgcaggaattcgcacgagaccattacctagaacatcctaatcgaaaagttgccccagaggtgattaacagaaagggttatgatcggtgtaaaggctgacatatggtcttgtggggtcatcctgtatgtgctagtggctggttatcttacgttccgagataaacacttgctggacatgtctaagaggattgagaaagctgacttcaaatgtcccagttggttttctaccgatgtgcacacgtttttgctaaggattcctgatcctgactccctactagaaagatctcggacgaaaaaatcatggaaaatccttgctttagcaaaggtctcaggtggaaagcttcttacgaaagattttagaaagtaacaaaaccctcttattgcgaacaataaagccaaattttttttttcaccgacgcgccccaaatccccatttgatcgccncggaatcatgcgtctgaagacccccctccccccctgactgggctttttggaaccaaccccccccaaccaaatggtctttggaccccttcttggttttttttgtgcgacttctaacgtataagaggcgccccctctattttctttgtgcgctaaaaaaaagtctccccaaatcatattttcaaacagggaaaaaaatcggaaaacaaatttgctgcgatgacctcacacagcaaaggggtgcgtgttttttttaatatggggaaactctccttaactcccaaagagag

SEQ ID NO: 41365 - protein, 95 aa, Zea mays
  misc_feature: Ceres CLONE 1436622-F
  misc_feature: SWISSPROT Homolog: EC 2.7.11.1 Non-specific serine/threonine protein kinase
MIGVKADIWSCGVILYVLVAGYLTFRDKHLLDMSKRIEKADFKCPSWFSTDVHTFLLRIPDPDSLLERSRTKKSWKILALAKVSGGKLLTKDFRK

SEQ ID NO: 41366 - DNA, 689 bp, Zea mays
  misc_feature: Ceres CLONE 1436628-F
  misc_feature (336)..(336): n is a, c, t, g, unknown, or other
  misc_feature (340)..(340): n is a, c, t, g, unknown, or other
  misc_feature (341)..(341): n is a, c, t, g, unknown, or other
  misc_feature (352)..(352): n is a, c, t, g, unknown, or other
  misc_feature (389)..(389): n is a, c, t, g, unknown, or other
  misc_feature (390)..(390): n is a, c, t, g, unknown, or other
  misc_feature (401)..(401): n is a, c, t, g, unknown, or other
  misc_feature (403)..(403): n is a, c, t, g, unknown, or other
  misc_feature (434)..(434): n is a, c, t, g, unknown, or other
ccgcggtggcggccgctctagaactagtggatcccccgggctgcaggaattcgcacgagaccattacctagaacatcctaatcgaaaaaataaaagtgaaattccattaccttgctgtctcggtctgtcggccatcgccggttgcgcagcgggcagcggctcacgtcgacggggaagactccggaggccacgggcgttacattctcctgccgtatttttgcgatccctggctaaccaaacaaatggtggagacatggattagtgcttatgggaaaatcatccccaacagggattgaagtgacagccagggatccactcatcccctgggtggaaaantcanngtgtggattgnattgctagctaccgaacagccctcagcgtgctatttnncatggatcctngntagacaccactgaacttcctgggttccaatnaagttcgagcatagagatcgtcttccctcaactggagtggcagtttatccgaaggtcttcaagctatttccgagaaggctaagccaagggacattcctgcttccccaaggaccctttttttttttggggccaaacaaagttccaaaggcgaaaccccaaagggccccttccccgggggccccaaaaaaccccccaaaatcctttcccccaaggggttcccgggggggaaaaaaagggccttttttttttcttttt

SEQ ID NO: 41367 - DNA, 746 bp, Zea mays
  misc_feature: Ceres CLONE 1436632-F
  misc_feature: Encodes the peptide sequence at SEQ ID NO. 41368
  misc_feature (313)..(313): n is a, c, t, g, unknown, or other
  misc_feature (316)..(316): n is a, c, t, g, unknown, or other
ggagctccccgcggtggcggccgctctagaactagtggatcccccgggctgcaggaattcgcacgagaccattacctagaacatcctaatcgaaaaaacacctcacctcctccggcgacgcacgcagcccccggcgtgcgctcgcctatctccaatcatccaccgcgccgccgcagaggcctcgtcctcaccttccccgtaggaagccgaagtacagccagcagcgtcgccatcagcaccgatcatggccgactacgagcaggagcaggatatggaggtggaggcactgcaggccatcctcatggacgacatncangagatcgacccgagtgagagtgggatcgccaccaccgccgggtgcttcagaatctactctctcctcggatgatgattttgatgagtcgcttatgtcccatttcactgggcctgattttttggcaccttggaaaggccccccgatgaccctccccttctaattggaaaaagggtcccagggatttaaccccttgtctttgcctcccctaaaggaaaaattttggcccaaaggcaaaaaaaaaatttggggggggggatgggcccccctcttttttttccccccccaaaaggggggtaaagaaaaaatttggccaaaaagggtgggtgggggacccccaaaaaactctccacaaaaagggggttttttcccccccgggggggggtcttttttaaaaaaatttttctggggggaaaaacattaaaaaaaaaaa

SEQ ID NO: 41368 - protein, 47 aa, Zea mays
  misc_feature: Ceres CLONE 1436632-F
  misc_feature (23)..(23): Xaa is any aa, unknown, or other
  misc_feature (24)..(24): Xaa is any aa, unknown, or other
MADYEQEQDMEVEALQAILMDDXXEIDPSESGIATTAGCFRIYSLLG

SEQ ID NO: 41369 - DNA, 836 bp, Zea mays
  misc_feature: Ceres CLONE 1436659-F
  misc_feature: Encodes the peptide sequence at SEQ ID NO. 41370
  misc_feature (8)..(8): n is a, c, t, g, unknown, or other
  misc_feature (67)..(67): n is a, c, t, g, unknown, or other
  misc_feature (84)..(84): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (289)..(289): n is a, c, t, g, unknown, or other
ggtgggtnttcggggcgtggggcgacgggcggggcagggggaggtcccaacacgggggggccaacgnaagttggggggggggtnttnnntnnntcaaactggaactccccgcggtggcggccggnnnattacttctttatcccccgggctgcaggaattcgcattagaccattacctagaacatcctaatcgaaaaacatattattgagaccaactagcaacatagaaagcacaatagtgtaccaacaatggcagccaaaatattttgcttccttatgctccttggtcnttctgcaagtggtgctaccggaaccatttttccacaatgctcacaaagctctatagcttcccttctttccccatacctctaaccagcggggtcctcagggggggaaaaacccaattggtcaaaccctacagggaccaaacagggaaatccgcaaaaggggatccttaacactttaaaaacccttgtgttcctcccaaaaacacggcgagagccctgataaacaaggaggtttacccctttggggggccatttgggggggggaaaaaaaaaacattgggggggaaaaaaaaaccttaaaaaaagaatttgtggggcgacaaaaaaaaacttgtgggcgggaacaactcccccgaaaaacaacaacagagtttccttccccctttataaaaaaaaaagggggggggggggagaaaaatacggggggcggctatattggggggaacaaactattttccccctcttttcccccccccgcggtgtggtggggggcccaccacccccccgggaaatattttttttctctttacaaaacaaaaagaagagaagg

SEQ ID NO: 41370 - protein, 40 aa, Zea mays
  misc_feature: Ceres CLONE 1436659-F
  misc_feature (14)..(14): Xaa is any aa, unknown, or other
MAAKIFCFLMLLGXSASGATGTIFPQCSQSSIASLLSPYL

SEQ ID NO: 41371 - DNA, 642 bp, Zea mays
  misc_feature: Ceres CLONE 1436665-F
  misc_feature: Encodes the peptide sequence at SEQ ID NO. 41372
tggagctccccgcggtggcggccgctctagaactagtggatcccccgggctgcaggaattcgcacgagaccattacctagaacatcctaatcgaaaaagcaggcgttcggcccggcagcccccaagtcccatcgccgagcagaaagtcaggaacagaactcaggcgttggcgattggcatctccctcccctaagccatggctaccgggcggcccgtacgactcgtgctggatgcctccctcctcctcgacccctcctccaccagggaggcggcggcggtggcgctgcggcccggggtagaggagttgctgcggcggttgcgctactccaacctgagcgtggcaatctgctatgcagagggcatgccaactaatgagtcagactttcttgaaaaggtcgcaagctcacacttgtttggatctatagtacttcttgcaaaaagtgggaatctttctccaattgaattaatgatagaatggagccgaacaagtttttgtttttatgcgacttcaagagttgacaaaggtttaatttctgagctccagaatcagaactggagagttctttctgtagctaatgaatgtagcatagaggttcctggtgttttaaatgttcaaaggcttcaggagttgcttctcacctt

SEQ ID NO: 41372 - protein, 148 aa, Zea mays
  misc_feature: Ceres CLONE 1436665-F
MATGRPVRLVLDASLLLDPSSTREAAAVALRPGVEELLRRLRYSNLSVAICYAEGMPTNESDFLEKVASSHLFGSIVLLAKSGNLSPIELMIEWSRTSFCFYATSRVDKGLISELQNQNWRVLSVANECSIEVPGVLNVQRLQELLLT

SEQ ID NO: 41373 - DNA, 663 bp, Zea mays
  misc_feature: Ceres CLONE 1436668-F
  misc_feature: Encodes the peptide sequence at SEQ ID NO. 41374
  misc_feature (519)..(519): n is a, c, t, g, unknown, or other
tggagctccccgcggtggcggccgctctagaactagtggatcccccgggctgcaggaattcgcacgagaccattacctagaacatcctaatcgaaaagttcttccagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgctttcggcggctggcgctcgacgtcctccccttcntcaaccgcagggggacaaaccggtgcccaaggggaaaaccccctccggggcccttaaaaagggggccccgcctattttcacctgtttttcgggggccccaaaaaggggcccaatttgggggaaaaaaaccccccgccggggggg

SEQ ID NO: 41374 - protein, 142 aa, Zea mays
  misc_feature: Ceres CLONE 1436668-F
  misc_feature (19)..(128): Pfam Name: REF Pfam Description: Rubber elongation factor protein (REF)
  misc_feature (95)..(95): Xaa is any aa, unknown, or other
MAEEQSNPQHQQAEEREVMVEQQQPRRAPKLRYLDFVQVAAAQAAVCLAGLYGLAKDHAGPLRPSVDAVESAVKGVVSPVYDRFRRLALDVLPFXNRRGTNRCPRGKPPPGPLKRGPRLFSPVFRGPQKGAQFGGKKPPAGG

SEQ ID NO: 41375 - DNA, 666 bp, Zea mays
  misc_feature: Ceres CLONE 1436674-F
  misc_feature: Encodes the peptide sequence at SEQ ID NO. 41376
  misc_feature (368)..(368): n is a, c, t, g, unknown, or other
  misc_feature (377)..(377): n is a, c, t, g, unknown, or other
  misc_feature (442)..(442): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (600)..(600): n is a, c, t, g, unknown, or other
  misc_feature (601)..(601): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
aagctggagctccccgcggtggcggccgctctagaactagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcgggggcgccagggccgtctccagggaggctacgtcntcaccgtcnaagggcttcaggagactcgtcccggctaaacgcccgacgcggcaagcgaccatttctcagcatcnaggggagaccgccaaagtccctcgacccttgtaaaaagggccggaaagaggccttccaggggggttggcaccggaattcatcggggtcactaccccctttggggaggcccaggggacccccccccccccggtnnnnnnnnnnnnnnnnnnnngggagnnaaaaaaaaaaaaaaannnnnnncnnnnncgnnnnnnngnnnnnnnnnnnnnnnncgnnnnnnnnc

SEQ ID NO: 41376 - protein, 89 aa, Zea mays
  misc_feature: Ceres CLONE 1436674-F
  misc_feature (79)..(79): Xaa is any aa, unknown, or other
MSTLDTRTLKDELTSMDRKCLVDLGHPLLNRVADSFIRAAGVGGARAVSREATSSPSKGFRRLVPAKRPTRQATISQHXGETAKVPRPL

SEQ ID NO: 41377 - DNA, 640 bp, Zea mays
  misc_feature: Ceres CLONE 1436675-F
  misc_feature (366)..(366): n is a, c, t, g, unknown, or other
  misc_feature (396)..(396): n is a, c, t, g, unknown, or other
  misc_feature (414)..(414): n is a, c, t, g, unknown, or other
  misc_feature (417)..(417): n is a, c, t, g, unknown, or other
  misc_feature (419)..(419): n is a, c, t, g, unknown, or other
  misc_feature (427)..(427): n is a, c, t, g, unknown, or other
  misc_feature (476)..(476): n is a, c, t, g, unknown, or other
ggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgttttctccgcgtcgatcgtcggtctgctggatcgtattcngatgggtgatttgagcgtcttgggtgtcancggcccgccggagggcanccngnttgcggcngcaaatgacctgcatcatctcggccaaaaagaggcttttggggccccancagggttcaggtccgcccttttttcttggacatttcccctgggggggaaacaaattaaaaaaagcgccatcccttgggtccccggggggattttccttcttttggggagaaaccccccaccccttctgtccattccgattgaaaagaaaaagccccgaacttat

SEQ ID NO: 41378 - DNA, 632 bp, Zea mays
  misc_feature: Ceres CLONE 1436683-F
  misc_feature: Translation starting site: 507
aagctggagctccccgcggtggcggccgctctagaactagtggatcccccgggctgcaggaattcgcacgagaccattacctagaacatcctaatcgaaaaaacgtcttgtgctgctttgtcctcgccggattttgtggtggctctggaacctcccctacacagagccgtgtgtcctgctcaggttgatacctccaagaaagttgacccaaaagactcggacttgaacgctgcatcggctctgcatcctggtccatctttcttgaccacggacctgacgagtacgactgaggtcaccttccccagggcctagaatttgaccaacgctagaaatcctatcttctccaagatcaatgatgctcctacaaactcgctggaccattacagtgtcctcctgtcccacttaccactgactctgcgatggacaatcattgacgacgaccacactcttgtcttcattgttgacattcgtgctgacacgaagacatcatagatgctgtctaagaaatgtatgacgtccaaacccttaaagtcgacaccctcgtccgggctgatggaacgagtaaagcttaccttcggcttacacctgaatatgatgctctacatggtgctaactccatcggcatcatctaa

SEQ ID NO: 41379 - DNA, 641 bp, Zea mays
  misc_feature: Ceres CLONE 1436684-F
  misc_feature: Encodes the peptide sequence at SEQ ID NO. 41380
  misc_feature (594)..(594): n is a, c, t, g, unknown, or other
ggagctccccgcggtggcggccgctctagaactagtggatcccccgggctgcaggaattcgcacgagaccattacctagaacatcctaatcgaaaaatccgttctgttgaaaattaaaagacgtgcgtgactcccatctatagagtacagagattcaaaacaatggacttgtactaaaaactagactacctccgcggagagggatagaaagatgcaaaacgaccttctcctgtcctgcatctgcatgcaataagcagccgctttagtgctgccgtgcagagaggtacttccatgctgctcctggccgtgccggccgtgttggccgggttcctcaaggcgttccgcctcgccttcctgctttggccgctcaacctcgcgctcccgctggcgcgcgacctgccgcgggcctgcatcacggtccgggccatcgcgtccttctacgccgccgggctgcggggctacgtcgcccggccccaccgcggcgtgcagctgctgcaggcgcggaaccagctggggcaacagcaacagctggacgcggcggcgccttctcctcttcttccttcttctcagggctcggcggggcgtggacccccnaggatgccgatggcctcccccatggcatggtcgccttcgacaacatt

SEQ ID NO: 41380 - protein, 116 aa, Zea mays
  misc_feature: Ceres CLONE 1436684-F
MLLLAVPAVLAGFLKAFRLAFLLWPLNLALPLARDLPRACITVRAIASFYAAGLRGYVARPHRGVQLLQARNQLGQQQQLDAAAPSPLLPSSQGSAGRGPPRMPMASPMAWSPSTT

SEQ ID NO: 41381 - DNA, 717 bp, Zea mays
  misc_feature: Ceres CLONE 1436686-F
  misc_feature: Translation starting site: 253
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctggggctccccgcggtggcggccgctctagactagtggatcccccgggctgcaggaattcgcacgagaccattacctagaacatcctaatcgaaaaattccattccacacaaggctaggcacaagcgaaccaaacccatggcgtccgacggcagcggcgtggtgacggtgtacggcagcaacggcgcgaagctgctggagccgtccaagcagccccagtcggcgactttctcccgtcaggtggggctgcccagatgctccggggcggggtcatcatggacgtggtgaccccggagcaggcgcggcctcccgaagaagccggccccctgcaccttgaaagcctctggaagggggtcccggacgaaattccgcccgcaagggggggttggggccccaatgtctgaacccgggccctcaaccccggaaaattaagggcgggcccgtccccattcccgggaaatgggcccaagggccccccatttgggccatttccgggggaggcccccaaatcttgggggggccgggggggtgcttaccccattgggaaaaaaaaaccgaggggttttaacccccccccaaaaaagagcgcccaccctaatttaa

SEQ ID NO: 41382 - DNA, 651 bp, Zea mays
  misc_feature: Ceres CLONE 1436695-F
  misc_feature: Encodes the peptide sequence at SEQ ID NO. 41383
  misc_feature (539)..(539): n is a, c, t, g, unknown, or other
aagctggagctccccgcggtggcggccgctctagaactagtggatcccccgggctgcaggaattcgcacgagaccattacctagaacatcctaatcgaaaaacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattcggttggatccagcatatgcaggacgaggatgcaggccggccatacaggaagttcctgtaagcggcgtccagggccgcaggagacgtcgatccctcgaccggggctgcgaggaggggagtttccattcagtttgtgtcggtattgttttagtctgaatctgatggagcagtttggaatgctgaactattgtgcctgatccaaatgaataaggtgtaatgactcgtcttttncattactgaaactgaacatgtttgaatttatctggtcacttgtatggtaaatagcagcgttgtcaatgtcatatactgtttatgacttcattcgagcgccgtggaagaatat

SEQ ID NO: 41383 - protein, 75 aa, Zea mays; identical to SEQ ID NO: 41067
  misc_feature: Ceres CLONE 1436695-F

SEQ ID NO: 41384 - DNA, 651 bp, Zea mays
  misc_feature: Ceres CLONE 1436696-F
  misc_feature: Encodes the peptide sequence at SEQ ID NO. 41385
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaatctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagcttcagatgatgatgcagcttgagcgtgccgctgcccgcagcagcagcctgtacgagccagctctgatgcagcagcagcagcagctgctggcaggccagggtctcaacccatgcccatgatgatggcgcaaaacatgccgggccatggntggactcctacagtaccagcttgccagctac

SEQ ID NO: 41385 - protein, 142 aa, Zea mays
  misc_feature: Ceres CLONE 1436696-F
MKMVIVLVVCLALSAASASAMQMPCPCAGLQGLYGAGAGLTTMMGAGGLYPYAEYLRQPQCSPLAAAPYYAGCGQPSAMFQPLRQQCCQQQMRMMDVQSVAQQLQMMMQLERAAARSSSLYEPALMQQQQQLLAGQGLNPCP

SEQ ID NO: 41386 - DNA, 712 bp, Zea mays
  misc_feature: Ceres CLONE 1436706-F
aagctggagctccccgcggtggcggccgctctagaactagtggatcccccgggctgcaggaattcgcacgagaccattacctagaacatcctaatcgaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacgccgcgtgagtgctctctctccacctccccctctccgtgcgacgactgggtgggctacccgcgctcctacgcaggtgccaatgactcggcgaatttctggaccgaaaaaaccgcccacccaaaagggcccttaaaaggcccccttccccggggatgaaaaatgggggggggccgggaattaaccgggtttttaaaagggggccatgtcccccccaaaaagtggggggggaatttccccacccgcttcctttgaggggcccccgagggaggtgggggtttttgggggggctatttttctttggggaaaaaacccccgttttttttttaaaccccccccggaaaaaaacccccccccggggggtcctctttggggggaggtctccccccccaaaaaaaaaaaacgctttttgtgtgcgcgccccaaagggggggcggggtagaaaaataagaaccccc

SEQ ID NO: 41387 - DNA, 665 bp, Zea mays
  misc_feature: Ceres CLONE 1436709-F
  misc_feature: Encodes the peptide sequence at SEQ ID NO. 41388
  misc_feature (447)..(447): n is a, c, t, g, unknown, or other
  misc_feature (567)..(567): n is a, c, t, g, unknown, or other
  misc_feature (603)..(603): n is a, c, t, g, unknown, or other
  misc_feature (653)..(653): n is a, c, t, g, unknown, or other
ggagctccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgatgatgatggacgtgcantccgtcgcgcagcagctgcagatgatgatgcagcttgagcgtgccgctgcccgcagcagcagcctgtacgagccagctctgatgcagcagcagcagcagctgctggcagcccagggtctncaccccatggccatgatgatggcgcaaaacatgccnggcatgggtggactcttacagtaccagtagcagctgcccagctaccgaancaacccctgtgg

SEQ ID NO: 41388 - protein, 159 aa, Zea mays
  misc_feature: Ceres CLONE 1436709-F
  misc_feature (98)..(98): Xaa is any aa, unknown, or other
MKMVIVLVVCLALSAASASAMQMPCPCAGLQGLYGAGAGLTTMMGAGGLYPYAEYLRQPQCSPLAAAPYYAGCGQTSAMYQPLRQQCCQQQMMMMDVXSVAQQLQMMMQLERAAARSSSLYEPALMQQQQQLLAAQGLHPMAMMMAQNMPGMGGLLQYQ

SEQ ID NO: 41389 - DNA, 941 bp, Zea mays
  misc_feature: Ceres CLONE 1436712
  misc_feature: Encodes the peptide sequence at SEQ ID NO. 41390
agagactcggctacctctcctgcaaaatggctatggcagtggcttccttcgtcgccgcttcgcaccaccacggcagtcacctggccgccggcgtccccttctccgcgcgagtaggcaggagcttaggccgcagtggcgtcaccatctacatgagagcccagaagaagagcaatagtgaatctgggagcagtagcggaggtggggacgtgcgggccagcagcggacggcgagtgtggcgtcgtcggaaactgaccaaagaggatgacatgttgcgttacaagttggatcgtatcccttttctagaggagaaggtgagaaaagtaagggagaatgggaagatcatatgcctggacattaatcagctgatgttatctcaagagaatagatttgcattcaccatggaggtggctgaagaagctaatgtctatcttgagaagaacaggcatgaatatgggctgaagaagcctatactgcatgttctcagtaaccgcatgaatgaagctgggttttctcggcctgagggttacctttatccttatcctatcaagcctggtccttatttcattaaagaggaaggaaattgagtaaaatcacgtgctacttggttttgcgaggatgaaaaatgcaagcaacaggaaaccgatttyggagtcgccgcttcactgtagactggccactagttgtccacagcccgagcgtggctggattctagaaattggaaaccccactaccttgttgtcatgctgtgtgacacacgtagtacaaaggtcgtcttgaacaacatgactgcacatgcagcagagaggatatttcgtgacctgaaaatgtcagcatctgctgttctgtactgtgcctcattggcgttaacagtgcataggtatttgacatgcataaaagaccgggcaagtatttggctttggctgaaaaaaaaaaaaaaaaaa

SEQ ID NO: 41390 - protein, 185 aa, Zea mays
  misc_feature: Ceres CLONE 1436712
MAMAVASFVAASHHHGSHLAAGVPFSARVGRSLGRSGVTIYMRAQKKSNSESGSSSGGGDVRASSGRRVWRRRKLTKEDDMLRYKLDRIPFLEEKVRKVRENGKIICLDINQLMLSQENRFAFTMEVAEEANVYLEKNRHEYGLKKPILHVLSNRMNEAGFSRPEGYLYPYPIKPGPYFIKEEGN

SEQ ID NO: 41391 - DNA, 657 bp, Zea mays
  misc_feature: Ceres CLONE 1436724-F
  misc_feature: Encodes the peptide sequence at SEQ ID NO. 41392
  misc_feature (586)..(586): n is a, c, t, g, unknown, or other
  misc_feature (603)..(603): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacatagaacatcctaatcgaaaaagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgtcctgacaaggcgcgccgcctcggctacaaggccaagcagggttatgttgtttaccgtgtccgtgttaggcgtggtggcaggaagaggcctgtgcctaaaggtattgtctatggcaagccaaagcaccagggtatcacccagctcaagttccagaggaacaagaggtctgttgctgaagagagggctggacgaaagcttggtggactcagggttctcaactcctactgggtgaatgaggatagcaccctacagtactttgagatcatcntgggtgatgtggcccanactaccatcccgcatgatccnaggatccactggctatgccatcctgggcacaag

SEQ ID NO: 41392 - protein, 157 aa, Zea mays
  misc_feature: Ceres CLONE 1436724-F
  misc_feature (2)..(157): Pfam Name: Ribosomal_L15e Pfam Description: Ribosomal L15
  misc_feature (134)..(134): Xaa is any aa, unknown, or other
  misc_feature (139)..(139): Xaa is any aa, unknown, or other
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTLQYFEIIXGDVAXTTIPHDPRIHWLCHPGHK

SEQ ID NO: 41393 - DNA, 620 bp, Zea mays
  misc_feature: Ceres CLONE 1436726-F
  misc_feature: Encodes the peptide sequence at SEQ ID NO. 41394
aaagctggagctccccgcggtggcggccgctctagatctagtggatcccccgggctgcaggaattcgcacgagaccattacctagaacatcctaatcgaaaaatgtttatatacactaaacaagggtcagtactcgaagtcgaagccgcagcagctagctagctagcatggccgggaaagagcttacgctgctggggttatgggcgagcccgttcgtgctccgggcgcgcatcgcgctcagcctcaaaggcctcacctacgcatactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttccccgccgccgcacctaatttccttccatccgacccctacgaccgcgccattgctcgcttctgggcctcctacgtcgacgacaagttctacagcgcgtggatacccgtgttcaggggcaggacggcggaggagatggcggaggcggcgaggcaggccgtcgcggcgctggagacgctggagcaggcgttcagggagtgctccaaggggaaggccttc

SEQ ID NO: 41394 - protein, 151 aa, Zea mays
  misc_feature: Ceres CLONE 1436726-F
  misc_feature (4)..(77): Pfam Name: GST_N Pfam Description: Glutathione S-transferase, N-terminal domain
  misc_feature: SWISSPROT Homolog: EC 4.4.1.5 Lactoylglutathione lyase
MAGKELTLLGLWASPFVLRARIALSLKGLTYAYSEENLDDKSELLLSSNPVLKKVPVLIHHGKPVCESQIIVQYVDEAFPAAAPNFLPSDPYDRAIARFWASYVDDKFYSAWIPVFRGRTAEEMAEAARQAVAALETLEQAFRECSKGKAF

SEQ ID NO: 41395 - DNA, 654 bp, Zea mays
  misc_feature: Ceres CLONE 1436728-F
ccccgcggtggcggccgctctataactagtggatcccccgggctgcaggaattcgcacgagaccattacctagaacatcctaatcgaaaaatcctcattcgctctactcttggtcttgtaactcctgtgctgctcactgccactgacagcaaatatggctactccgactctttacctctctaggtttgttgctccttctgcatgtctgcctccacccacaaatatacctcaatggtcacccgcgcctacctctaccctactctccccctcccctacctctgctaccgatacgctaccctcaaccgagcctctgcagccccataggctactatcgcctccgccatccccacccatgacctttatcaccattctgtcatggatcaacacccatatctttcccgccggccatgcgatcatccaccccgccgcggctgctacggcatatctcgccacctgcgatcaaaaaatcctgtctgtggaaactttctccctactctaaccaacccctgattccctcattaaaccatccgtctacattaacagccgctcctcacttgctttcttcaactattaccaactcgccctctagctactgactactctcactcactacaatcttcttccatttaaccaaatgcccaatgtgagactcaa

SEQ ID NO: 41396 - DNA, 662 bp, Zea mays
  misc_feature: Ceres CLONE 1436734-F
  misc_feature: Encodes the peptide sequence at SEQ ID NO. 41397
aaagctggagctccccgcggtggcggccgctctagaactagtggatcccccgggctgcaggaattcgcacgagaccattacctagaacatcctaatcgaaaaccccccccccccatctctcctcccctccccatctcggtcttgcggagatcgaagagaagctgagggctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcggcgtccttaaaaaggaaaagatcactattgatccagatgacccagcggcagtttctcaatatgctcaagtcatgaagactgtaagggaaaaggcggatcttctttctgattctcaaaggattaaatataccattgagaccttcaccaagggcatccctgatgcacggacttacttgaatactcttcaacagctcagaataaagagtggtcttatagatcatattggaatcgaacctttgatgatggaagctcttgagaagat

SEQ ID NO: 41397 - protein, 152 aa, Zea mays
  misc_feature: Ceres CLONE 1436734-F
MAMAARLVSRSRQLHSVQAAFANGGATQVRSFAKDAAPADRPPVGGDDLLKGIFFEVKKKFETALGVLKKEKITIDPDDPAAVSQYAQVMKTVREKADLLSDSQRIKYTIETFTKGIPDARTYLNTLQQLRIKSGLIDHIGIEPLMMEALEK

SEQ ID NO: 41398 - DNA, 640 bp, Zea mays
  misc_feature: Ceres CLONE 1436746-F
  misc_feature: Encodes the peptide sequence at SEQ ID NO. 41399
  misc_feature (600)..(600): n is a, c, t, g, unknown, or other
tccccgcggtggcggccgctctagaactagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaagtcattggcgtgtgctccttggcagaaatggcgatgatggtggatcccccccatggcatggcaagtcaaggaaagcattactatactatgtggcagacactgtttgagatcgacaccaaagacgtggcgatcagagccagcggaggaagagcttacgggagcggttggtcctctggtaaccgccaggacaggaaaaaagcgcaataaaaagaaagagcacctctttgacaaccggggggaggnctaagggccctaagagagctaagacccctccgccaccaga

SEQ ID NO: 41399 - protein, 59 aa, Zea mays
  misc_feature: Ceres CLONE 1436746-F
  misc_feature: SWISSPROT Homolog: EC 2.7.11.24 Mitogen-activated protein kinase
MAMMVDPPHGMASQGKHYYTMWQTLFEIDTKDVAIRASGGRAYGSGWSSGNRQDRKKAQ

SEQ ID NO: 41400 - DNA, 643 bp, Zea mays
  misc_feature: Ceres CLONE 1436778-F
  misc_feature: Encodes the peptide sequence at SEQ ID NO. 41401
  misc_feature (573)..(573): n is a, c, t, g, unknown, or other
aagctggagctccccgcggtggcggccgctctagaactagtggatcccccgggctgcaggaattcgcacgagaccattacctagaacatcctaatcgaaaaattcatttgttcgccgacccgatgctgctgtgctgccactgccagtgggcacggtcctcggcgcgatcaccggtggcctcatcggcctggccacggagacgggcgtgctgcgcggcacgggcgtcggcggcatcacgggcgcgctggtgtccatggaggtcgtcgagtcgctgtggcgctccgacgagccggcaatctggagcgtcgtctacgtgctcgatgtcatctggagcttgctcaccggccgccttgtgcgcgagaaggtggaccccgccgtgctcagcgccgtcgagagccagatgagcgcagcggacacaccggccttgcatgcagaccacgccgacatcttcgacacgggcggcaccaacggcatggcgagggtcgccatggacgcgctccccgtcgttaggttcaccgagcgcagcaacgtcgacgccagcggcgagctcatcgcctgttcggtttgcctccnagaattccaagccggcgacagcgcgaggagcctgccggtgtgccgccacacgttccacctgccgtgcatc

SEQ ID NO: 41401 - protein, 130 aa, Zea mays
  misc_feature: Ceres CLONE 1436778-F
  misc_feature (107)..(107): Xaa is any aa, unknown, or other
MEVVESLWRSDEPAIWSVVYVLDVIWSLLTGRLVREKVDPAVLSAVESQMSAADTPALHADHADIFDTGGTNGMARVAMDALPVVRFTERSNVDASGELIACSVCLXEFQAGDSARSLPVCRHTFHLPCI

SEQ ID NO: 41402 - DNA, 644 bp, Zea mays
  misc_feature: Ceres CLONE 1436791-F
  misc_feature: Translation starting site: 192
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcgatcgnnntgccctcaggagaggaaggggtcgagctcggtggccatcancaagtacgtcgaggggaagcacggcggcaagctccccacccactcccgcagcagctcaccgtgcagctgaagaagctcgctgccgccggcaagctgacgagggtgaagaactcctttcaggctgcggccaccgacgccaagcccaaagccggccaagccagggcacccaaaggccgcgccaaagcccaagccctccccaaggggaaagcc

SEQ ID NO: 41403 - DNA, 628 bp, Zea mays
  misc_feature: Ceres CLONE 1436796-F
  misc_feature: Encodes the peptide sequence at SEQ ID NO. 41404
  misc_feature (444)..(444): n is a, c, t, g, unknown, or other
  misc_feature (457)..(457): n is a, c, t, g, unknown, or other
aagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcaggncacaacaactacnacaacttgtgctagcaaaccttgctgcctactctcagcaacagcagtttcctccatttcaccaactagctgcattgaactctgctttctatttgcaaacacaacactaccattcagccagctatctgctgcctaccccagaattttctccattcaccaactgacagcatga

SEQ ID NO: 41404 - protein, 153 aa, Zea mays
  misc_feature: Ceres CLONE 1436796-F
  misc_feature (96)..(96): Xaa is any aa, unknown, or other
  misc_feature (100)..(100): Xaa is any aa, unknown, or other
MAAKIFCLLMLLGLSASAATATIFPQCSQAPIASLLPPYLSPTVSSVCENPILQPYRIQQAIAAGILPLSPLFLQQSSALLQQLPLVHLLAQNIRXQQLXQLVLANLAAYSQQQQFPPFHQLAALNSAFYLQTQHYHSASYLLPTPEFSPFTN

SEQ ID NO: 41405 - DNA, 642 bp, Zea mays
  misc_feature: Ceres CLONE 1436801-F
  misc_feature: Encodes the peptide sequence at SEQ ID NO. 41406
aaagctggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtgacggcccgccgggcaggggaggaacaggctgctggtggtggtcggccgctgggacccagagacgtgcg

SEQ ID NO: 41406 - protein, 145 aa, Zea mays
  misc_feature: Ceres CLONE 1436801-F
  misc_feature (3)..(50): Pfam Name: F-box Pfam Description: F-box domain
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPPGPSQSLPLFCQVAAAVTARRAGEEQAAGGGRPLGPRDV

SEQ ID NO: 41407 - DNA, 633 bp, Zea mays
  misc_feature: Ceres CLONE 1436807-F
  misc_feature: Encodes the peptide sequence at SEQ ID NO. 41408
  misc_feature (344)..(344): n is a, c, t, g, unknown, or other
aaagctggagctccccgcggtggcggccgctctagaactagtggatcccccgggctgcaggaattcgcacgagaccattacctagaacatcctaatcgaaaaattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccattgagaatccgcangacattatcgtgcagtctgctaggccctatggccagagggctgtccctcagtttgcgcagtacactggtgccccatgccatgctggcaggcacactcctggtacattcaccaccagttgcaaacctcttcagtgagccacgctttcttatcctgactgacccgaggactgatcatcaccccataaggaagctgcccttgggaacattccaccatcgccttctggaaactgattccccaaggcccaaggtgaaaccgcatccccccataccaggggaaacaaactttggt

SEQ ID NO: 41408 - protein, 121 aa, Zea mays
  misc_feature: Ceres CLONE 1436807-F
  misc_feature (23)..(121): Pfam Name: Ribosomal_S2 Pfam Description: Ribosomal protein S2
  misc_feature (77)..(77): Xaa is any aa, unknown, or other
MAAAPAGGGPRALSQREQDIQMMLAADVHLGTKNCDFQVERYVYKRRTDGIYIINLGKTWDKLQLAARVIVAIENPXDIIVQSARPYGQRAVPQFAQYTGAPCHAGRHTPGTFTTSCKPLQ

SEQ ID NO: 41409 - DNA, 656 bp, Zea mays
  misc_feature: Ceres CLONE 1436809-F
  misc_feature: Encodes the peptide sequence at SEQ ID NO. 41410
aagctggagctccccgcggtggcggccgctctagaactagtggatcccccgggctgcaggaattcgcacgagaccattacctagaacatcctaatcgaaaaacattcctaaagtttgtgtccgcaatgatccaaagtccaccaaaccgagatcatgtggaggatcatcaatcatttgatctggaagattggcttccaataacagcatcaagaaatgcaaattggtactattcagctttccacaacgtaactgcaatggttggtgctggagttcttggccttccctacgccatgtcagagcttggatggggacctggggttgcggtgctgatcctgtcatgggtgatcacgttgtacaccctctggcaaatgattgagatgcacgagatgtttgaagggcaacggtttgataggtaccacgagctgggtcaggcagcctttggaaggaagcttggtttgtatatcatcgtgccgctacagcttcttgttgaaaccagtgcgtgcattatctatatggtgaccggaggtgaatcgttgaaaaaggttcatcaactttctgtgggagatgacaagtgcacaaagctgagaatcgaatacttcattttgatatttgcctcttcacagtttgtgctctcccttctaaagaacttcaactcc

SEQ ID NO: 41410 - protein, 177 aa, Zea mays
  misc_feature: Ceres CLONE 1436809-F
MIQSPPNRDHVEDHQSFDLEDWLPITASRNANWYYSAFHNVTAMVGAGVLGLPYAMSELGWGPGVAVLILSWVITLYTLWQMIEMHEMFEGQRFDRYHELGQAAFGRKLGLYIIVPLQLLVETSACIIYMVTGGESLKKVHQLSVGDDKCTKLRIEYFILIFASSQFVLSLLKNFNS

SEQ ID NO: 41411 - DNA, 661 bp, Zea mays
  misc_feature: Ceres CLONE 1436810-F
  misc_feature: Encodes the peptide sequence at SEQ ID NO. 41412
aagctggagctccccgcggtggcggccgctctagaactagtggatcccccgggctgcaggaattcgcacgagaccatcacctagaacatcctaatcgaaaagttgtgactattgtgtgcgtgagagagaaacagaagaggaaaaggaatccatggcggcgacgctggcgaggagggcggggcgctccgcggcgacgacgctatggggcgcggcgaggggcttcgcatcggtggggtccgacatcgtctctgcggctcccggcgtgtcgctgcataaggcgcggtcctgggacgagggcgtcgccaccaagttctctaccacgcctctcaaggacatcttctacgggaagaaggtggtcatcttcggcttgcccggtgcatatacaggggtttgttcacaagcgcacgttcctagttactagaagaatattgacaagttgaaagcaaaaggaatcgactctgttatctgtgtagctgtgaatgatccgtatgtcctggatgggatggcaaaaaagctagacgctaaagataccaatgaagtctatggggactttgatgggaggttccccaaaagcctgggatttggaaataaaacatttctgctgctttgcttgggcggccttcttcccggtgggcccgccttggttgaccatagaaagaac

SEQ ID NO: 41412 - protein, 89 aa, Zea mays
  misc_feature: Ceres CLONE 1436810-F
  misc_feature: SWISSPROT Homolog: EC 1.11.1.15 Peroxiredoxin
MAATLARRAGRSAATTLWGAARGFASVGSDIVSAAPGVSLHKARSWDEGVATKFSTTPLKDIFYGKKVVIFGLPGAYTGVCSQAHVPSY

SEQ ID NO: 41413 - DNA, 644 bp, Zea mays
  misc_feature: Ceres CLONE 1436817-F
  misc_feature: Encodes the peptide sequence at SEQ ID NO. 41414
ggagctccccgcggtggcggccgctctagaactagtggatcccccgggctgcaggaattcgcacgagaccattacctagaacatcctaatcgaaaaaaccttccggactctcctacatgacactggtatctgggccccatgtgctaactgcctgtaaaccctaatccagaatccctcccggcctcctccgtctcgcgctcgattcgaatccgagctccctatcctgctgctcctgctgttcccgctgcaatggaggacaacgcggtcgaagagcccgagttgagcggtgcggcggagttcgcgccggcgctcgtcaccgcccacccacacggtaactccgtcgacgtcaccatcgggcccgagctccacgtgtttgatctcagggctggtcatccagtttcattgtcagatgattgtggtggccattctcattacgacgcaataagagctatctgcttcagtgtgagtggaactatgtttgcttcagctggtgatgacaaacttgtgaaggtttgcaagactgattcgtggcgttgcatccagactataactacccagaacagggtcagtgctgttgttattagcaacgatgacctgtatgtatctcttgcagataaatttggtgttgctctgttagtcacttt

SEQ ID NO: 41414 - protein, 131 aa, Zea mays
  misc_feature: Ceres CLONE 1436817-F
MEDNAVEEPELSGAAEFAPALVTAHPHGNSVDVTIGPELHVFDLRAGHPVSLSDDCGGHSHYDAIRAICFSVSGTMFASAGDDKLVKVCKTDSWRCIQTITTQNRVSAVVISNDDLYVSLADKFGVALLVT

SEQ ID NO: 41415 - DNA, 648 bp, Zea mays
  misc_feature: Ceres CLONE 1436827-F
  misc_feature: Encodes the peptide sequence at SEQ ID NO. 41416
aagctggagctccccgcggtggcggccgctctagaactagtggatcccccgggctgcaggaattcgcacgagaccattacctagaacatcctaatcgaaaaatctcccataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctaggcgggggtggaaccctgggaccctaaatggaaaaaaagtttgttgatccaaaccctttttccttgggaaaatttattttatacccaaaaaaaaaaaagggggacaagtttttacccgggggccaatcaaaaaacccggggggaaacctggccgtttcactaaaaaaattttt

SEQ ID NO: 41416 - protein, 110 aa, Zea mays
  misc_feature: Ceres CLONE 1436827-F
  misc_feature (1)..(108): Pfam Name: Zein Pfam Description: Zein seed storage protein
MATKILALLALLALLVSATNAFIIPQCSLAPSASIPQFLPPVTSMGFEHPAVQAYRLQLALAASALQQPIAQLQQQSLAHLTLQTIATQQQQQQFLPSLSHLGGGGTLGP

SEQ ID NO: 41417 - DNA, 655 bp, Zea mays
  misc_feature: Ceres CLONE 1436834-F
  misc_feature: Encodes the peptide sequence at SEQ ID NO. 41418
aagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctcacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggc

SEQ ID NO: 41418 - protein, 142 aa, Zea mays
  misc_feature: Ceres CLONE 1436834-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFG

SEQ ID NO: 41419 - DNA, 675 bp, Zea mays
  misc_feature: Ceres CLONE 1436842-F
  misc_feature: Encodes the peptide sequence at SEQ ID NO. 41420
  misc_feature (167)..(167): n is a, c, t, g, unknown, or other
  misc_feature (357)..(357): n is a, c, t, g, unknown, or other
aaagctggagctccccgcggtggcggccgctctagaactagtggatcccccgggctgcaggaattcgcacgagaccattacctagaacatcctaatcgaaaaatctgtacttttgattgatcgtgtctgtctgtgcaggctcaccaagatgggggccctggtgtggngagaaggtggtgcaccgccagccagggctggcgcctcctctccagcatgtggctccacgccggcgtcatccacctggtcgtcaacatgctctgcctcctcttcatcggcatgcgcctcgaacagcagttcggatacgtgaggatcggcgcgatctacgtggtctccggcgtgggacgcgccgtgctgtcntccctggtcgtccagaaccgcgtcaccgtggggggcctccggggcctcttggcctgctgggcggcctggctctcggacttgctccccaattgggaccatttaacccaaaaaggggggggggcgggggccccgccccccttttccggggccccctttaaccttggggcgtcggggttcctgcccccaattaaaaaaaccgggccccaattggggggggtttcccccggggtttttcaaaactcgggtttcccggggccacgggccccccccttttgggtgggggaggaaggttttaaattccccccccgggggccccct

SEQ ID NO: 41420 - protein, 154 aa, Zea mays
  misc_feature: Ceres CLONE 1436842-F
  misc_feature (1)..(138): Pfam Name: Rhomboid Pfam Description: Rhomboid family
  misc_feature: SWISSPROT Homolog: EC 3.4.21.105 Rhomboid protease
MWLHAGVIHLVVNMLCLLFIGMRLEQQFGYVRIGAIYVVSGVGRAVLSSLVVQNRVTVGGLRGLLACWAAWLSDLLPNWDHLTQKGGGAGAPPPFSGAPFNLGASGFLPPIKKTGPQLGGVSPGVFQNSGFPGPRAPPFWVGEEGFKFPPRGPP

SEQ ID NO: 41421 - DNA, 631 bp, Zea mays
  misc_feature: Ceres CLONE 1436845-F
  misc_feature: Encodes the peptide sequence at SEQ ID NO. 41422
  misc_feature (341)..(341): n is a, c, t, g, unknown, or other
  misc_feature (364)..(364): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgcccctcgctctcctggctctcgctgcgagcgccacctccacgcatacaagcggcggctgcggctgccagccaccgccgccggttcatctaccgccgccggtgcatctgccacctccggttcacctgccaccctcggtgcatctcccaccgncgggtcacctggcggcggcggtnccccctggcaccggcggtgcatgtgccggccgccgggtcattcttgcggcgcccaccatggccattaaccctaattaaaccgcccccgggctcagccttcatccccaggcacacccatgccccggtgcaaaaggccccatcccaagccccttgggcaacttgcggggggaaccttgcgggggtttgggaaagccacccccatcccttggggcccagtggcgccccaagttccctagaagcgatctcgtgtccaccccccaccggccc

SEQ ID NO: 41422 - protein, 39 aa, Zea mays
  misc_feature: Ceres CLONE 1436845-F
MPRCKRPHPKPLGQLAGGTLRGFGKATPIPWGPVAPQVP

SEQ ID NO: 41423 - DNA, 854 bp, Zea mays
  misc_feature: Ceres CLONE 1436854-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (420)..(420): n is a, c, t, g, unknown, or other
  misc_feature (421)..(421): n is a, c, t, g, unknown, or other
  misc_feature (427)..(427): n is a, c, t, g, unknown, or other
  misc_feature (428)..(428): n is a, c, t, g, unknown, or other
  misc_feature (449)..(449): n is a, c, t, g, unknown, or other
  misc_feature (451)..(451): n is a, c, t, g, unknown, or other
  misc_feature (489)..(489): n is a, c, t, g, unknown, or other
  misc_feature (512)..(512): n is a, c, t, g, unknown, or other
  misc_feature (516)..(516): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggggctcaccgcggtggcggccgctctagaactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgnnctctanncgcgcgccggtgccggaagcngnttctgctccccggtccgtcgaaggacatctacaaggantaacgggggccggccggtcccgncgtncttccggcccctcaccccagaaagttaaagaattttcacccgccttgggcgattccacaaaaaaggaaaacctttgtgctataatcgggaaccccaaaaaaaaaccgggggggaggggggccctcccccgcgggaaaaagaggggcccccagagaattttcccgagaaccccccgcccccggaaaaaaaattcctcgccgcgcaaccggagaaaaaacacccccgcaaggggggggtcccgtgttttttccccccccccacccacaaaagaggggggggaaaattaccgggcgattttttttaaaatccccccggggggggataccaaaaagaaaaga

SEQ ID NO: 41424 - DNA, 676 bp, Zea mays
  misc_feature: Ceres CLONE 1436871-F
  misc_feature: Encodes the peptide sequence at SEQ ID NO. 41425
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (338)..(338): n is a, c, t, g, unknown, or other
  misc_feature (398)..(398): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (514)..(514): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagnnnattacctagaacatcctaatcgaaaagtaccatgttcaaaacgaaaagtctgatctgaagccagcagacgtgaaaccgacagcacgtacgtacgtacgtgtgagggctgctnnncggccatgggagaatggtgcttcaagaaacgcgcagctctggtgattattgtggccattattagctcgctgcagctgctcctgataactgctcaagaagctggaggagnnnacgaggtgtggtcgtcgtcatcctcgccggccggtgngtcgtggtggcggcgccgtcgtcgtcccgacggcgcggatggggccggacgggtcgtccntcgtgttcgggggaggaggcggnnnntggtgtaccagagcagcgccaaccctctgcccagcggcatcccggcctacaccgtgcagatcatcaacgtctgcggcggagggtgcaccntgtacgacgtgcacgtctcctgcggcgacttcgccnnnncggagctcgtcgacccggccaatttccagcgcgtcgccttcgacgactgcgtcgtcaagggcggcgccgccttggaacccagcgagaccgtctccttccagtactccaactccttctcctacc

SEQ ID NO: 41425 - protein, 160 aa, Zea mays
  misc_feature: Ceres CLONE 1436871-F
  misc_feature: SWISSPROT Homolog: EC 2.1.1.43 Histone-lysine N-methyltransferase
  misc_feature (35)..(35): Xaa is any aa, unknown, or other
  misc_feature (36)..(36): Xaa is any aa, unknown, or other
  misc_feature (48)..(48): Xaa is any aa, unknown, or other
  misc_feature (68)..(68): Xaa is any aa, unknown, or other
  misc_feature (76)..(76): Xaa is any aa, unknown, or other
  misc_feature (77)..(77): Xaa is any aa, unknown, or other
  misc_feature (107)..(107): Xaa is any aa, unknown, or other
  misc_feature (119)..(119): Xaa is any aa, unknown, or other
  misc_feature (120)..(120): Xaa is any aa, unknown, or other
MGEWCFKKRAALVIIVAIISSLQLLLITAQEAGGXXEVWSSSSSPAGXSWWRRRRRPDGADGAGRVVXRVRGRRRXXVYQSSANPLPSGIPAYTVQIINVCGGGCTXYDVHVSCGDFAXXELVDPANFQRVAFDDCVVKGGAALEPSETVSFQYSNSFSY

SEQ ID NO: 41426 - DNA, 640 bp, Zea mays
  misc_feature: Ceres CLONE 1436873-F
  misc_feature: Encodes the peptide sequence at SEQ ID NO. 41427
  misc_feature (100)..(100): n is a, c, t, g, unknown, or other
  misc_feature (101)..(101): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
aaaactggagctccccgcggtggcggccgctctagatctagtggatcccccgggctgcaggaattcgcacgagaccattacctagaacatcctaatcgannaacttctacctggcctcgcaggcttcgcaaggcggccacacgccgatacctcctccttcacccgctccgtcgtcccccccagccggccacgccaccatgctgccaccggccgcgcgccttgcggcccgccgcctnnncggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgactcgccggagaacaagccggacatgaaatgggagttctcacaggcgaatatgaagaaggtcaatgagattctgtctcactatccaagcaaactacagcaatctggtattattccgctgcttgatcttgcacagcagcagcatggtggatgggtgccagttgcagcaatggatgctattgctaaaattgtcgaagttgcacaatcaggggctatgaagttgcacccttctatacaatgtttaacaggactaagttg

SEQ ID NO: 41427 - protein, 77 aa, Zea mays
  misc_feature: Ceres CLONE 1436873-F
  misc_feature: SWISSPROT Homolog: EC 1.6.99.5 NADH dehydrogenase (quinone)
MKWEFSQANMKKVNEILSHYPSKLQQSGIIPLLDLAQQQHGGWVPVAAMDAIAKIVEVAQSGAMKLHPSIQCLTGLS

SEQ ID NO: 41428 - DNA, 682 bp, Zea mays
  misc_feature: Ceres CLONE 1436874-F
  misc_feature: Encodes the peptide sequence at SEQ ID NO. 41429
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaagtcatctctctcctcggacctcgccacctcacgcggaaggaggggaaaaggaagcgcggagactggaaatcgggccccaaatccgcttcggtctctcgatcggcgaggcatgattcatacaaccggctaggatggcctcaaaagctataaaaagaaggcctatcagcgctgagactgatacaacaggggaaaaacaaatggatacagcactgtcagatcctgtaacagaacctcttctaggaaacactcctcaggaagannnntccaagaacatatgagcctattacacggtcaggtttctgggatgggacggcacaggagtgtcttcgttggacacatcttttagcagcttttgttgcnnnatctgcaagaaacatagtaaatgttctttctgaatttggatatttgctagcaagactctttggttgctcttctgcttccaaaagttcannnnatggacagacacttccagttaacctcagtccattacaggaagaaaggttaagattgttgagacaaaggatagatgtgccatatgactgctcctctgnnnnncatcaggatgccctgaaagaacttt

SEQ ID NO: 41429 - protein, 48 aa, Zea mays
  misc_feature: Ceres CLONE 1436874-F
  misc_feature (43)..(43): Xaa is any aa, unknown, or other
  misc_feature (44)..(44): Xaa is any aa, unknown, or other
MASKAIKRRPISAETDTTGEKQMDTALSDPVTEPLLGNTPQEXXSKNI

SEQ ID NO: 41430 - DNA, 632 bp, Zea mays
  misc_feature: Ceres CLONE 1436876-F
  misc_feature: Translation starting site: 153
  misc_feature: SWISSPROT Homolog: EC 3.4.25.1 Proteasome endopeptidase complex
  misc_feature (29)..(29): n is a, c, t, g, unknown, or other
  misc_feature (30)..(30): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (606)..(606): n is a, c, t, g, unknown, or other
  misc_feature (607)..(607): n is a, c, t, g, unknown, or other
  misc_feature (632)..(632): n is a, c, t, g, unknown, or other
gcattttcaaaccatcccccggggtgcanngaataccacaaccaccattacggagaacatcctaatcgaaaaagggtctcaaacgcaaaccccaatctcggcgtcaccgccccaaatctagcaaacggaaatcccatctcgccgccgccgcgatgtctcgccgctatgacagtcgcacgacgatcttctcgccggaggggcgtctctaccaggtggagtacgcgatggaggcgatcggcaacgccgggtcagccctcgggatcctggcggccgacggcgtagtcctggtcggcgagaagaaggggacctccaagctcctccagacnnnccgctccgccgagaagatgtacaagatcgactcccacctggcgtgcgctgtggcagggatcatgtccgacgccaacatcctcatcaacacctgtnnnntctccacgcccagcgctacgcgctctcctaccaggagcccatccccgtcgagcagctcgtccagtccctctgcgacaccaagcagnnnaacacccagtttggtggcctccgcccctttggggtctccttcctattcgccgggtgggacaagcaccacggtttccagctctacatgagggnnttgtatatttactagtatatttatn

SEQ ID NO: 41431 - DNA, 647 bp, Zea mays
  misc_feature: Ceres CLONE 1436881-F
  misc_feature: Encodes the peptide sequence at SEQ ID NO. 41432
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (647)..(647): n is a, c, t, g, unknown, or other
aaagctggagctcaccgcggtggcggccgctctagaactagtggatcccccgggctgcaggaattcgcacgnnnccattacctagaacatcctaatcgaaaaccactgggtcttcagaccattagctttatctactccagagcgcagaagaacccgatcgacaccatgagggtgttgctcgtnnnnctcgctctcctggctctcgctgcgagcgccacctccacgcatacaagcggcggctgcggctgccagccaccgccgccggttcatctaccgccgccggtgcatcnnncacctccggttcacctgccacctccggtgcatctcccaccgccggtccacctgccgccgccggtccacctgccaccgccggtccatgtgccgccgccggttcatctgccgccgnnnncatgccactaccctactcaaccgccccggcctcagcctcatccccagccacacccatgcccgtgccaacagccgcatccaagcccgtgccagctgcagggaacctgcggcgttggcagcnnnccgatcctgggccagtgcgtcgagttcctgaggcatcagtgcagcccgacggcgacgccctactgctcgcctcagtgccagtcgttgcggcagcagtgttgccagcagctcaggcn

SEQ ID NO: 41432 - protein, 160 aa, Zea mays
  misc_feature: Ceres CLONE 1436881-F
  misc_feature (7)..(7): Xaa is any aa, unknown, or other
  misc_feature (42)..(42): Xaa is any aa, unknown, or other
  misc_feature (43)..(43): Xaa is any aa, unknown, or other
  misc_feature (81)..(81): Xaa is any aa, unknown, or other
  misc_feature (82)..(82): Xaa is any aa, unknown, or other
  misc_feature (122)..(122): Xaa is any aa, unknown, or other
MRVLLVXLALLALAASATSTHTSGGCGCQPPPPVHLPPPVHXXPPVHLPPPVHLPPPVHLPPPVHLPPPVHVPPPVHLPPXXCHYPTQPPRPQPHPQPHPCPCQQPHPSPCQLQGTCGVGSXPILGQCVEFLRHQCSPTATPYCSPQCQSLRQQCCQQLR

SEQ ID NO: 41433 - DNA, 593 bp, Zea mays
  misc_feature: Ceres CLONE 1436894-F
  misc_feature: Encodes the peptide sequence at SEQ ID NO. 41434
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (348)..(348): n is a, c, t, g, unknown, or other
  misc_feature (349)..(349): n is a, c, t, g, unknown, or other
  misc_feature (426)..(426): n is a, c, t, g, unknown, or other
  misc_feature (427)..(427): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
nnnnnnnnnnnnnnnnnnnnnnnnnnnnnnnnnnnnnnnnnnnnnnnnnnnnnnnnnncccccccggggnnnnnnnnnnnnnnnnnnnnnnnnnnnnnnnnccaagctggggctccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgccnncgccacctacgggcagcagcagcagcagggaggaggcgggcgcccgatgggtgagcaggtgaagggcatgctccacnncaaggggccgacggcgtcgcaggcgctgacggtggcgacgctgttcccgctgggcgggctgctgctgnnnctggtcgggggctgggcgctgacggccctccgtgggtggggctgggccgtggccaccgcccggtgttccctgaannntcagccccccgtggctggc

SEQ ID NO: 41434 - protein, 95 aa, Zea mays
  misc_feature: Ceres CLONE 1436894-F
  misc_feature (14)..(14): Xaa is any aa, unknown, or other
  misc_feature (40)..(40): Xaa is any aa, unknown, or other
  misc_feature (63)..(63): Xaa is any aa, unknown, or other
  misc_feature (88)..(88): Xaa is any aa, unknown, or other
  misc_feature (89)..(89): Xaa is any aa, unknown, or other
MADRDRSGIYGGAXATYGQQQQQGGGGRPMGEQVKGMLHXKGPTASQALTVATLFPLGGLLLXLVGGWALTALRGWGWAVATARCSLXXQPPVAG

SEQ ID NO: 41435 - DNA, 641 bp, Zea mays
  misc_feature: Ceres CLONE 1436899-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (132)..(132): n is a, c, t, g, unknown, or other
  misc_feature (136)..(136): n is a, c, t, g, unknown, or other
  misc_feature (152)..(152): n is a, c, t, g, unknown, or other
  misc_feature (353)..(353): n is a, c, t, g, unknown, or other
  misc_feature (354)..(354): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctgggacttcacgncggntggcggccgcttctanaactagtggaatcccccgggcttgcaggaattcgcacgaaaccatttacctagaacattcctaatctaaaaatcaccaccactgggtcttcagaaccattagctttatctactccagagcgcagaagaacccgatcgaaccatgagggtgttgctcgttgccctcgctctcctgggctctcgctgcgagcgccaccctccnnccatacaaacgggcggcttgcggcttccaacccaccgcccgcccgttcattctaccgcccgcccggtgcattcttgccccnnnctccggttttacccttgccccaccctccccgggggaatttttccccaaacggcccgggtccacccttggccccccccccgggcnnnaccttcccccccccccggttcccttttgcccccccccccccgtttttattttggccccccccccccccattgggccccttacccctaaccccnnnccccccccggggcttttaatccc

SEQ ID NO: 41436 - DNA, 648 bp, Zea mays
  misc_feature: Ceres CLONE 1436905-F
  misc_feature: Encodes the peptide sequence at SEQ ID NO. 41437
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
tggagctccccgcggtggcggccgctctagaactagtggatcccccgggctgcaggaattcgcacgnnnccattacctagaacatcctaatcgaaaaaatgtcgcgtgcggccactagatttttcctgacgcggtgtctgctcccacttcccctcctctcccccaggtggcggcagcgnnngcggggtagcatttgtgctacgagggcttttgcaatggcggcttcggggttcggcggcggcgaggcgttccggctctcggccgcgccgggggccggcttactgnnnctgcacaagggcgacatcaccctctggtccgtcgactgcgccaccgacgccatcgttaatgctgctaatgagcgaatgttaggtggcggaggtgttgatggagctatacatcaagnnnctggaccagagctagtgcaagcatgccggaaagttccagaggtcaaaccaggagtccgttgtcctactggagaagctaggattactcctgcttttgagcttcctgcctctcgggtgattccnnntgttggccctatatatgatttggacaagcatccctgaggtgtcattaaagaaggcctatgaaaatagcttgaagcttgctaaggataatggcattcagtacatcgcattccctgctata

SEQ ID NO: 41437 - protein, 116 aa, Zea mays
  misc_feature: Ceres CLONE 1436905-F
  misc_feature: SWISSPROT Homolog: EC 2.4.2.30 NAD(+) ADP-ribosyltransferase
  misc_feature (24)..(24): Xaa is any aa, unknown, or other
  misc_feature (63)..(63): Xaa is any aa, unknown, or other
  misc_feature (64)..(64): Xaa is any aa, unknown, or other
  misc_feature (105)..(105): Xaa is any aa, unknown, or other
MAASGFGGGEAFRLSAAPGAGLLXLHKGDITLWSVDCATDAIVNAANERMLGGGGVDGAIHQXXGPELVQACRKVPEVKPGVRCPTGEARITPAFELPASRVIPXVGPIYDLDKHP

SEQ ID NO: 41438 - DNA, 569 bp, Zea mays
  misc_feature: Ceres CLONE 1436907-F
  misc_feature (252)..(252): n is a, c, t, g, unknown, or other
tggagtccccgcggtggcggccgctctgaactagtggatcccccgggctgcagattccacgagaccattacctagaacatcataatcgaaaactgcgctccgaataccccagacccccgatcctcccaatggccaccgcattttcgctgcgcgctgcggccccggccaccgctccccgcgccgtctccgatccacctccgcggcagggcgtgccctggctcggactggcggaccggaagctgtgggcgtgcncagtacagcaagcggatgtacatcgagcacgtcgacgccatgagtctgctgtttgagctcttcgtgagccctgatgaaaagatggattaatccaacgggggggggatttgggaaaaattttggcctttacggggggtcctaaaaggggaaaaaaggggttgggcgaaaccttttggaaaaactttcaaatttctggaacccccttttggggaaaaactcctttacgggcttggaaatttgaaccgggaaaaaaaagggcttaggcccccccctttaaagggaaaaaagggggatccccccccctttttaaaaacaaa

SEQ ID NO: 41439 - DNA, 659 bp, Zea mays
  misc_feature: Ceres CLONE 1436919-F
  misc_feature: Encodes the peptide sequence at SEQ ID NO. 41440
  misc_feature (443)..(443): n is a, c, t, g, unknown, or other
  misc_feature (508)..(508): n is a, c, t, g, unknown, or other
  misc_feature (602)..(602): n is a, c, t, g, unknown, or other
aagctggagctccccgcggtggcggccgctctagaactagtggatcccccgggctgcaggaattcgcacgagaccattacctagaacatcctaatcgaaaaacgccgttttccccatctcgcgcagcgctactgccggctgtcccgagtaccgaccaccgtcctccgctccccgccgtgaatccttcctcctcccgcgatggagaccttcccgtcggtgaagaacatcctcctactggactccgaggggaagcgcgtcgccgtgaagtactacagcgatggctggcctactctctccgcgaagctggccttcgagaagtcggtcttcgccaaaacccagaaagcgaatgctggaacggatgcagagattgtaatgtttgatggtcaaattgtggtatacaagtttattcaagacctgcacttttttgttactggaggagaagnagagaatgagcttattttagcatcagttcttcagggattctctgatgctgtggaacgacttctcnagaacatggttgacaaaaggacagcactcgagaatttggacctgatcctattgtgtcttgatgaaatgttgatggagggatggtacttgaaacnaaaggagagagatagctgaaaagtgtctggtcacggatcggaggggcttcatcggct

SEQ ID NO: 41440 - protein, 140 aa, Zea mays
  misc_feature: Ceres CLONE 1436919-F
  misc_feature (6)..(140): Pfam Name: Clat_adaptor_s Pfam Description: Clathrin adaptor complex small chain
  misc_feature (82)..(82): Xaa is any aa, unknown, or other
  misc_feature (104)..(104): Xaa is any aa, unknown, or other
  misc_feature (135)..(135): Xaa is any aa, unknown, or other
METFPSVKNILLLDSEGKRVAVKYYSDGWPTLSAKLAFEKSVFAKTQKANAGTDAEIVMFDGQIVVYKFIQDLHFFVTGGEXENELILASVLQGFSDAVERLLXNMVDKRTALENLDLILLCLDEMLMEGWYLKXKERDS

SEQ ID NO: 41441 - DNA, 653 bp, Zea mays
  misc_feature: Ceres CLONE 1436933-F
  misc_feature: Encodes the peptide sequence at SEQ ID NO. 41442
ggagctccccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgcccgcgactcctacggcatcgccgtcgactacgggcgcgcgctcgcgctccc

SEQ ID NO: 41442 - protein, 123 aa, Zea mays
  misc_feature: Ceres CLONE 1436933-F
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGARDSYGIAVDYGRALAL

SEQ ID NO: 41443 - DNA, 687 bp, Zea mays
  misc_feature: Ceres CLONE 1436934-F
  misc_feature: Encodes the peptide sequence at SEQ ID NO. 41444
  misc_feature (623)..(623): n is a, c, t, g, unknown, or other
aaagctggagctccccgcggtggcgtccgctctagtctagtggatcccccgggctgcaggaattcgcacgagaccattacctagaacatcctcatcaaaaaagtgctcgtgtccggatgcgccagcgccgcctggtcaacagatttttgccctgcgctgtcactccaccacgctgcttgtactgaaagctttttcccagaataaaggctggggaggaggaagcggcggctacggcgctctcagaagagagggtgagatgaagactcggagttcagcgagaggggagccgaggcgtctcggaaatgcggctcttctggcgctcatgctctgctccgtcgtcgcgctctccctcatccgggggaaattcaccccaattgtcactaccgcaggagatgccatcaaatccgaggacgacgctcccccggctgcgctcagggtcagcaaggcggccgtcaacgttgacaccggcgacagcgccaacgaggccgccgcctaagctgctgctgaggagaaagagaaggaggaagtccagccgaagcccgctgacggttccggctccggctccggcggcagcgcaaccaagccggtgtgctacgagacgagccgccgctccgacacctgcnaggcggctggcgacgtgcgcgtcatgaggagcacccagacagtgtacgtggactccctggaccg

SEQ ID NO: 41444 - protein, 79 aa, Zea mays
  misc_feature: Ceres CLONE 1436934-F
MKTRSSARGEPRRLGNAALLALMLCSVVALSLIRGKFTPIVTTAGDAIKSEDDAPPAALRVSKAAVNVDTGDSANEAAA

SEQ ID NO: 41445 - DNA, 669 bp, Zea mays
  misc_feature: Ceres CLONE 1436940-F
  misc_feature: Encodes the peptide sequence at SEQ ID NO. 41446
atagctggagctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctccagttgttgttgttacaggtgcctctagagggattggaaaggcaactgctctagcccttggaaaagcaggatgcaaggttctggtaaattatgctcggtcttcgaaagaagctgaagaggtctccaaagagattgaagcatctggtggtgaggctatcacctttggaagagatgtttcaaaagaagctgatgtagagtctatgatgaaagcagctctagataaatggg

SEQ ID NO: 41446 - protein, 148 aa, Zea mays
  misc_feature: Ceres CLONE 1436940-F
  misc_feature: SWISSPROT Homolog: EC 1.1.1.100 3-oxoacyl-[acyl-carrier-protein] reductase
MAAAAAAAAAVSSPIAPRAVAAAASRRGFVTFGGGAARSSPTLRSGRGFSGVQTHVAAVEQAVVKDATKLEAPVVVVTGASRGIGKATALALGKAGCKVLVNYARSSKEAEEVSKEIEASGGEAITFGRDVSKEADVESMMKAALDKW

SEQ ID NO: 41447 - DNA, 662 bp, Zea mays
  misc_feature: Ceres CLONE 1436941-F
  misc_feature: Pfam Name: CutA1 Pfam Description: CutA1 divalent ion tolerance protein
aagctggagctccccgcggtggcggccgctctagaactagtggatcccccgggctgcaggaattcgcacgagaccattacctagaacatcctaatcgaaaaactccccgcaccattccgagttttctccccaccctcctccgtggctgccagtcccgcgggagcgcagcgcgcgctgctctacggtcgccgcgcgccgttcgcgggagcgctcctgtttttcagcatcggcgccgtcagcgctgcggtcgcgttcaggacagggtgcgccatctcacacagacgtccccccttcctcggggcaagaggtctcagttccactagaatggagtcagcttcgaccacgtgcatccattgtcgtgtatgtgacagttccaaatagggaagcagggaaaaagctgtcacatagtatcccccccgtggagcttgctgcctgggccaatatacacctggcattgaatccgtgtatgggtgggagggaaaagggacaatccggaggctgaagaatttctcctcctccaaaaccaggggaaacccttttgggaatgccttgaactgggcccttttcaaaagcccaatcccctggaaaaaagaaggtacccctgagaatttatatgggccctgccccacaaacgtgggggggaaaccccccccagtgatttc

SEQ ID NO: 41448 - DNA, 678 bp, Zea mays
  misc_feature: Ceres CLONE 1436944-F
  misc_feature: Encodes the peptide sequence at SEQ ID NO. 41449
aagctggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcacgctgttcgtggcggtgtctgtgggcgcgaacatctccggcaggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcctgtccgtgtgggacgcgctggtgctggagatcgcgatgacgtgccgggctggggacacggagtacccccc

SEQ ID NO: 41449 - protein, 160 aa, Zea mays
  misc_feature: Ceres CLONE 1436944-F
  misc_feature (13)..(159): Pfam Name: MIP Pfam Description: Major intrinsic protein
MPINRIALGSHQEVYHPGALKAAFAEFISTLIFVFAGQGSGMAFSKLTGGGPTTPAGLIAAAVAHAFTLFVAVSVGANISGRHVNPAVTFGAFVGGNITLFRGLLYWVAQLLGSTVACFLLRFSTGGQATGTFGLTGLSVWDALVLEIAMTCRAGDTEYP

SEQ ID NO: 41450 - DNA, 683 bp, Zea mays
  misc_feature: Ceres CLONE 1436947-F
  misc_feature: Encodes the peptide sequence at SEQ ID NO. 41451
  misc_feature (570)..(570): n is a, c, t, g, unknown, or other
ggagctccccgcggtggcggccgctctagaactagtggatcccccgggctgcaggaattcgcacgagaccattacctagaacatcctaatcgaaaaagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagtgcatgaacggcaaggagctggacggccgcaacatcaccgtcaacgaggcccagtcccgcggcggccgtggaggcggcggcggtgggtacggtggtggccgtggaggcggcggctacggcggtgggcggcgccgtgatgggcgtggcggctacggcggtggcggcggctacggtggcggcggcngctacggtggtggtggcggcggctacggcggtggcaaccgtgggcgcggctacggcaactcccgacgggaactggaggaactgagccgggggggcccgcgcggcccaagtatc

SEQ ID NO: 41451 - protein, 166 aa, Zea mays
  misc_feature: Ceres CLONE 1436947-F
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature (129)..(129): Xaa is any aa, unknown, or other
MAASDVEYRCFVGGLAWATDDHSLHNAFSTYGEVLESKIILDRETQRSRGFGFVTFSTEEAMRNAIECMNGKELDGRNITVNEAQSRGGRGGGGGGYGGGRGGGGYGGGRRRDGRGGYGGGGGYGGGGXYGGGGGGYGGGNRGRGYGNSRRELEELSRGGPRGPSI

SEQ ID NO: 41452 - DNA, 683 bp, Zea mays
  misc_feature: Ceres CLONE 1436950-F
  misc_feature: Encodes the peptide sequence at SEQ ID NO. 41453
  misc_feature (472)..(472): n is a, c, t, g, unknown, or other
  misc_feature (480)..(480): n is a, c, t, g, unknown, or other
  misc_feature (481)..(481): n is a, c, t, g, unknown, or other
  misc_feature (513)..(513): n is a, c, t, g, unknown, or other
  misc_feature (519)..(519): n is a, c, t, g, unknown, or other
  misc_feature (564)..(564): n is a, c, t, g, unknown, or other
  misc_feature (567)..(567): n is a, c, t, g, unknown, or other
  misc_feature (570)..(570): n is a, c, t, g, unknown, or other
  misc_feature (576)..(576): n is a, c, t, g, unknown, or other
aagctggagctccccgcggtggcggccgctctagaactagtggatcccccgggctgcaggaattcgcacgagaccattacctagaacatcctaatcaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtccccgcgcggccgtgnaagcggcnngcggtggtacggtggtggcctgtgaagcggcngctacngcggtggcgggcgccctgatggcggcggcggctacggcggtggcngcngcngctacngtggcggcgggcgctacggtggtgggtgccgcggctacggcggtggcaaccggggggggggctacgggaactccgacgggaactgaaggaactgagcggtgggggcc

SEQ ID NO: 41453 - protein, 101 aa, Zea mays
  misc_feature: Ceres CLONE 1436950-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (91)..(91): Xaa is any aa, unknown, or other
  misc_feature (94)..(94): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSPRGRXSGXRWYGGGL

SEQ ID NO: 41454 - DNA, 679 bp, Zea mays
  misc_feature: Ceres CLONE 1436952-F
  misc_feature: Translation starting site: 164
  misc_feature (679)..(679): n is a, c, t, g, unknown, or other
ggctgcaggaattcgcacgagaccattacctagaacatcctaatcgaaaaaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcaaggcgtgccggacggcggtcggcagcatcggccgccgctccgcccgcatcgcctactgcggcctcttcgcgctctccctcttcgcatcctgggcgctccgcgaggacgccgcgcccctcctccagtcgatcccatggattaaccacttccacaagacccccgaccgcaagtggttcgagaccgacgcggtgctcagaggtcagcctcggcaacttcctcttcttcaccatcctcgccgtcatcatggccgggataaaggaccagaaggacccccgtgacaagatccaccacggcggatggatggccaagatcttctgctgggtcatcatcgtcttcctcatgttcttcgtgcccaacggggtcgacagcttcgatgaatctatatccaagtttggctctgggctgtctcttctcgtacaggttgctctgctgatggatattgtgcacggatggactgagaactgggn

SEQ ID NO: 41455 - DNA, 777 bp, Zea mays
  misc_feature: Ceres CLONE 1436954-F
  misc_feature: Encodes the peptide sequence at SEQ ID NO. 41456
tttctttctccacattcctacatttattggtgttgttagtcgcgccgctttataaacatctctccccagaggggtgggcgctctatactagtggatcccccgggctgcaggaattcgcacgagaccattacctagaacatcctaatcgaaaaataaacgaccacgcgcccacggtgaactgcttgtctagggttcagggataaaagacccgctcctgtcccgcaggcaactgagcgccggcccgcccgcccgcccaccagccgccgcctcaccgccacctatcgacctcccttcttctgctcaaaccgctctggccgcttaactataaggaggacgctattcactagcacctgcacgaactcatccgcggatacgccgcgctcgtccgcgtgctcccctccatgaaggccttccactggggaactgatgtgagcatagaaaacatgcatcaagggttcacgcacgtcttcgagtccacgtttgaaagcacggaaggaatcaaggagtacattgagcaccctgcacacgtcgaattcgcaagtgtgttcttgcctgtgctggagaaggtcctcataatcgactacaaaccgacgtcggccaattagtggtagaacatgctctgtacttgttcctcggaggatccagtttggttctactctttattttgctaaataaactcggtctgctttgtcccttgttaagaatgagctttgagttttctgtagtgcaattgttgtagcttcgcatgttttcatatgggaattacgttcctaaaat

SEQ ID NO: 41456 - protein, 67 aa, Zea mays
  misc_feature: Ceres CLONE 1436954-F
  misc_feature: The sequence is a functional homolog of SEQ ID NO 2 in US patent 7253341
MKAFHWGTDVSIENMHQGFTHVFESTFESTEGIKEYIEHPAHVEFASVFLPVLEKVLIIDYKPTSAN

SEQ ID NO: 41457 - DNA, 812 bp, Zea mays
  misc_feature: Ceres CLONE 1436954-R
  misc_feature: SWISSPROT Homolog: EC 5.2.1.8 Peptidylprolyl isomerase
  misc_feature (1)..(1): n is a, c, t, g, unknown, or other
  misc_feature (2)..(2): n is a, c, t, g, unknown, or other
nnggacaattggtgtacgggccccccctcgaggtcgacggtatcgataagcttttttttttttttttttcgttctcactactaagagctgaacagccatcaggagtgaaaagatgtttcccgtgatatagatcaactgttgttcacaacgttcctttggtacagcaatctaaccagtctctgtaacactttaaacatgatggaaaatcgatcgaaaacggcggccctttttgccgacgaactcgcaaaaacacaagtcaaattacatccgagtatgtatcaaagctcgctgtcgttgctctccgtggtggcgccagcagatgtcttcccattcacagcaatgagctccgtgtcgaaaaccagagttgcaccacctggaatctttggtggggagcctcgctccccgtaacccatctttgcggggtattctcagcttccgcttttcgccgacgcacatacctagtaaaccttgggcccaacccttttatcacctgcccattcccaagagtgaattcgaagggatcacctctgtcatagctagagtcaaatactgatccatcagtgaatggtccccgaaaaagcactttaatcttgtcccctttgtgagcccggtagggtacatgaattcagggttggtacttggacgcccaatctgggaaccttgtgtaacaatcccgcgggaactttctttgggcccaaaaaccatttcaaaaaaaggaacggcccgcccaaacgggggaaaggggaaaaacaacaggggagaagaggcaaaaaaaaaaaacccccgggggctttttttttttcgtggccccc

SEQ ID NO: 41458 - DNA, 726 bp, Zea mays
  misc_feature: Ceres CLONE 1436960-F
  misc_feature: Encodes the peptide sequence at SEQ ID NO. 41459
  misc_feature (376)..(376): n is a, c, t, g, unknown, or other
  misc_feature (396)..(396): n is a, c, t, g, unknown, or other
tccccgcggtggcggccgctctagaactagtggatcccccgggctgcaggaattcgcacgagaccattacctagaacatcctaatcgaaaaatacaaagtcgcggtcgtcaacaggaagaggccgtccatcctcgctctctccaggcaaaagctccctcacctgcctggcacctcgatcgagggcgtggagaagggcgggtacaccatctccgacaactcgactggcaacaagcctgacctcattgtgatgggcaccggctccgagctggagatcgcggccaaggccgccgacgagctgaggaaggagggcaagacggtccgcgtcgtctcgttcgtctcctgggaactctttgatgagcagtcggatgagtacanggagagcgtcctccctgctngcgtcacagcgaggatcagcatggaggctgggtccactcttggctggcaaagtacgtcggaccccagggcaaggccatttggcatcaacaaggttccggccggagtgctcttggccgggaccgattaacaaggagtacgggcctccccggggaaaagcatcattggcgcctgccaagagcttttaaaaactaaaccacggcccggagttttttttccttgccccccttaaagccccaaaggaacatgttcccctggggaaactcccttgttcccggaatttggaaaaaagaaaatagggggggggcgcaaaatttccccttccttttttt

SEQ ID NO: 41459 - protein, 91 aa, Zea mays
  misc_feature: Ceres CLONE 1436960-F
  misc_feature: SWISSPROT Homolog: EC 2.2.1.1 Transketolase
  misc_feature (43)..(43): Xaa is any aa, unknown, or other
  misc_feature (50)..(50): Xaa is any aa, unknown, or other
MGTGSELEIAAKAADELRKEGKTVRVVSFVSWELFDEQSDEYXESVLPAXVTARISMEAGSTLGWQSTSDPRARPFGINKVPAGVLLAGTD

SEQ ID NO: 41460 - DNA, 682 bp, Zea mays
  misc_feature: Ceres CLONE 1436963-F
  misc_feature: Encodes the peptide sequence at SEQ ID NO. 41461
ggagctccccgcggtggcggccgctctagaactagtggatcccccgggctgcaggaattcgcacgagaccattacctagaacatcctaatcgaaaaatttcgagtggtcgagtccgtccgtgtctgtcctccgctgtccgctggctgctgctctaacccaatccaaggaggatgccgaggagcccgcagctgagcctgagcggctgcagctctctcttctccctgtccagcaccagtacgagccgcgacagcgccgccctgaaggcgccggtgccagcgccaccggcaggcgcggtgcccccacggcgcacccctctcctgtcgctcagcgtcggcgaggaggaagaggacgagggtgaggacgaggaggagtacctgctgggggccggcgccctggatctgcagctgacggggcccggtggcggcagcaacagcagcggcggctacgacgacgagcggaagaacatccggatgatgaggaacagggagtctgcgctgcgctccagggcaaggaagagggcctatgtgcaggagctggagaaggaggttcgtcgcctggtgaatgagaacctcaagctcaagaggcagtgcaaacaactgaaactagatatggctgcactggtccagcaaagcagcagcaagagcagctcccacatcagaagaacctcctcatccactcagc

SEQ ID NO: 41461 - protein, 170 aa, Zea mays
  misc_feature: Ceres CLONE 1436963-F
  misc_feature (92)..(155): Pfam Name: bZIP_1 Pfam Description: bZIP transcription factor
MPRSPQLSLSGCSSLFSLSSTSTSRDSAALKAPVPAPPAGAVPPRRTPLLSLSVGEEEEDEGEDEEEYLLGAGALDLQLTGPGGGSNSSGGYDDERKNIRMMRNRESALRSRARKRAYVQELEKEVRRLVNENLKLKRQCKQLKLDMAALVQQSSSKSSSHIRRTSSSTQ

SEQ ID NO: 41462 - DNA, 823 bp, Zea mays
  misc_feature: Ceres CLONE 1436969-F
  misc_feature: Encodes the peptide sequence at SEQ ID NO. 41463
actaccgcctctctctccccgcacctccccttcctgaccccccttctcataactggtgttcctcgcggtggcggacgatctacaactagtggatcccccgggctgcaggaattcgcacgagaccattacctagaacaccctaatcgaaaaaagatagagagatacccgatggtcatcgtgtaccggactcccctcaaaggcggccccagcacctcgagcatgggagaccggcatcggcatgggcctggcagcggggtggaggacccggccaagctgctgcggcgggtgcagatcctcgcgcccaactcgacgcaggtggtggggttcctgacgctgctcgtctctagagcctcgctgatgttgttgaccgggccgacgctcaccggcgtcatgcttgtgctccatttctccggctagatccccctcatcatacccctatctgggtctctgtcgatttccccctcttttctttctcccccgcggttgtctcctactgggtaggaaggacaatacccctacctacaaggccacgcgaccctttagggaccccgatcggatcgcaatataccccatccgccggataggacgacaagcccgaggcctctatcaaggacgtacctttacgcgcattatcggccgagtatctagtggcaatcgccgcccagacactaccgcgccctgatttcgcaaggcgcggtaacccccccagtcccgcctggtgccgtgaacccccacccctccatcatgtgccgccgaagtttttacagcaagcgcgtctctcggaatcctcgctcgacggccccataaccttacccaattgccg

SEQ ID NO: 41463 - protein, 65 aa, Zea mays
  misc_feature: Ceres CLONE 1436969-F
MGDRHRHGPGSGVEDPAKLLRRVQILAPNSTQVVGFLTLLVSRASLMLLTGPTLTGVMLVLHFSG

SEQ ID NO: 41464 - DNA, 686 bp, Zea mays
  misc_feature: Ceres CLONE 1436987-F
  misc_feature: Translation starting site: 296
aaagctggagctccccgcggtggcggccgctctagaactagtggatcccccgggctgcaggaattcgcacgagaccattacctagaacatcctaatagaaaactccccagcccccgccccggtcgcggagccgtcgttctcgtctttcggtactcgcgcgcgccagctcacttctctacttcccttccccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgagtgagttctgatttaccgagtcgtcattcctgttgctggttgaagttgttggatttgatgtggtgccccgcgtgtgttgcagcaattggattcaacgttgagacggtgcagtacaacaacatcaagttccaagtatgggatcttggtggtcaaacaagcatcaggtaccggctctttatcatgatagtaaattcctgactgtcatttctgaagtaaataatactattgcatttatttaatcaccgatga

SEQ ID NO: 41465 - DNA, 709 bp, Zea mays
  misc_feature: Ceres CLONE 1436994-F
  misc_feature: Encodes the peptide sequence at SEQ ID NO. 41466
  misc_feature (252)..(252): n is a, c, t, g, unknown, or other
cgcggtggcggccgctctagaactagtggatcccccgggctgcaggaattcgcacgagaccattacctagaacatcctaatcgaaaaccccactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggnccgcgcgctcgtggcgtccgccgcagccgcggatgcccccgccccggctcccgggtcggacgccgcgtccgccgtaaccctggccggggcttccctggccgccggcggcttggggtaccttctttggtaaatcccccttgaaacggggtcccggccccaaatagaattcccggggcctgggcccgggaacccaccccggggggccggggtgtctctttgaaaggcccccgggctttgttttttttttggacccccccccccccccaaaaaaaaaggtccccctggggggtaaacctttccccccccctgttgttgggcggagaatatataccccggggggtttttggtttaaaaagaaaatttttttttttccaaaaaaaaaaaaaaaaaatttttttttccccccccccggggggggggcggccccccccccccccccgggggggggggttaggcg

SEQ ID NO: 41466 - protein, 57 aa, Zea mays
  misc_feature: Ceres CLONE 1436994-F
  misc_feature (15)..(15): Xaa is any aa, unknown, or other
MAGLRMKFVAVAAMXRALVASAAAADAPAPAPGSDAASAVTLAGASLAAGGLGYLLW

SEQ ID NO: 41467 - DNA, 832 bp, Zea mays
  misc_feature: Ceres CLONE 1437002-F
  misc_feature (14)..(14): n is a, c, t, g, unknown, or other
  misc_feature (483)..(483): n is a, c, t, g, unknown, or other
  misc_feature (489)..(489): n is a, c, t, g, unknown, or other
  misc_feature (496)..(496): n is a, c, t, g, unknown, or other
  misc_feature (498)..(498): n is a, c, t, g, unknown, or other
  misc_feature (591)..(591): n is a, c, t, g, unknown, or other
  misc_feature (592)..(592): n is a, c, t, g, unknown, or other
  misc_feature (600)..(600): n is a, c, t, g, unknown, or other
  misc_feature (602)..(602): n is a, c, t, g, unknown, or other
  misc_feature (616)..(616): n is a, c, t, g, unknown, or other
  misc_feature (739)..(739): n is a, c, t, g, unknown, or other
gggtgccccgcggncgcgtggggcgggtgggactggagggggggtccaccgcgaatattgtgacacccgcctgtggcggccgctctagaactagtggatcccccgggctgcaggaattcgcacgagaccattacctagaacatcctaatcgaaaaaaaaagacctgcaattccccaccccaaatacctaccctgaccaaagttgggcggttcctcctctgctgccagctcacggtgatccacccccccgagatctgctgggtgccagctccaaggacgaagaggcccggaatgtccttggaagccacgatctagaagaacaagaagattagcctggtctggggaggagcccaaagcacccgcatgacggatctcccctgtcaccatcctcttgtgacatggtgttgacgacgagttgtgttgatagttgggaagaactggattggtgggataacgaccgtcatgggtgtgtgagccacccaancccccnccgagananacggtgatggtaaaaccgggtagaggaggagccggggcgacgtggggcccaaaaaacaactccgaagacgttgcatacttgaccttggaagtnnggggaccncnaagcttccagggtntaagacaactgtcaaccaagtttctatcaatgtccacgcagtcattacatactgaggggaacctagaacgttttacaatacacgcccacagaaaaaaaggatagcagaaagtgggcccccacncgaaacctaaagcaaagccaccgcaagcctgtcgtaacggttggccccagatatgagggtgaaacctctcgcattaggagcggaggaggtggg

SEQ ID NO: 41468 - DNA, 694 bp, Zea mays
  misc_feature: Ceres CLONE 1437009-F
  misc_feature: Encodes the peptide sequence at SEQ ID NO. 41469
  misc_feature (472)..(472): n is a, c, t, g, unknown, or other
  misc_feature (507)..(507): n is a, c, t, g, unknown, or other
tctgaactagtggatcccccgggctgcaggaattcgcacgagaccattacctagaacatcctaatcgaaaattttcttctgcagtttctcaagtcgagaagctagtgggggacgacgccaccgagagggaacgcgacacgagatcgccatcgccatggggggaggagtcatgcgcaccgccgcgaaggtcagcatcgccgggggcgcggcggcggcgaaaagcggccggttccgcaacgccgctccggtcttcgccacggcccccgccgccgcgggttccgaagcggcgccgcttgtctccgtctcgagtggtgaggtgccccccgccgcggcgcattgggcggcgtcctgggagctggacgactgggagtttgcggactggagggacgacgcctcggcgtcggcggcggtagtggagagggaggcaacggcggccgccgccaagcccaggctggtcttcgcgccgccgtcnagggaggaggccgaggaggccacgaccgagctcanggacgccgtaaagagggcttatttcaacgagtccccagttgaggttgttaaggaacaagataaagagtttaataaactggcaactgatgccatgattccttctatgcctggacatgtggtccacgcttttacgtttctgaaatcaaccacggaggctcagagtgctgtcccctcccttgcatcaaat

SEQ ID NO: 41469 - protein, 180 aa, Zea mays
  misc_feature: Ceres CLONE 1437009-F
  misc_feature (118)..(118): Xaa is any aa, unknown, or other
MGGGVMRTAAKVSIAGGAAAAKSGRFRNAAPVFATAPAAAGSEAAPLVSVSSGEVPPAAAHWAASWELDDWEFADWRDDASASAAVVEREATAAAAKPRLVFAPPSREEAEEATTELXDAVKRAYFNESPVEVVKEQDKEFNKLATDAMIPSMPGHVVHAFTFLKSTTEAQSAVPSLASN

SEQ ID NO: 41470 - DNA, 540 bp, Zea mays
  misc_feature: Ceres CLONE 1437010-F
  misc_feature (269)..(269): n is a, c, t, g, unknown, or other
aaagctggagctccccgcggtggcggccgctctagaactagtggatcccccgggctgcaggaattcgcacgagaccattacctagaacatcctaatcgaaaactcctgaacacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgtctccgtccttaanggcggcagcttggctgggtcggtcttcaagcaactaaggggcgcccaccccccgggaggagaggcctttccactccctccctccggggcccaaagaaaagaagacccctttggggccccccccccccccccccccggggggcccctccttgggggcccccccccaaaaaaaaaaccccccccccccccctttttttttttccccacaaaatccccccccgggggggggggtttttcctccctccccccccggggaaaaaaaaaaaaaaacc

SEQ ID NO: 41471 - DNA, 741 bp, Zea mays
  misc_feature: Ceres CLONE 1437011-F
aaagctggagctccccgcggtggcggccgctctataactagtggatcccccgggctgcaggaattcgcacgagaccattacctagaacatcctaatcgaaaaataataaaacctcaaatcgtctctctcccgtcctcccctccaccgccgcagccgccgacgtacctcctcctcccgcgcagcagccaccgccaccgccggaaatgaataccggccaagagcaagacggaactgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctctctctgaagaccgagagggaaaagaagcgtgagaagtacttccccatgaggaagtatgctatcaaggcctaggtcagaactgtgagatgctgcgcttagcatatcatcggctgtgttttaatttttggtttgtatggacatttgctgtgggtcggaagtacgatgtattcctccatttccataaatggctaaattggtttgactggcaaaaaaaaaaaaaaaagcttatcgataccgtcgacctcgagggggggcccg

SEQ ID NO: 41472 - DNA, 683 bp, Zea mays
  misc_feature: Ceres CLONE 1437015-F
  misc_feature: Translation starting site: 243
  misc_feature: SWISSPROT Homolog: EC 3.2.1.21 Beta-glucosidase
tccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcaaagctcaagtaagtgaggtagtcacgaatggctcagttgatgaattccctgaatcacatttcccatatggctcggaacaacggttgggtggaaatgccccactggagtatgcaagctttacaataagatttggctcattgaatgtgacccaatgctttactcggtcaccaaacac

SEQ ID NO: 41473 - DNA, 708 bp, Zea mays
  misc_feature: Ceres CLONE 1437027-F
  misc_feature: Translation starting site: 475
aaagctggagctccccgcggtggcggccgctctagaactagtggatcccccgggctgcaggaattcgcacgagaccattacctagaacatcctaatcgaaaatccatcaccaccactgggtcttcagaccattagctttatctgctccagagagtaaaagaacccgatcgacaccgtgagggtgttgctcgttgccctcgctctcctggctcacggtgcgagcgccacctccacgcatacaagcggcggctgcggatgccagccaccgccgccggttcatctaccgtcgccggtgcatctgccacctccaggtcacctggcacctccggtgcatctcccaccgtcggtccacctgcagcgaccggaccacctgccaccgcgggtccgtgtgccgcctccggttcaactgccgccgccaccatgacactaccctaatcaaccgccccggcctcagccacatcatgagccacacccatgttccgtgctaacagccgaatccaagcccgtgccagctgcggggaacctgtggcgttggtcaccaccccgatcctggaggcagtgcctcgagttcctgaagcatcagtgcagaccgacggcgacgccctactggtcgctctgagtgccagtcgttgctgcatcactgataccaccacctcaagcacgaggagccccagaaccagtaccagccgatcatccgctaggtcctcc

SEQ ID NO: 41474 - DNA, 639 bp, Zea mays
  misc_feature: Ceres CLONE 1437035-F
  misc_feature: Encodes the peptide sequence at SEQ ID NO. 41475
gggctgcaggaattcgcacgagaccattacctagaacatcctaatcgaaaaactccaccttggccgctgttctcctcaccgctcgtgctctctctctctctctcggcgccgactcggctaccgccgccgccttacggaagcttcccaggtcttcgtcaggcttttctccggcaacgagcaccctgcacagatcgtgaacctccacacctcaacgatagatggcggggttcagaagccttgcacccaagaccaggaacctggtggtggccgggggactgtctgccttcgtgctcggggtctactactacaccatgagagcggtgggaggcacggacgagctacaggtggcgatcgacaagtttgaggagacgaagaagcaggatgctgctagaaactccagctccagcgcaggaggatcataattcataaacacgcggacacgccctggatctgctgcaggctgagtggctgacatggtacgacgacagtcacgtcgctcagtaggccatgaccatgcgttctgcttgtactgtgaataaataatgatggggtatggaactctttatctggaaaagttggcagctggtgctttgagaatgtaatagtggccccgatgtttgattttcagggccagccgga

SEQ ID NO: 41475 - protein, 67 aa, Zea mays; identical to SEQ ID NO: 7911
  misc_feature: Ceres CLONE 1437035-F

SEQ ID NO: 41476 - DNA, 617 bp, Zea mays
  misc_feature: Ceres CLONE 1437044-F
  misc_feature: Encodes the peptide sequence at SEQ ID NO. 41477
aagctggagctccccgcggtggcggccgctctagaactagtggatcccccgggctgcaggaattcgcacgagaccattacctagaacatcctaatcaaaagtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcggatcgagatcgtcgctggggatgacgccctcggggccaagggcgccaccggcgaagggtgctcatctcttgccgactgggcgtgccaccgcagcgacgacgggaggagctccaacgcgacaaagatctagaaaaacatgccagatccagaaactgcaaattgaagctgaaagatggtatgcctaccagggagggcaatgagcctgtaccttt

SEQ ID NO: 41477 - protein, 71 aa, Zea mays
  misc_feature: Ceres CLONE 1437044-F
MDPDFSPASGGPSFEFAFNSVNFSDRVLRIEIVAGDDALGAKGATGEGCSSLADWACHRSDDGRSSNATKI

SEQ ID NO: 41478 - DNA, 641 bp, Zea mays
  misc_feature: Ceres CLONE 1437046-F
  misc_feature (301)..(301): n is a, c, t, g, unknown, or other
  misc_feature (302)..(302): n is a, c, t, g, unknown, or other
  misc_feature (357)..(357): n is a, c, t, g, unknown, or other
ggagctccccgcggtggcggccgctctatactagtggatcccccgggctgcaggatttcgcacgagaccattacctagaacatcctaatcgaaaactacaagctctttggaggagtagagacttccagccatcccttctacgctctccccgttcccgtgtcgtcctcccgacaaagagggagccgctagggtttagcggcttccgcttctgggcgagggcttacccgcgagggacggcgcgacgcggcggcacttgagctagggtttccctccgatcccgttcctttcccggcgaaggcgnnatggacgaaaggcggcgattgacgaacttgatccggcgggctcctcgaggcccgncggcgggggcgcacccccggcgccaacggcgcagggtgacttgacgccgaagatcccgggcgcccttctggcgccccaccgggccaaggggagagtttttttctttttctcccagcccaaaaccttttttggagaacttccggggcccccccctattaaaaaaaaatggcgggggggatatttttctgggggcccaatttataacacccccctctttaaaaatatataaggaggagggggggggcccccccccccccaaggaaaaaatttttatttttgtgtga

SEQ ID NO: 41479 - DNA, 698 bp, Zea mays
  misc_feature: Ceres CLONE 1437049-F
  misc_feature: Translation starting site: 163
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
ggagctccccgcggtggcggccgctctagaactagtggatcccccgggctgcaggaattcgcacgagaccattacctagaacatcctaatcgaaaactcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggcccagtcgcactctctggctcctggggacgcgagctccgcctttggaacnnntctcacgggctcacacccgccgcttcgtcggccacaagaaggacgtcatctccgtcgccttctccgtcgacaaaccgcagatcgtctccgcgtcccggaaaagaacttcagctttggaactttctcgcgagggaaataacccatcggggggaactcgggggggggaaggccaaaaggggggtctcctgggttaggttcccccaaaacctttccccccctttggc

SEQ ID NO: 41480 - DNA, 711 bp, Zea mays
  misc_feature: Ceres CLONE 1437054-F
  misc_feature: Encodes the peptide sequence at SEQ ID NO. 41481
  misc_feature (463)..(463): n is a, c, t, g, unknown, or other
  misc_feature (534)..(534): n is a, c, t, g, unknown, or other
  misc_feature (547)..(547): n is a, c, t, g, unknown, or other
  misc_feature (568)..(568): n is a, c, t, g, unknown, or other
  misc_feature (616)..(616): n is a, c, t, g, unknown, or other
ggagctccccgcggtggcggccgctctagattagtggatcccccgggctgcaggaattcgcacgagaccattacctagaacatcctaatcgaaaaaccacacccatgtccacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcaccgccgtgctctctggcggatccctcatcgaggcactcangaagctgacggagccgccgtacctggattcagtggactggagcaagtggcacgtcttctgggtggatgagnaggtcctgcccanggacatgtggatagcaactancagctcggctatgatggggtttctctccaggtggccgatcctcctggnacagtttatgctataaacgatgcgttgttcagttgaaggagccgcagacgactaccaagcggggcctgaaccagcttgtcaagaccggtgtggat

SEQ ID NO: 41481 - protein, 119 aa, Zea mays
  misc_feature: Ceres CLONE 1437054-F
  misc_feature: SWISSPROT Homolog: EC 3.1.1.31 6-phosphogluconolactonase
  misc_feature (64)..(64): Xaa is any aa, unknown, or other
  misc_feature (88)..(88): Xaa is any aa, unknown, or other
  misc_feature (92)..(92): Xaa is any aa, unknown, or other
  misc_feature (99)..(99): Xaa is any aa, unknown, or other
  misc_feature (115)..(115): Xaa is any aa, unknown, or other
MATGGAAPTASDAGSKKKLLIFDSEEDLAVSLAKYTAELSEKFAAERGAFTAVLSGGSLIEALXKLTEPPYLDSVDWSKWHVFWVDEXVLPXDMWIATXSSAMMGFLSRWPILLXQFML

SEQ ID NO: 41482 - DNA, 729 bp, Zea mays
  misc_feature: Ceres CLONE 1437058-F
  misc_feature (729)..(729): n is a, c, t, g, unknown, or other
gaccattacctagaacatcctaatcgaaaaatccgttctgttgaaaattaaaagacgtgcgtgactcccatctatagagtacagagattcaaaacaatggacttgtactaaaaactagactacctccgcggagagggatagaaagatgcaaaacgaccttctcctgtcctgcatctgcatgcaataagcagccgctttagtgctgccgtgcagagaggtacttccatgctgctcctggacgtgccggccgtgttggccgggttcctcaaggcgtttccgcctcgccttcctgctttgggcagctcaaaccttcgcgctcccggctgggcgcgcgaactgcccggggggccttaattaccgtcccgggccatcgcatcctttctaccccccccggggttggcggggctacattccccggcgcccaccggggcgtgaaccttgcttcagggcccgaaacccacttgggccaaaaaaaaacagttgggaaccgggcggcccggccccccattttttttccccccccccgggggtctctggggggggggggaaacccccgaggagggccaaatttttccccacagaggcaagttccccccttttaaaaaatttttttgtaatatttctcggggggggtttctcttcttaaaagaggtttatttataacgggcgccccttttatttttgtggccccgccctcttttttgatatttttttccggcgcggggaaan

SEQ ID NO: 41483 - DNA, 710 bp, Zea mays
  misc_feature: Ceres CLONE 1437059-F
  misc_feature: Encodes the peptide sequence at SEQ ID NO. 41484
aagctggagctccccgcggtggcggccgctctagtactagtggatcccccgggctgcaggaattcgcacgagaccattacctagaacatcctaatcgaaaaaggtgaagccgccgccgctgcaatgtccatagccaccgcaggaaactgagatggggggttttgtcaagacccacaagaccaatgcgtacttcaagcgtttccaggtgaagttcaagagaaggcgcgctggcaaaacagactacagggccaggataacgctgattaaccaagacaaaaacaagtacaatacacccacatacagatttgttgtgcgatttaccaacaaggacatcacagcacaaatcatctctgctagtatagcaggtgatatggttcttgcttctgcttactcgcatgagttgccacgatatggtcttgaacttggtctgaccaactatgcagctgcctactgcactggccttctgttggctcgccgtgtgctcaagacccgtgttttacataaggaatatgaggggcatgttagagccactggtgaagacttctctgttgagccagctgatgaaaggaggcctttgcctgctctcttggatgtttgccttaataggactacaactgggaacgtggcttttgtgccctccaaggaacttttgatgggggactggaaattcctcacaaccagaaaaggtttgctggtttccagagggagaa

SEQ ID NO: 41484 - protein, 186 aa, Zea mays
  misc_feature: Ceres CLONE 1437059-F
  misc_feature (27)..(160): Pfam Name: Ribosomal_L18p Pfam Description: Ribosomal L18p/L5e family
MGGFVKTHKTNAYFKRFQVKFKRRRAGKTDYRARITLINQDKNKYNTPTYRFVVRFTNKDITAQIISASIAGDMVLASAYSHELPRYGLELGLTNYAAAYCTGLLLARRVLKTRVLHKEYEGHVRATGEDFSVEPADERRPLPALLDVCLNRTTTGNVAFVPSKELLMGDWKFLTTRKGLLVSRGR

SEQ ID NO: 41485 - DNA, 727 bp, Zea mays
  misc_feature: Ceres CLONE 1437063-F
  misc_feature (727)..(727): n is a, c, t, g, unknown, or other
ggagctccccgcggtggcggccgctctagaactagtggatcccccgggctgcaggaattcgcacgagaccattacctagaacatcctaatcgaaaaaaccaaacgcaatggtttgttctctcattctcttttgtctcctttctctttgtaatgaagttgtgttatagatatgaatattgtttcttgttatgcttttatttatttgcgttcacataagatcatattggtttattgtcccatttacaatcttggattacggtttatccatatactatgaattggaaaggcgaacgcagcgtcaggaatggcggtggaagacgaatgtaagttgaagtttttggagctaaaagcgaaaagaaactataggttcataatattcaggatagacggacaacaagtggtggttgagaagcttggaagtcctgaggagaactacgacgatttctccaattccttacctgccaatgagtgccgctacgctgtctatgacttcgacttcaccactgctgagaattgccagaaaagcaagatcttcttcatagcatggtcaccggattcttcgagggtaagaatgaagatggtgtatgcgagctcaaaagacaggttcaagagagagttggatgggattcaggtggagttacaagccacagacccgagcgagatgagtttcgacatcatcaaaagtcgagctctctagattcatatgtgcctgattttctatcatatn

SEQ ID NO: 41486 - DNA, 714 bp, Zea mays
  misc_feature: Ceres CLONE 1437065-F
  misc_feature: Translation starting site: 147
aagctggagctccccgcggtggcggccgctctatactagtggatcccccgggctgcaggaattcgcacgagaccattacctagaacatcctaatccaaaaacacaacaagaagcttgcattgttcgttgctcgatcgttgcaagtaatggagaaccctgctccgagtatcgtagtgccccccatcgccgcacctgtatcaacgaacttgagcagactctccttccgcaacctgtacatccgacggacgggtccagacagcacgcagatggtgactgtggagggaagaagaggctctattgatcagacaggcgacatgaggtacgtgagtgacttccccgtctacgatggccgtggctccgacaccatcctggtggctcgcgtgaagggcgtcacaaccacgtatcgggaactccaaccagttcttcactttcaccttcgaggctgagatgctaaaatggctccacgctccttaccaatgagtgctgacggatggatccgatgaatgcgcaatctacagcgggaccggacagtttgctatggccataagtgtcggtcaaaaaaagtactttgccgatagggacggcgccggggacactgaccagctccgcatgcaggttttctgcccggtgtttgggctcatcaaagcaaaccaagaaggcggccccgagttgaaaggtttatctttccggaccacggagaatcgtaccgtagaa

SEQ ID NO: 41487 - DNA, 566 bp, Zea mays
  misc_feature: Ceres CLONE 1437066-F
  misc_feature: Encodes the peptide sequence at SEQ ID NO. 41488
  misc_feature (454)..(454): n is a, c, t, g, unknown, or other
  misc_feature (455)..(455): n is a, c, t, g, unknown, or other
aagctggagctccccgcggtggcggccgctctagatctagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcggtgcgagcgccagctccagtacaagcggcggctgtggctgccagacacccacgtttcatcctaccgcctcccgttctatatgcccgcttccgttctatttggcggccgcagaaacccaccccgaaacctttggcaatacccccaacttaacccccccccaaaaaaaaagcccggggcccccattttgaaaacctcggggggggggaaagatttccaaaaaaaccccttttttttgggggccccaaagnngccctcaaatttttcaaagggggcccctttgtgccccccccggggggggaaaaacccctcaagggtgccccccccaaaggggggggggggggggtgaaaaaaaaaaaaaaa

SEQ ID NO: 41488 - protein, 75 aa, Zea mays
  misc_feature: Ceres CLONE 1437066-F
MKVLIVALALLALGASASSSTSGGCGCQTPTFHPTASRSICPLPFYLAAAETHPETFGNTPNLTPPQKKSPGPPF

SEQ ID NO: 41489 - DNA, 723 bp, Zea mays
  misc_feature: Ceres CLONE 1437069-F
  misc_feature: Encodes the peptide sequence at SEQ ID NO. 41490
aagctggagctccccgcggtggcggccgctctagaactagtggatcccccgggctgcaggaattcgcacgagaccattacctagaacatcctaatcgaaaaatgctatgcgcttcctccacatacaagaccaccgcagatcaaaacacacatctctctcactcactcactcgcctcactccactggacatccatccatggagctcttcgcatcagcagcatcagccgaggatcagaagccgtgcagcagcaggctgttcaacaggaagaggagcggcggcaaggcgggcatgggcgtgcgcagcaccgacaagggccggtcgtccttctccgggcggtgcgcgcggctcgtcaaagagcagcgcacgcggttctacatcatgccccgctgcgtcacgatgctggcgtgcagaagcgagtacacctgacgcctgagccctcggtgtccctgatgcaatggcgccggacatgatgcgcagccgcatgcatgacgcgagcatcatcccaagggcagaggaggaggaggaggggaagcctcctccgccgccgagcaggtcaagagacgctcgatccgcctccgcggtcttaattagggaaccacgaacgaaccttgtgtaaagagaagaatattatttttttcattattttctctcctgactaactgctctcggatgcctgatcctttagcacctcgatcgagccttaccgttcttcgtgccgttcg

SEQ ID NO: 41490 - protein, 76 aa, Zea mays
  misc_feature: Ceres CLONE 1437069-F
  misc_feature (53)..(71): Pfam Name: DVL Pfam Description: DVL family
MELFASAASAEDQKPCSSRLFNRKRSGGKAGMGVRSTDKGRSSFSGRCARLVKEQRTRFYIMPRCVTMLACRSEYT

SEQ ID NO: 41491 - DNA, 686 bp, Zea mays
  misc_feature: Ceres CLONE 1437070-F
  misc_feature: Encodes the peptide sequence at SEQ ID NO. 41492
  misc_feature (457)..(457): n is a, c, t, g, unknown, or other
agagctggagctccccgcggtggcggccgctctataactagtggatcccccgggctgcaggaattcgcacgagaccattacctagaacatcctaatcgaaaaacgagatccattcacaacttcagctgcgcctcgactcgtagcccgaaccctagccaccaagccggaggcgagagagcagccatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcgagcgcgtcgccgtctccgtcgacctctacaaccagggatccgcgactgcctatgatgtgtccattaatgacgactcttgggccacagaagtgtttgagcttgtcactggagagaaatcgaagacatggaaaggcttgaccctgntgccactgcttcacacacatatgtcctgaagaccaaaacacagggcaggttccaagggttcaccagctatcattacataccggttccccacaaggacggttcttcgggaggataattcattcccattttcccaatgggaaattcccccggaaaaaacctcccaaaaaaaaatttttaaaggggctaaaaggttttggaaaaaaaaaccgggtccttttggttctttggt

SEQ ID NO: 41492 - protein, 100 aa, Zea mays
  misc_feature: Ceres CLONE 1437070-F
  misc_feature (92)..(92): Xaa is any aa, unknown, or other
MARCLALVALLVLGLAAAAASAADAPFVVAHKKISLSRPKPGVERVAVSVDLYNQGSATAYDVSINDDSWATEVFELVTGEKSKTWKGLTLXPLLHTHMS

SEQ ID NO: 41493 - DNA, 759 bp, Zea mays
  misc_feature: Ceres CLONE 1437071-F
  misc_feature: Encodes the peptide sequence at SEQ ID NO. 41494
aaactggagctccccgcggtggcggccgctctattctagtggatcccccgggctgcaggaattttcacgagaccattacctagaacatcctaatcgaaaaaaaccctaatgcttcccaccgatccatttcggccgccgccacacgtagaatgcatgagctccaaggatgccggctggccacgggctgcgctcgcggacgcgcgacctgttcgcgcgccccttcagcaagaagggctacatcccgctcaccacctacctccgcacctacaagatcggcgactacttcgacgtcaaggtgaacggcgccgaccacaaggggatgccgcacaagttctaccacggccgcaccggtcgcgtctggaacgtcaccaagcgcggcatcgacctcgagataaacaagcaagtgtatggacgcaacccccccaaacgtatccatggtcctcgtggagcaagtgcagccctcccgcttgccaataaagttccccctgaggaatgtgaaaaatggtcttttgaaggcggatgcaaaggatccgccgctaggtcatccgcacccaaaaggcctcccttaggaccccaaaccctggcttcctggttagaggggcactaccatccgggaccgtgcacttcccatcccgtaacgagggtgttcccatgattcttaagggccggaaacccaaggtgggtttgatagggaacccttccaccccgggtaccaacccccggggggttaacctctgagggcggtaaaaattttttggg

SEQ ID NO: 41494 - protein, 162 aa, Zea mays
  misc_feature: Ceres CLONE 1437071-F
  misc_feature (2)..(94): Pfam Name: Ribosomal_L21e Pfam Description: Ribosomal protein L21e
MPAGHGLRSRTRDLFARPFSKKGYIPLTTYLRTYKIGDYFDVKVNGADHKGMPHKFYHGRTGRVWNVTKRGIDLEINKQVYGRNPPKRIHGPRGASAALPLANKVPPEECEKWSFEGGCKGSAARSSAPKRPPLGPQTLASWLEGHYHPGPCTSHPVTRVFP

SEQ ID NO: 41495 - DNA, 682 bp, Zea mays
  misc_feature: Ceres CLONE 1437073-F
  misc_feature: Translation starting site: 540
  misc_feature (621)..(621): n is a, c, t, g, unknown, or other
ttctagaggatcccccgggctgcaggaattttcacgagaccattacctagaacatcctaatcgaaaaataaaaattgatatcactactctatttgcttcggtcatgctcaatctgattcattctcacatctaatatctctctcatctccctctcccagcctgtctgtaccaacagcaccacttccagtccagcgaacgcctgaccttccaagacctaccctcaggaggctggtaacatccgtaaaggtggtcacctctacttccagggccgtgccctgcaaggttgttgagctttcgacttctaagactggcaagcacggacacgccaagggtcacttcactgccattgataacttcgactgctaagaagctcgaggatattgttccatcttcccacctttgtgatgttccccatgtgaaccgtatagcttaccaccttgattgatatctctgaggatggctttgttatccttttgaccgacgatgctggcaccaacgacgacctcgagcttcccaccgatgacaatcacatcgctctgatgagcagtgaattccacgagggaatggatgaggcggtgtctgtcatgccttccatggtagacgaccacatctgtgccgtanaagaagttggtggcggcaattaaacccatactatccttctcgtttcccgaaggataatatt

SEQ ID NO: 41496 - DNA, 715 bp, Zea mays
  misc_feature: Ceres CLONE 1437074-F
aagctggagctccccgcggtggcggccgctctatactagtggatcccccgggctgcaggaattcgcacgagaccattacctagaacatcctaatcgaaaacaaataacttgagtgctattcaacgtgttactcctgctggatggcaccacttattgatagtgcctgcctctgactctggtactcctctggttactctgtggggtactccatgtgaaccgctgattgaggctaccaatcctaatcacggtgatgtgactttaacaaggtccagctggaaggtctccagacttgctcgcagccagcttttactgatccgttgggatctgaaaatcggtcacattctccttctgtagtccttgatcctcatgctctcctcaaaactccatgcgatgatactcttaactatgatgtattacttcacactaaaacagcagttgcctttccgatacaaggcaagatggcgcatgctagagaagaattgatactggcaacacacttagaaaagcaccttgaatgtgctcaacattacaccatggtatggtgtgggtgactccattactcctgctgcggaacagatcactttggtccgactacctgctagctccagcaatcaccttgacgacatatcttctccacctcctgcacaaacgagccagcggactcacccttcacaagcatgtcctgccggggaccgtcctaaaatccggcgtgaat

SEQ ID NO: 41497 - DNA, 672 bp, Zea mays
  misc_feature: Ceres CLONE 1437076-F
  misc_feature: Encodes the peptide sequence at SEQ ID NO. 41498
ccccgcggtggcggccgctctataatagtggatcccccgggctgcaggaattcgcacgagaccattacctagaacatcctaatcgaaaaatctatcccactcctagtcgtatctcaagcgtctttcggcttgacctctggacaacgtgcgcacgtggggaacctagctccttctgctagcctaccatgggtgataaccaccggggtgccacaggaggtggagggggctactgcaacctccatcgacgggggcggaatgccctgctaggcgtagcatcacccgaagcaggccgccatgatgacagcgctcaaggccgcgacggccgcaaccttcggcgggtcgatgctggtgctgtccaggctgatcctggccggtaccctgatctctctcacggtggccacccccgtgctggtgatcttcagcccggtgctggtgcctgccgcaatcgcgttggctctcatggatgccgggttcgtcacctccagcgaactctgtgtcactcgcctgccctggttctcctgaatgtgcagataactgacgtgcaatcacccgccgggagccgatattgtataccactccaatgcgaggctggcgtattacgcacgcgacttccacgagttttcctagcacctcatcgaccatgcgtacggtgttttgagagaaaaacctccc

SEQ ID NO: 41498 - protein, 75 aa, Zea mays
  misc_feature: Ceres CLONE 1437076-F
  misc_feature (1)..(76): Pfam Name: Oleosin Pfam Description: Oleosin
MMTALKAATAATFGGSMLVLSRLILAGTLISLTVATPVLVIFSPVLVPAAIALALMDAGFVTSSELCVTRLPWFS

SEQ ID NO: 41499 - DNA, 885 bp, Zea mays
  misc_feature: Ceres CLONE 1437080-F
  misc_feature: Encodes the peptide sequence at SEQ ID NO. 41500
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (37)..(37): n is a, c, t, g, unknown, or other
  misc_feature (43)..(43): n is a, c, t, g, unknown, or other
nnnnnnnnnnnnnnnnnnnnnnnaagcgatgggtttntttctnccaaactggggctcacagcggtggcggccgctctagaactagtggatcccccgggctgcaggaattcgcacgagaccattacctagaacatcctaatcgaaaaatcggccatcgccatctccatttccagcatacaagacgcgatacgtctcgaggacagcgctccgcacccgcacgcaagcgcagaccggaccgaatcgaagcagcagctgcgtacagaagatcacgccctactgccgcgctgcactgcacaatgggcatctgcgtgtcgtgcgacgcggcggaggagggcgccgcgacggcggcgcgggtggtgctccccagcgaagagatgggggagtacactccaccggtcaccgccgcggaggcgttgctagcgggcgaacctaagagcccaacggcggctccatttgcagacgccaaagcgcgccccccctacggaggggcccggaccgcaggcccgggatcagggcgcggcccggggaggccggagccgctcaggccggggggctagaaatgtagcttttggaagtatgcacccgggaggaacagtggtaatgcagccaagagggcgggtagcgccccgggtacctcggaggggccggacgggggggtcgggggggtcggggggggccgggagagcgggacggttgcgcatcgagggggcggctggaggagatcgggtccagaccgatccgagttgggaggggggccgggcggccggactgtggcgcgccgtgcggccggggcgcgcgtcgatggcggccgccggtcgcggagatggcacgggggctcagacgaggggtcggaggctggggtacatggcgtgagggggaagaggc

SEQ ID NO: 41500 - protein, 86 aa, Zea mays
  misc_feature: Ceres CLONE 1437080-F
MGICVSCDAAEEGAATAARVVLPSEEMGEYTPPVTAAEALLAGEPKSPTAAPFADAKARPPYGGARTAGPGSGRGPGRPEPLRPGG

SEQ ID NO: 41501 - DNA, 715 bp, Zea mays
  misc_feature: Ceres CLONE 1437083-F
  misc_feature: Encodes the peptide sequence at SEQ ID NO. 41502
  misc_feature (473)..(473): n is a, c, t, g, unknown, or other
aagctggagctccccgcggtggcggccgctctattctagtggatcccccgggctgcaggaattcgcacgagaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtccaggccgtccggggcgggtccggcgctcacatctgaggcgagtagcaagcgaagaacatgcaaatgcaggtcggaggaggcgcggccgacagcccgggcgctgcggcggcggcgggcgcggaggcgccacgcccgagccgctacgagtcgcagaagcggcgggactggcacacgttcgggcagtacctgcgcaaccaccggccgccgctggagctggcgcggtgcancggcgcgcacgtgctcgagttcctgcgctacctcgaccagttcggcaagaccaaggtccacgcgccggggtgccccttcttcggccagccgtcgccgcccgcgccgtgcccgtgcccgctgcggcaggcctggggcagcctcgacgcgctcatcggccgcctgcgcgccgccttcaaggagcaagggggccggcccgaggccaaccacttcggcgcccgcgccgtgagcatctacttccggg

SEQ ID NO: 41502 - protein, 137 aa, Zea mays
  misc_feature: Ceres CLONE 1437083-F
  misc_feature (10)..(137): Pfam Name: DUF640 Pfam Description: Protein of unknown function (DUF640)
  misc_feature (57)..(57): Xaa is any aa, unknown, or other
MQMQVGGGAADSPGAAAAAGAEAPRPSRYESQKRRDWHTFGQYLRNHRPPLELARCXGAHVLEFLRYLDQFGKTKVHAPGCPFFGQPSPPAPCPCPLRQAWGSLDALIGRLRAAFKEQGGRPEANHFGARAVSIYFR

SEQ ID NO: 41503 - DNA, 721 bp, Zea mays
  misc_feature: Ceres CLONE 1437087-F
  misc_feature: Encodes the peptide sequence at SEQ ID NO. 41504
agctggagctccccgcggtggcggccgctctagaatagtggatcccccgggctgcaggaattctcacgagaccattacctagaacatcctaatcgaaaaatctatcacactggtgctcgtaactcaagcatcaatggacggagcactgggcagcaagcgcatctggggtacctggcgctgcctcgctagcctacgatggctgatcactcacggggagcgccatgacgtggcatggagctcagggcagctgcatgccaggggcgagcagcagtgcgacgtgctgcaccagcagaaccagggcgacctgatcaccggcctcatcggggggatcgccgacaccttctgcgggtgcatcctccggctcaccggtcagatcctggccgggagcctgatcctgctcacgggggccacccccgtggccgtgatcttcatccaggtgctggtgctcagcgacatcgggctggcgctcatggcggtggcaaccgtcccatccgggggcgtgaccgtcgctgggatgcttgcgatctcttggatgtacaaatacctgacgggcgagtacaggtccggaggctacaatccagaccccaccccggctcaatatggcttaccctgaccgctaaacctgggatgaaatccatttccacatcctccagcccgcaggggactttgctataagaaccaacccatggtgggacgggcgcgcgcggatctcattttaacc

SEQ ID NO: 41504 - protein, 159 aa, Zea mays
  misc_feature: Ceres CLONE 1437087-F
  misc_feature (57)..(160): Pfam Name: Oleosin Pfam Description: Oleosin
MDGALGSKRIWGTWRCLASLRWLITHGERHDVAWSSGQLHARGEQQCDVLHQQNQGDLITGLIGGIADTFCGCILRLTGQILAGSLILLTGATPVAVIFIQVLVLSDIGLALMAVATVPSGGVTVAGMLAISWMYKYLTGEYRSGGYNPDPTPAQYGLP

SEQ ID NO: 41505 - DNA, 721 bp, Zea mays
  misc_feature: Ceres CLONE 1437092-F
  misc_feature: Encodes the peptide sequence at SEQ ID NO. 41506
aagctggagctccccgcggtggcggccgctctagaattagtggatcccccgggctgcaggaattcgcacgagaccattacctagaacatcctaatcgaaaaatcccttagcctgacgctggcgctgccgctgccaccgcccatgtccgccgccccgccccgccgcgtggtcatctgcggcggcggcgtggtgggcgcttgcacggcctacttcctcgccacccacgccgcgtcccccaccgtcccgacactcgtcgagaggtgcgccccggcgtgcgccgcctcgaggaaagccggcggcttcctggcgctggactggtgcgactccaccccggcgctgtccaggctcgcgcgggcctccttcgcgctccaccgccgcctggccgacgccctcggcggcgccgacgcctacggcttccgccccgtccacaccctctcaataatggtccccccgcaccccgccgcctcctcctcctcgccgcagcacccgctgctcccgccctgggtcgacccctccgcgtccgccgccccgcagagggagctcgggacccccgacaccaccgcacatgtccacccgggcctcttcaccaaggccgtactcgcctcgtcgggagccgaggacgtcattggcaaggaggagcgcgtcgacctgtcccaggacgaccgcgacgcctgcatcctgttcatggagcgcgacaggatgatggacacctactccatcc

SEQ ID NO: 41506 - protein, 193 aa, Zea mays
  misc_feature: Ceres CLONE 1437092-F
  misc_feature (8)..(188): Pfam Name: DAO Pfam Description: FAD dependent oxidoreductase
MSAAPPRRVVICGGGVVGACTAYFLATHAASPTVPTLVERCAPACAASRKAGGFLALDWCDSTPALSRLARASFALHRRLADALGGADAYGFRPVHTLSIMVPPHPAASSSSPQHPLLPPWVDPSASAAPQRELGTPDTTAHVHPGLFTKAVLASSGAEDVIGKEERVDLSQDDRDACILFMERDRMMDTYSI

SEQ ID NO: 41507 - DNA, 710 bp, Zea mays
  misc_feature: Ceres CLONE 1437095-F
  misc_feature: Encodes the peptide sequence at SEQ ID NO. 41508
gctctagattagtggatcccccgggctgcaggaattctcacgagaccattacctagaacatcctaatcgaaaaacggccaatgcaattgcagttggtcttgtcattgggcgggacccatttccacagccgcccgcaattggctagtcaaatctcgctatcctttccccaccatccagatcttcccttgcatggacgccgtcgtctccaccctcaccgctcttgccatcttcgcgagcactcgtcgagcacgctccctacaggaacgtgaagggctatagggtggtcgggaggaaaggcggccggagggtccgttggcagaggtgggaggagcggcagttcgtcctctacctctccttcccgcggggcgtcgaggttgccctgcccgccgccgccccccggatactgccagcggggtggctcagccggccggggttccacgagggacggaccatcaacacttggcgttgcattgtgggatactactccgtggcggcggggtgtccgtccaccccgccccagcccgtgctctccccctttcaggaaaccacctgctgcaatatccgtcaaaactctatagtgacctgcggagggggttttccctttcaaaaaaaaaaaacgggcccccaatttcgttaattcaaaacaacccatcctgttggggggaaggagggaaaaacttgcgatttcggctgacagaatggagacccga

SEQ ID NO: 41508 - protein, 29 aa, Zea mays
  misc_feature: Ceres CLONE 1437095-F
MDAVVSTLTALAIFASTRRARSLQEREGL

SEQ ID NO: 41509 - DNA, 764 bp, Zea mays
  misc_feature: Ceres CLONE 1437097-F
  misc_feature: Encodes the peptide sequence at SEQ ID NO. 41510
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
nnnnnnnnnnnttttnnttttttggggnnnnntannnnnnnccacagtggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgactatatggcgtcaggtcaggaaagcaggaaggagctggaccgcaaggcccgcgagggcgagaccgtcgtccccggcgggaccggcggcaagagcgtcgaggcccaggagcacctcgccgaagggcgcagccgcggaggccagactcgcagggagcagctggggcagcaggggtacagcgagatggggaagaagggcggtctgaccaccacggacgagtccggcggcgagcgcgccgccagggagggcgtcagcatcgacgagtccaagttcaccaagtagtcctatcgcgtgcgtgcgtacgcagcgttcgtagctgtctgcgtagtgtaccttggccgtagctagtgctactctctactttggagtagctgaatgataataatgtagctagcagcatgcatgtaggcgatcatacatacgtacgtacatgcaaggtacttggggggtgatcaagaatgcctaccagaaaggggatccataccctaatttagtctggtccgccg

SEQ ID NO: 41510 - protein, 91 aa, Zea mays
  misc_feature: Ceres CLONE 1437097-F
  misc_feature (1)..(92): Pfam Name: LEA_5 Pfam Description: Small hydrophilic plant seed protein
MASGQESRKELDRKAREGETVVPGGTGGKSVEAQEHLAEGRSRGGQTRREQLGQQGYSEMGKKGGLTTTDESGGERAAREGVSIDESKFTK

SEQ ID NO: 41511 - DNA, 759 bp, Zea mays
  misc_feature: Ceres CLONE 1437101-F
  misc_feature: Encodes the peptide sequence at SEQ ID NO. 41512
aagctggagctccccgcggtggcggccgctctagaattagtggatcccccgggctgcaggaattcgtacgagaccattacctagaacatcctaatcgaaaaacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtcggccccaaagtcgtcaagtacaacttccgaacagcaccgcggtccccaagctcggggtcatgcttgtggggtggggaggcaacaacggggccccgcttgagcgctgggggtcattgccaaaagggaggggaattcatggcggaccaaggacaaggggcgagaaggcaaataataaggggtccccttcccgaggttccccccatagaagaaggccgccccacacgggggaagaaaattttggccccgttaagaacccccctaccccgggggaaacccaaacaaccttggggtttgggggggcgggggaccccccccccctataacccgtggaaaaagccttgacacgggcccaaggggggggggaattttccctcggaaaaaaat

SEQ ID NO: 41512 - protein, 157 aa, Zea mays
  misc_feature: Ceres CLONE 1437101-F
  misc_feature: SWISSPROT Homolog: EC 5.5.1.4 Inositol-3-phosphate synthase
MFIESFRVESPHVRYGPTEIESEYRYDTTELVHEAKDGASRWVVGPKVVKYNFRTAPRSPSSGSCLWGGEATTGPRLSAGGHCQKGGEFMADQGQGARRQIIRGPLPEVPPIEEGRPTRGKKILAPLRTPLPRGKPKQPWGLGGRGTPPPYNPWKKP

SEQ ID NO: 41513 - DNA, 698 bp, Zea mays
  misc_feature: Ceres CLONE 1437106-F
  misc_feature: Encodes the peptide sequence at SEQ ID NO. 41514
gctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgtaccattggaaatgactcggcatgtttcaatgatatcgattttccttgtcacctaaggagcataacaagaattcacgtggggtatcaagctcctctacattcgggaccttagcccacaaaagatatctgcaaccctc

SEQ ID NO: 41514 - protein, 115 aa, Zea mays
  misc_feature: Ceres CLONE 1437106-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISIFLVT

SEQ ID NO: 41515 - DNA, 664 bp, Zea mays
  misc_feature: Ceres CLONE 1437109-F
  misc_feature: Translation starting site: 172
cttgaactagtggatcccccgggctgcaggaattcgcacgagaccattacctagaacatcctaatcgaaaaagccttccccgtctctcctcttctgccgaacgagacagaccgggttatgtagcctgcctcgctttcggcgagagaggaagaggcggaggagatcagggcaatgggcggggcggaggcgctgggccagccggacggccatgcgaacggggccgtggtggaggagaagctggacttgctgcggcggcagctggggaaggcggacggcgacccgctccggatcgtcggcgtcggggcgggcgcctggggtagcgtcttctgcgcgctgctgcaggacgcgtacggccacctccgcgacaaggcgcaggtccgcatctggcgccgccccgggccgagccgtcgaccgcgccaccgccgagcacctcttcgacgtcatcaacgcgcgcgaggacgtcctgcgccgcctgatccgccgctgcccctacctccagtacgtcgaggcgcgcctcgggggaccgcccgcttctaccccaacgagatactccggggacggcttcctgcctcaaaaatgatcgaccccgccgttcttgcccgcttcagggtcgtccacaaacctgggaggagggccgtctggggaaccctgacattggtcctca

SEQ ID NO: 41516 - DNA, 700 bp, Zea mays
  misc_feature: Ceres CLONE 1437110-F
  misc_feature: Encodes the peptide sequence at SEQ ID NO. 41517
  misc_feature (484)..(484): n is a, c, t, g, unknown, or other
  misc_feature (505)..(505): n is a, c, t, g, unknown, or other
  misc_feature (620)..(620): n is a, c, t, g, unknown, or other
  misc_feature (623)..(623): n is a, c, t, g, unknown, or other
  misc_feature (624)..(624): n is a, c, t, g, unknown, or other
ggcggccgctctagaactagtggatcccccgggctgcaggaattcgcacgagaccattacctagaacatcctaatcgaaaaaatccatttacctgtccaccaaaccagtctgtagtgttttttccctccctaatgaacagaccacggaggtgacgaagcagcggtagagacaaattagcgagcagagaaggggtactggcgatgacacaccttgccattgagccacatgcggtcggaagggaatgaggggctgacggcgacagtggtggtggcgcagagatggtcggggtcgagcgttacgctgatgctgtcgttgatggggaggatgagcgcctcgtcccgcttcccccagtacttgatcaccgcaatgttggtcggcgtccgccccgttgccatgagcacccactgcccctccgccgccgccattggatctctcgcttcgcgctgctctatgcccgaatatccttgcaaggggaagtagtangcataatccctactactctantagcacggtgtgtaggcgtgcacaccgtgcgccatcgttcttgcagcctcccgatgctcccctggccagatccggtcacacttttgtcgccgcaatcatcgggtacctgcccctnaannatctcccctttcgttcccggtcaggatctcaatcgcgcattgatgggcgtctcgctgcccccctcggaagccctgc

SEQ ID NO: 41517 - protein, 84 aa, Zea mays
  misc_feature: Ceres CLONE 1437110-F
MRSEGNEGLTATVVVAQRWSGSSVTLMLSLMGRMSASSRFPQYLITAMLVGVRPVAMSTHCPSAAAIGSLASRCSMPEYPCKGK

SEQ ID NO: 41518 - DNA, 702 bp, Zea mays
  misc_feature: Ceres CLONE 1437111-F
  misc_feature: Encodes the peptide sequence at SEQ ID NO. 41519
tctgatctagtggatcccccgggctgcaggaattcgcacgagaccattacctagaacatcctaatcgaaaaagaaggttcttcgcttcactctgccctgcgccgccgccaacgctgcagccgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgacaggagggatgcaaaggatgctattcgtgatctagatggtaagaatggatggaaagttgaactatctcgtagcaccaatggtcgtggcagtcgtgatcggcatggtggatctgagttcaagtgctatgagtgtggtgagactgggcacttttgcacgtgaatgtcgcctgcccattgggctctggaagtctagggcgtggaaagacgtcccaccagggagcaggaccccccattccccaccccctagaataccggcaggaagtcctcaatcttttattaagaaggaggcttttagccccttccgttattccgttcctccccaggggccccccaaacttccccttccccccgggcttccggaggaa

SEQ ID NO: 41519 - protein, 99 aa, Zea mays
  misc_feature: Ceres CLONE 1437111-F
  misc_feature (4)..(70): Pfam Name: RRM_1 Pfam Description: RNA recognition motif. (a.k.a. RRM, RBD, or RNP domain)
MARVYVGNLDARVTSGELEDEFRVFGVLRSVWVARKPPGFAFIDFDDRRDAKDAIRDLDGKNGWKVELSRSTNGRGSRDRHGGSEFKCYECGETGHFCT

SEQ ID NO: 41520 - DNA, 825 bp, Zea mays
  misc_feature: Ceres CLONE 1437114-F
  misc_feature: Encodes the peptide sequence at SEQ ID NO. 41521
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (21)..(21): n is a, c, t, g, unknown, or other
  misc_feature (41)..(41): n is a, c, t, g, unknown, or other
  misc_feature (43)..(43): n is a, c, t, g, unknown, or other
ccccccccnnnnnaaccccanggcccccccctccctccacncncaaagctggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtccaggataggattggctacagcatgatcacggacgcagaggagaaagggctgattactcccggcgtgagtgttctgaccgaaccaactagcggcaacacaggcattggactggccctttatggctgctggccagggcttacaacctttaccccccccaaggccggccctcaatggaccagggcgagggaggcatcacaattgaaggcttttggggggcggaaacttggtccttacctgaccccactccctgcgcaaaggaaaggagcttgcccaggaaagcgcgaaagaagaaaaaggcaaaaggcccacccaacctccttaaattcccttccaacaaattttggaaaatcccaaggtataccccaaaggattgcacttatgggagacaaaccgggggccctggaaaatccttgggaacaggccaagcgggcaag

SEQ ID NO: 41521 - protein, 192 aa, Zea mays
  misc_feature: Ceres CLONE 1437114-F
  misc_feature (12)..(192): Pfam Name: PALP Pfam Description: Pyridoxal-phosphate dependent enzyme
  misc_feature: SWISSPROT Homolog: EC 2.5.1.47 Cysteine synthase
MGEASPSIAKDVTELIGNTPLVYLNKVTEGCVGRVAAKLESMEPCSSVQDRIGYSMITDAEEKGLITPGVSVLTEPTSGNTGIGLALYGCWPGLTTFTPPKAGPQWTRAREASQLKAFGGRKLGPYLTPLPAQRKGACPGKRERRKRQKAHPTSLNSLPTNFGKSQGIPQRIALMGDKPGALENPWEQAKRA

SEQ ID NO: 41522 - DNA, 831 bp, Zea mays
  misc_feature: Ceres CLONE 1437116-F
  misc_feature: Encodes the peptide sequence at SEQ ID NO. 41523
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
tttttttgccctcggggccccnacccccnnggggtnnnnnnnnnnnnnnnnnnaaaaactggcactccccgcggtggcggccgctctataatagtggatcccccgggctgcaggaattcgcacgagaccattacctagaacatcctaatcaaaaatcaaccatattattgagaccaacaagcaacatagaaggtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtaagtgaaaacccagctcttcagccctataggctccaacaagcaatcgcaacaagcaaccatgcctttatgacccttgatgttttcaccaatcacaaggcctagcattgccccacccgtcggtacaaaacactgaggcgccggccatcccccccccccctccaggcgaccgggaaatccgagagggcaacctcctggcgaaaacagttgcggcccaagttagccaccgaatcacgacgttgcttggcccctcaaccaccaaccggtagtaaaaaacaagaacgccctgctcggcgtttgtttgggggaccaggcggggtgaatacccccccttccctcccaaaaaaaaaggggcggcctgccgggcccgcgcccagcggcggcaacgcccattcccacgctcatattgggactcggatgtagccgggcgcggcgacggcagaacgccgcggcgtgagggggggggggtcc

SEQ ID NO: 41523 - protein, 80 aa, Zea mays
  misc_feature: Ceres CLONE 1437116-F
MATKIFSLLMLLALSACVANATIFPQCSQAPIASLLPPYLPSMIASVSENPALQPYRLQQAIATSNHAFMTLDVFTNHKA

SEQ ID NO: 41524 - DNA, 877 bp, Zea mays
  misc_feature: Ceres CLONE 1437117-F
  misc_feature: Encodes the peptide sequence at SEQ ID NO. 41525
ggttttttgttgggggggggggggagatgaaaaactcgacgtagacgggctggcactccccgcggtggcggccgctctaaaatagtggatcccccgggctgcaagaattctcacaaaaccattacctagaacatcctaatcgaaaaaggattttgtttcgggtgaggtggggggcggcatggccccacccgcccgctcaggctcagctcctcctctccaaccacccctcgccgttgctgtccgccgccgcaacgtcatcgccacctcggtggaccgccgcctcgcttcaacacgcctgccccatccgacaccagcaagagccacgacaagagcgccctcctccctcctccactccccctttgccactctcttcctcccgccttccggccaccggagtgcggcatcggcgcccgcctaacactgggaggaaacctggtcccctccctcctccaaggaaagacggatccgccacatggggggcggaaggaacaccccccccggggggggttcgccgcaacagcgcgcgccgtgcgggcgaacactcaatactcctcatcaccttgactgcccttggtcctttagtagcctcttatcatgttttgtggtaccgccccggtccgcaatctcccttctccgtctaaatcacccgcgcgacccgccaccaccaccccccgcccaccacatccctcgtaaagccagacttcaccaccaattgcttttgtctgcctatcttgtaatattctaatattacagccgtcccggggccccctctcgcgccattatccacaccctaaacgaggaccacgagggcgggcacaccacccgcctcacccccgccagcgccggcgcgcctccgccactcatcaacatccgcgtg

SEQ ID NO: 41525 - protein, 90 aa, Zea mays
  misc_feature: Ceres CLONE 1437117-F
MGGGRNTPPGGGSPQQRAPCGRTLNTPHHLDCPWSFSSLLSCFVVPPRSAISLLRLNHPRDPPPPPPAHHIPRKARLHHQLLLSAYLVIF

SEQ ID NO: 41526 - DNA, 821 bp, Zea mays
  misc_feature: Ceres CLONE 1437121-F
  misc_feature: Encodes the peptide sequence at SEQ ID NO. 41527
  misc_feature (12)..(12): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
gggggggggggnttttgttgtttggtacncccaaaannnnanaaaactgggactccccgcggtggcggccgctctagattagtggatcccccgggctgcaggaattctcacgagaccattacctagaacatcctaatcgaaaaacatccaagtcctttctccaccgaacctcaggaactagccgttgcccgcacctctccacgtcgcgcttcccatggactccgccaccgtggcgctcgccagccccgcctccgacgaccgacggttctggggccgcctccgcacccgcgtcgacaccatcctcgaggaccgccgtggcctcccgccagccgccgccgccggtgcccccatgcgcggggtggaatctgagcgggggaagcggctccgggaggactccctgatgctcgtccgtggcctcgactctgaggcggaatctctggcacagctctccgacacccccacccctgcgcagaagggagggagtgctctcgcgaacctgctcctcccaggcgaggggaatgcgaaagcggccccttgccccctgcccggagaaggtgaaaggcagaaggaggaggaacccacggcctaaaccgaatgggtgggcgccctcctggaaaaaattctcccaaggaaacggccatggtacaagcaatttctcccgtccttcttgggaatggaacacggcgggcacggcatccggaatgggtctttgaggaaaagggggaaagggccttaagggccccctgccttgaaaatggtgcaacaaaggccgctatatgccttgaaactcggtgggcaatcgaaaaacgagggaggggtgg

SEQ ID NO: 41527 - protein, 124 aa, Zea mays
  misc_feature: Ceres CLONE 1437121-F
MDSATVALASPASDDRRFWGRLRTRVDTILEDRRGLPPAAAAGAPMRGVESERGKRLREDSLMLVRGLDSEAESLAQLSDTPTPAQKGGSALANLLLPGEGNAKAAPCPLPGEGERQKEEEPTA

SEQ ID NO: 41528 - DNA, 719 bp, Zea mays
  misc_feature: Ceres CLONE 1437123-F
  misc_feature: Encodes the peptide sequence at SEQ ID NO. 41529
  misc_feature (719)..(719): n is a, c, t, g, unknown, or other
aaagctggagctccccgcggtggcggccgctctataactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatgggggccgggttcgtcacctccggcggcctcggcggcgctgcgctggccgggttctcctgaatgtacaagtacctgacgggcaagcacccgccggggcgccgaccacttggaccacgccaaggcgaaggctggcgccccaggccccgcgacgtcaaggatgcaacccagcacccgcatccaaccaggggcaaggggtcttgaaaaaaaaaaccccacctcaaaccggaccgccgcggggggaactcn

SEQ ID NO: 41529 - protein, 111 aa, Zea mays
  misc_feature: Ceres CLONE 1437123-F
  misc_feature (36)..(112): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPVLVPAAIALALMGAGFVTSGGLGGAALAGFS

SEQ ID NO: 41530 - DNA, 713 bp, Zea mays
  misc_feature: Ceres CLONE 1437124-F
  misc_feature: Encodes the peptide sequence at SEQ ID NO. 41531
tccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgcccctggtgcacccgcacagcatgctggtggtgaccatcaacggcaccggcatgctcatccagctcacctacgtggcgctcctcatcctctgctccgcgggggcggtgcgccgcagggtcgtgctcctgttcgccgccgaggtccccttcttcgtcgccttggccgcgctggtgctcaccctggcccacacccacgagcgcagtccatgctcggtgggcatcgtcttcctcttcttcggcacccggatgtaccccgcgccccttcccctcatgaaattgttggtcccaacaaaaaacgtggaaatctt

SEQ ID NO: 41531 - protein, 164 aa, Zea mays
  misc_feature: Ceres CLONE 1437124-F
  misc_feature (9)..(97): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALLILCSAGAVRRRVVLLFAAEVPFFVALAALVLTLAHTHERSPCSVGIVFLFFGTRMYPAPLPLMKLLVPTKNVEI

SEQ ID NO: 41532 - DNA, 665 bp, Zea mays
  misc_feature: Ceres CLONE 1437125-F
  misc_feature (559)..(559): n is a, c, t, g, unknown, or other
tccccgcggtggcggccgctctagaactagtggatcccccgggctgcaggaattcgcacgagaccattacctagaacatcctaatcgaaaaatcccgtaatcgcagcctcgccccgctcgcatcttcctctccctctcagcgctggtgctcaatctacaggtcgtcccgctccctacacacccgccctccggtgtgaacctccatgacgtccacaaccactctccgatctgctgtcgtgacctcatccagccgtgctgtggcagtggatcggagttcgctccagctctgattggaattccactactatatgtgccacttgaagttgttatgttcaaataatatggtgaaaacgagcgtctattgggatctattttttatcttgcaaatgatcttcctgaaggaggtaatatattcttagatgaggtatatatcgtaatacttatagcataaacactcaagccactacaaactgccttcgtccccttcatcactgctgatgaccgtgacttggagacccgacagcgaccctcgacgttgtcgccgccgagcccatgctgnttccaccagtggtccaccgcccggatgtggcccgccaagacgagcaggaacggtggcagcgaagcgaggtggtagatccagcaccgcctctgcacgaccatccatt

SEQ ID NO: 41533 - DNA, 791 bp, Zea mays
  misc_feature: Ceres CLONE 1437127-F
  misc_feature: Encodes the peptide sequence at SEQ ID NO. 41534
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnnnnnnnaaaannnnnnnaacccgcgtccccttgtnntngtnnnaaaagtggagctccccgcggtggcggccgctctagaatagtggatcccccgggctgcaggaattctcacgagaccattacctagaacatcctaatcgaaaaaccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagggcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgaccggagaggttacaaggtcgtataccggaggtatgctagcctgtatttctgcatgtgcatggatgccgaggacaatgagcttgaagtccttgagatcatccctcatttccgcaagatactggaccgttattttgggagtgcatgtgagtttggatttgatattccattttcagtaaggcctactacttactggaatgaaattctcatccgctgggggaccttcaacgaatcctaccaagaaaaaaatgtttgcaaaaaactttattggctgcaccgggatattcttttgggtccgaggcctgtcttaaaggaggcaaaccccg

SEQ ID NO: 41534 - protein, 158 aa, Zea mays
  misc_feature: Ceres CLONE 1437127-F
  misc_feature (1)..(145): Pfam Name: Clat_adaptor_s Pfam Description: Clathrin adaptor complex small chain
MINFVLLISRQGKVRLTKWYSPYTQKERTKVIRELSGLILTRGPKLCNFVDRRGYKVVYRRYASLYFCMCMDAEDNELEVLEIIPHFRKILDRYFGSACEFGFDIPFSVRPTTYWNEILIRWGTFNESYQEKNVCKKLYWLHRDILLGPRPVLKEANP

SEQ ID NO: 41535 - DNA, 724 bp, Zea mays
  misc_feature: Ceres CLONE 1437128-F
  misc_feature (370)..(370): n is a, c, t, g, unknown, or other
tccccgcggtggcggccgctctagaactagtggatcccccgggctgcaggaattcgcacgagaccattacctagaacatcctaatcgaaaactttcctagggtttcgtcgcttccagccgccgccgcgtcagcctcgccaagcgcagcagccgccgcataacatggttctctagatctcagccctggcggaggtggaacagaagcaggacacgccgaagctgcttcaaccgactggaccttatatgatgtacagctgaacgacatctcgatgaacttactacatgattgtgaacgcgactaagcatgccatgtacctgccgcagatcgcggggcgatactacaagatccgttcagcacgacgcagagcangatcgatgagcggctaaaaactccatcatgatgcacgtgcgcaaccacgtcagaagggtatgggtggccaatcatgaggctaccctgaaataatcaccgtggtcccgggcaaacccatccggtctcttcaagcaaaaagaaaggggccccccaaaaaaaccccccaattgttccccttggttttaaaaaacccgcccgaaaattaccccccgggggggggaaccttgtttttcctcccccccggggggggaggagagagtttctcagaaagaaaaactttttaaaaggccctaaaaaaaatttaaaccccgggggggtttttcaaaaatcccccccaaaaaaaaaaagaagggg

SEQ ID NO: 41536 - DNA, 679 bp, Zea mays
  misc_feature: Ceres CLONE 1437131-F
  misc_feature: Translation starting site: 217
  misc_feature (432)..(432): n is a, c, t, g, unknown, or other
gcggtggcggccgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactgcaagagaaccttctgagaggcatctatgcctatggttttgagaagccatcggctattcagcaaaggggaatagttcccttctgncaggggcttgacgtgattcagcaagctcagtctggaactggaaaacagctaccttctgttctggaatcttgcagcaacttgattatggattggttgaatgccaggcattgtttcttgcctcaacccgtgagctggctcagcaaattgagaagggtatgcgtgctcctggggactattttggtgtcaaagtgcatgccctgggttgggggaacttccgttcgtgaggaccaaaggattcttgccaggg

SEQ ID NO: 41537 - DNA, 733 bp, Zea mays
  misc_feature: Ceres CLONE 1437132-F
  misc_feature: Encodes the peptide sequence at SEQ ID NO. 41538
tggcggccgctctagaactagtggatcccccgggctgcaggaattcgcacgagaccattacctagaacatcctaatcgaaaagttcttccagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttcggcggcctgccgctcgacgtcctcgccttcgtcgaccgcaaggtggacgacacggtgcacgaggtggacaagcacctccccgggcgcgctgaaagcggcgtcggcccatgtctacgcgatgtttccgggtcgtgccttgaggtggcgcgccaaactggcggcccaaagcctaatgctcgggactttaggggctcagccccccgcggcgctcccgaatgacaactcaagtaggacgcgggacgtgcaccggcacgcccggg

SEQ ID NO: 41538 - protein, 156 aa, Zea mays
  misc_feature: Ceres CLONE 1437132-F
  misc_feature (19)..(157): Pfam Name: REF Pfam Description: Rubber elongation factor protein (REF)
MAEEQSNPQHQQAEEREVMVEQQQPRRAPKLRYLDFVQVAAAQAAVCLAGLYGLAKDHAGPLRPSVDAVESAVKGVVSPVYDRFGGLPLDVLAFVDRKVDDTVHEVDKHLPGRAESGVGPCLRDVSGSCLEVARQTGGPKPNARDFRGSAPRGAPE

SEQ ID NO: 41539 - DNA, 707 bp, Zea mays
  misc_feature: Ceres CLONE 1437134-F
  misc_feature: Encodes the peptide sequence at SEQ ID NO. 41540
  misc_feature (416)..(416): n is a, c, t, g, unknown, or other
gcggtggcggccgctctagaactagtggatcccccgggctgcaggaattcgcacgagaccattacctagaacatcctaatcgaaaaaagcgcccaaggcagcggagagagctagctccctcctcctcctcaggtagcgagcgagcgagcgagcgagctcctctgcccctctgcacacctggcctccccttctccgctgcaggaccgccgttgacgactgctccaccagtactgcgcgcgcccgcgctgcctacccttacctagccagagcgcggcgcgcgagagggagaacgaccaggaggggaggagatcgatcgatcgatcgatcgagatagatggctttcctcaacatggagcagcagacctgggccttcaccttcggtatcctaggtaacataatctcgctgatggtgtccntttcgccgctgccgacgttctaccgcgtgtaccgcaagaagtcgacggaagggttccagtcgaccccgtacgtggtgacgcctgtcagctgcctgctggggattctctacccgcttctcaagtccggcgcgaaattgctggggaccatcaacgggttccggtggcttgatcaaggcggcgtacctggcaacttacctggtgtaacccccccaaggccccccagggcccttaacggcccaaaaagctttttgggggctaaacggggggggttttttggcctcccgcccgccc

SEQ ID NO: 41540 - protein, 124 aa, Zea mays
  misc_feature: Ceres CLONE 1437134-F
  misc_feature (13)..(82): Pfam Name: MtN3_slv Pfam Description: MtN3/saliva family
  misc_feature (28)..(28): Xaa is any aa, unknown, or other
MAFLNMEQQTWAFTFGILGNIISLMVSXSPLPTFYRVYRKKSTEGFQSTPYVVTPVSCLLGILYPLLKSGAKLLGTINGFRWLDQGGVPGNLPGVTPPRPPRALNGPKSFLGAKRGGFFGLPPA

SEQ ID NO: 41541 - DNA, 723 bp, Zea mays
  misc_feature: Ceres CLONE 1437135-F
  misc_feature: Encodes the peptide sequence at SEQ ID NO. 41542
gcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtactgatcctcctcgcagggcgcttcatggggaagagagtggtgtttctcaagcagctcaagtctggcctgctccttatctctgggcctttcaagatcaatggagtaccgatccgccgtgtgaaccagacctatgtcattgctacatcaaccaaagttgacatctctggtgttgatgtcacccagtttgatgacaagtactttgcccgggagaagaaccaaaaggtgaagaaaaccgaggggctagcttattgcaaccataaaagggggctgcaaataccctttcctaacatctagagggatccacggaaaatccaaagaaaactcttgttgctg

SEQ ID NO: 41542 - protein, 177 aa, Zea mays
  misc_feature: Ceres CLONE 1437135-F
  misc_feature (112)..(174): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYVIATSTKVDISGVDVTQFDDKYFAREKNQKVKKTEGLAYCNHKRGLQIPFPNI

SEQ ID NO: 41543 - DNA, 763 bp, Zea mays
  misc_feature: Ceres CLONE 1437139-F
  misc_feature: Encodes the peptide sequence at SEQ ID NO. 41544
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (34)..(34): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nccccccccnnnnnnnnnnnanacgaanntgngngggttannnnnnncaaactggagctccccgcggtggcggccgctctagaatagtggatcccccgggctgcaggaattcgcacgagaccattacctagaacatcctaatcgaaaaatccacagaaaaaaagcgtcccgcctcatcccgagatcagaatcagaggccacgcggcgatggcgatggcgatgccgatggcagtggcgcgggtgaccagcctcgcctgcgccccccgacaggcgcagcatcgccgccgccatagccttgccccgccgtgcgcctcgggtgcggtggaggtgcgggtctgcacgaaccgcacgtgcgcgcggcagggggggcgcgaggtcctggctgcgctcgcgggcctcgcaccgccggcggtcgacgtggcctcctgcgggtgcctcgggcgctgcggcgccgggcccaacgttgcggcgtccgtccctgggagcaccgcggtgttcggccacgtgggcacggcggcgcgaggcgcgcagctactggagcacctcctcggccccgcggaattcgatgcggccctagggctcaccgcgctggccaccgagggagaaggcggaggctgcccctcgagaggggaaacgcggacgaagcggaaaccccttctcaccggaggtctggactggaccccataccccagttctgccaattgtgcatgcctcctctcaattggctgggatccggattttggtggatttacaccttggtgtg

SEQ ID NO: 41544 - protein, 185 aa, Zea mays
  misc_feature: Ceres CLONE 1437139-F
MAMAMPMAVARVTSLACAPRQAQHRRRHSLAPPCASGAVEVRVCTNRTCARQGGREVLAALAGLAPPAVDVASCGCLGRCGAGPNVAASVPGSTAVFGHVGTAARGAQLLEHLLGPAEFDAALGLTALATEGEGGGCPSRGETRTKRKPLLTGGLDWTPYPSSANCACLLSIGWDPDFGGFTPWC

SEQ ID NO: 41545 - DNA, 611 bp, Zea mays
  misc_feature: Ceres CLONE 1437140-F
  misc_feature: Encodes the peptide sequence at SEQ ID NO. 41546
  misc_feature (136)..(136): n is a, c, t, g, unknown, or other
ggagcccccgcggtggcggccgctctagaactagtggatcccccgggctgcaggattcgcacgagaccattacctagaacatcctaatcaaaaatcgcacatattattgagaccaactagcaacatagaaagcacntattgtaccaataatggcagccaaaatattttgcctcattatgctccttggtctttctgcaagtgctgctacggcgagcattttcccgcaatgctcacagctcctatagcttccttcttccccatactctcaccacgatgtcttcgtatgtgaaatcattctctacctacaggatccacaggcatccagcagcatcttaccttatcaccttgtccctcaaacatcatcaccctatacagcagtacctttgggcattaatggacaaacattagggaaaaacactacaaaaattgtgttagaaaacttgttgcttatttagaaaaaaattaccttggggggattggtggccaaaaaattgggccaaaaactaaaaaacttgggaaaaaaacttttgtcctttttttaaaaaaaaatttttgccctttaaacaaaagggggtgaaacccgggcgtttttgcccaaacccacccccccc

SEQ ID NO: 41546 - protein, 31 aa, Zea mays
  misc_feature: Ceres CLONE 1437140-F
MAAKIFCLIMLLGLSASAATASIFPQCSQLL

SEQ ID NO: 41547 - DNA, 728 bp, Zea mays
  misc_feature: Ceres CLONE 1437145-F
  misc_feature: Encodes the peptide sequence at SEQ ID NO. 41548
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtggaacgcgccgggcaggagaggaagaggctgcntgtggtggtcggcggctgggacccggagacgtgggcgccgaacgacgcggtgctcgtctacgacttcctgtcgggcgcgtggcggcccggcgcgcccatgcccggcccgcgcaggtccttct

SEQ ID NO: 41548 - protein, 174 aa, Zea mays
  misc_feature: Ceres CLONE 1437145-F
  misc_feature (3)..(50): Pfam Name: F-box Pfam Description: F-box domain
  misc_feature (134)..(134): Xaa is any aa, unknown, or other
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPPGPSQSLPLFCQVAAAVERAGQERKRLXVVVGGWDPETWAPNDAVLVYDFLSGAWRPGAPMPGPRRSF

SEQ ID NO: 41549 - DNA, 807 bp, Zea mays
  misc_feature: Ceres CLONE 1437147-F
  misc_feature (382)..(382): n is a, c, t, g, unknown, or other
  misc_feature (656)..(656): n is a, c, t, g, unknown, or other
  misc_feature (657)..(657): n is a, c, t, g, unknown, or other
  misc_feature (661)..(661): n is a, c, t, g, unknown, or other
  misc_feature (693)..(693): n is a, c, t, g, unknown, or other
  misc_feature (698)..(698): n is a, c, t, g, unknown, or other
  misc_feature (704)..(704): n is a, c, t, g, unknown, or other
  misc_feature (705)..(705): n is a, c, t, g, unknown, or other
  misc_feature (735)..(735): n is a, c, t, g, unknown, or other
  misc_feature (739)..(739): n is a, c, t, g, unknown, or other
  misc_feature (746)..(746): n is a, c, t, g, unknown, or other
  misc_feature (752)..(752): n is a, c, t, g, unknown, or other
  misc_feature (760)..(760): n is a, c, t, g, unknown, or other
  misc_feature (761)..(761): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (774)..(774): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (795)..(795): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (804)..(804): n is a, c, t, g, unknown, or other
  misc_feature (807)..(807): n is a, c, t, g, unknown, or other
tcttctctcttcccttcctacgtgctatacacgttggatctcgctgcaaggaccgggcggccgtcctcccgggtgggggtggtctcttaaactagtggtgttcctccggggtgggggaagtctactcgggaccgttgcgtgaatcaaactattattaaatgttgtttctcggtcctgggtgtgccagctggtctgtacgaatgtcatgaattgtcgaattggagatgtcttggtatgtcccggctaatatggggtgcgggggatcgagactcatacccagggactctagtttccataaatgttctgactgtgataccgtcccacatgggctacgttcgggcatcgcccccgcctgactaccatgactggccgcccgcgggcngtacccctgcgcggagtacctgaggcagccccagtgcaccccgctggcggcggcgccctactacgcccgggtggggggagccaagcgccatgttccagccgctccggcaacagtgctgccagcagcagatgaggatgatggacgtgcagtccgtcgcgcagcagctgcagatgatgacgcagcttgagcgtgccgctgccgccagcagcagcctgtacgagccagctctgatgcagcagcagcagcagctgctggcagacaatgttctcaaccnnatgnacatgatgatggcgcaaaaacatgccgacatntgttnactctnnacagtacagctggctagctaccgcaacaanccgntttggcnttccgngctgcatnnccnnntactactngatcatgcagtgnnngcgaantccnnntancan

SEQ ID NO: 41550 - DNA, 681 bp, Zea mays
  misc_feature: Ceres CLONE 1437156-F
  misc_feature: Encodes the peptide sequence at SEQ ID NO. 41551
  misc_feature (57)..(57): n is a, c, t, g, unknown, or other
tggcggccgctctagaactagtggatcccccgggctgcaggagagaccattacctanaacatcctaatcgaaaagtccttccctccgcctccgcccccgcccactcctggcttccaccactcctgtcacctcttcccgcgccgacgcagccgccatggaccccgtctccacatgggggctaaccccgctcgcgggcgccgacccggagatctacgacctcctggagcgcgagaagcggcgccagcgtcgcggcatcgagctcatcgcctccgagaacttcacctccttcgccgtcatggaggcgctcggctccgcgctcactaacaagtactccgagggcatgcccggcgcccgctactacgggggcaacgacgtcatcgacgagatcgagaacctctgccggtcacgcgcgctcgctgccttccaccttgacgccccgtcctggggcgtcaacgtgcagccctactcggggtcccccgccaacttccccgcctacaccgggctgcttcacccgcacgaccggatcatgggggtcgactttccctccgggggacacctcacttcccgggtacaacacggccgggggaaataaggatctcccgccccctcgatctacttttgaaagcctgccgtaaaaaggtgagccgccccaacgggggaacatcgaactacaaaaaaacg

SEQ ID NO: 41551 - protein, 145 aa, Zea mays
  misc_feature: Ceres CLONE 1437156-F
  misc_feature (12)..(146): Pfam Name: SHMT Pfam Description: Serine hydroxymethyltransferase
  misc_feature: SWISSPROT Homolog: EC 2.1.2.1 Glycine hydroxymethyltransferase
MDPVSTWGLTPLAGADPEIYDLLEREKRRQRRGIELIASENFTSFAVMEALGSALTNKYSEGMPGARYYGGNDVIDEIENLCRSRALAAFHLDAPSWGVNVQPYSGSPANFPAYTGLLHPHDRIMGVDFPSGGHLTSRVQHGRGK

SEQ ID NO: 41552 - DNA, 721 bp, Zea mays
  misc_feature: Ceres CLONE 1437160-F
  misc_feature: Encodes the peptide sequence at SEQ ID NO. 41553
  misc_feature (114)..(114): n is a, c, t, g, unknown, or other
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaacatttcgacttntcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctgggggtaccagccaaaccnataactaccacagggccgacggtcagaacacggaaacttccttacggaccgtccttcgacaaggtccacgctgctcctggcggtggctctccctgggaaacccgttgggtgcaactgatgcccttcaccaagttatccccccccatggcccccaatgctttttttgaatcggagaaaaccctttttctttttgtggtaccaaaacctcccctccccggtgggcccccaaaacccgcccaaaattttaggggataattgggggcccgaacccccctaaaaaagccctccctcccacccct

SEQ ID NO: 41553 - protein, 121 aa, Zea mays
  misc_feature: Ceres CLONE 1437160-F
  misc_feature (67)..(67): Xaa is any aa, unknown, or other
MSRGGSAGGGQSSLGYLFGSGEPPKPAVAPAVSAPPAAAGAPPAEKPPAAKPDGTSQIAAGGTSQTXNYHRADGQNTETSLRTVLRQGPRCSWRWLSLGNPLGATDALHQVIPPHGPQCFF

SEQ ID NO: 41554 - DNA, 762 bp, Zea mays
  misc_feature: Ceres CLONE 1437162-F
  misc_feature: Encodes the peptide sequence at SEQ ID NO. 41555
  misc_feature (103)..(103): n is a, c, t, g, unknown, or other
  misc_feature (108)..(108): n is a, c, t, g, unknown, or other
  misc_feature (109)..(109): n is a, c, t, g, unknown, or other
  misc_feature (367)..(367): n is a, c, t, g, unknown, or other
  misc_feature (374)..(374): n is a, c, t, g, unknown, or other
  misc_feature (375)..(375): n is a, c, t, g, unknown, or other
  misc_feature (393)..(393): n is a, c, t, g, unknown, or other
  misc_feature (417)..(417): n is a, c, t, g, unknown, or other
  misc_feature (702)..(702): n is a, c, t, g, unknown, or other
  misc_feature (703)..(703): n is a, c, t, g, unknown, or other
ggagctccccgcggtggcggccgctctagaactagtggatcccccgggctgcaggaattcgcacgagaccattacctagaacatcctaatcaaaaagaggaanaaagnncacgcgagagcttgtcggagggctctctgtctctgtgataaaccgatacgcagaggaagctgcggagaggtgtccctgctctgccggtgagctgcggccagcgggtgaagagaagtggaccggacggggacgaaggagagagagaagaagaaaaaggcgccgcgggggccatggctggacacgcgcctgcgaggggacagaccacccaccggctttcgcgctacgtgcagcctgctgagccagtttctcaaggaaaanaaaggcnngcctgcaaggcctcggcngcctcccccattgccccggccccngaaacttgaaacaggggcttttcgggccgccgacccccttgaacttggttgtcccgcttaaagcgggcaaagggcccccgttgggggaaccccaaaaggcccttggcccaaacccccccgggggggaaaccccagggaggcaccgtggggggaggggcccaaattttaccttttttttcggggggaaaagggggctttttcaaagagttcccccccccacaaggaagaaccctttcaaaatttgagccccccggggggccccccccgggggggaggggggggggnntgtgcccctcttcccccacaaaaaatgttggtggtttaataaaaagttttttttggtgg

SEQ ID NO: 41555 - protein, 48 aa, Zea mays
  misc_feature: Ceres CLONE 1437162-F
  misc_feature (35)..(35): Xaa is any aa, unknown, or other
  misc_feature (36)..(36): Xaa is any aa, unknown, or other
  misc_feature (37)..(37): Xaa is any aa, unknown, or other
GAPRGGGRSRTSGSPGLQEFARDHYLEHPNQKEEXXXRESLSEGSLSL

SEQ ID NO: 41556 - DNA, 974 bp, Zea mays
  misc_feature: Ceres CLONE 1437163-F
  misc_feature: Encodes the peptide sequence at SEQ ID NO. 41557
  misc_feature (923)..(923): n is a, c, t, g, unknown, or other
  misc_feature (974)..(974): n is a, c, t, g, unknown, or other
tgttaccccccccgcccgtcccgcggcggctcccccctcgccgttgagcgccccaactcaccgcggtggcggccgctctagaactagtggatcccccgggctgcaggaattcgcactagaccattacctagaacatcctaatcgaaaaacccgatctccaaatcgcccccccaaaccctcttcttcccccttcccgtgctctacccaaatcgagggctcgatccgtcggccatggctctggagtgggtggtgctgggctacgcggcgggcgcggaggccatcatgctgctgctgctgacgttgccggggctctactgcctgctccggggcatgatctccctggtgcgcgagcccgctgaagcccaggagtgcggcggggcccttctgcctcttcccggctatggacatctacttggaaagtgggagacgccccccacctgtcggataacaagcgctgcctgccacccgcctcgcgagcaacctctctgccaccaggaagtgccgttcatggaagttcgccacccgaaaaacccgcctccgtccatctgtcggcccgggcgcgtggctccgtccgtactggcgaagccgtcatgttttcccggttcgacccgcatggcgcgggttccgtttcaggggccttcgccactccggcattgtccgtcctatacggcggattcaagacctaaggctgccacaggaaaactcttcggaccccaccttcgattttaacgtttcggtcaatgtctcgtcgctgttaggggctgtatggatcctcttcgcctttcctcgcgagcaccagtgacgcatcgccgttcccaggtatatgtgcgcgaccgccggtacaattgcgggcggcgtaatccccgtgacctcgccgtagatctttgctggatccttgtaccccgttggtgaatgttccgctngtacggattggcctgttgtgccggatggttgcgtctgcgagctgaagcatn

SEQ ID NO: 41557 - protein, 165 aa, Zea mays
  misc_feature: Ceres CLONE 1437163-F
MALEWVVLGYAAGAEAIMLLLLTLPGLYCLLRGMISLVREPAEAQECGGALLPLPGYGHLLGKWETPPTCRITSAACHPPREQPLCHQEVPFMEVRHPKNPPPSICRPGRVAPSVLAKPSCFPGSTRMARVPFQGPSPLRHCPSYTADSRPKAATGKLFGPHLRF

SEQ ID NO: 41558 - DNA, 727 bp, Zea mays
  misc_feature: Ceres CLONE 1437171-F
  misc_feature: Encodes the peptide sequence at SEQ ID NO. 41559
  misc_feature (727)..(727): n is a, c, t, g, unknown, or other
tccccgcggtggcggccgctctagaactagtggatcccccgggctgcaggaattcgcacgagaccattacctagaacatcctaatcgaaaaattgattttttttccgcgcagccgatttcttttcgtctctctcgctctcgccttctcggcgcagcgcagtactacgagctagcagcaccaggaacctcttcccacacttccgcgctcctccctctgtctcgagactcgagaatggttgtgtaggcgggcgcaggagggagggaggcgagagggggagctagggtttttcgccgccgccttctgttatcctcaggctctgaaccccctcctgtccggtgcgcggcggattagactccgatggggaagtctccggcgaagtggatcaagtccgtgctcttcgggaagaagtcgtcgtccaggtccggctccaccaaggccaaagatttatcgaaaggtgcgagtaacaaaggagctgctgctgcggggaaggagcccgtgttctctgagagctccccagtgatctcggagcctgtacttgttagcgcccacaacaatgagaccgtgcgggaggtggcgaagggtgagaattccagcgtgcaagaagtgccagtgaccgatgtcagtcaagtcttggagaaacagggcagtgtggggtctgatacgtccaatgatgctgagagggtgagggaagagcgaacggccgtgaaagcacaagctgccttccgn

SEQ ID NO: 41559 - protein, 123 aa, Zea mays
  misc_feature: Ceres CLONE 1437171-F
MGKSPAKWIKSVLFGKKSSSRSGSTKAKDLSKGASNKGAAAAGKEPVFSESSPVISEPVLVSAHNNETVREVAKGENSSVQEVPVTDVSQVLEKQGSVGSDTSNDAERVREERTAVKAQAAFR

SEQ ID NO: 41560 - DNA, 670 bp, Zea mays
  misc_feature: Ceres CLONE 1437172-F
  misc_feature: Encodes the peptide sequence at SEQ ID NO. 41561
ccccgcggtggcggccgctctagaactagtggatcccccgggctgcaggaattcgcacgagaccattacctagaacatcctaatcgaaaaacaaaaaggcggcagcacagcgccacccctcctgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttgagccaaagctattttctaagaaaaatggcggcaatgatggtggcgatgactgcgaggagcaagaacagcatattacccatggagaagaagcagggctggtctattcagctaccagagctccggttcccttgggattcacatgaagacaagggtttctctctgagtctgcaaggatctggaccttctcatggcggcctgtttgctagcgtgggtcttaaagtgtcgacaggtgccccagcagtggcgcccggaccgggtgacaggtatattaagattccattccctgatcattgtataaagtacgtgtctgaggcagttgggtaccaggtttataccccttgaccggaatcagtgaaggaggggctggatgctaacgcaaagaaggcac

SEQ ID NO: 41561 - protein, 105 aa, Zea mays
  misc_feature: Ceres CLONE 1437172-F
MAAMMVAMTARSKNSILPMEKKQGWSIQLPELRFPWDSHEDKGFSLSLQGSGPSHGGLFASVGLKVSTGAPAVAPGPGDRYIKIPFPDHCIKYVSEAVGYQVYTP

SEQ ID NO: 41562 - DNA, 675 bp, Zea mays
  misc_feature: Ceres CLONE 1437175-F
  misc_feature: Encodes the peptide sequence at SEQ ID NO. 41563
acccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgcccacagatcaggcaggtggagcccctgccaccggtaccaggcgacatacggggggggtcctgcaagtccttcctgcaacaacaacccgcagggcgagcctcccgggcccttaataggcgcccccagttaacccacacccccttaaccgccaaattggcggcccttgaaatttgcaaaa

SEQ ID NO: 41563 - protein, 173 aa, Zea mays
  misc_feature: Ceres CLONE 1437175-F
MKVLIVALALLALAASAASSTSGGCGCQTPPFHLPPPFYMPPPFYLPPQQQPQPWQYPTQPPQLSPCQQFGSCGVGSVGSPFLGQCVEFLRHQCSPAATPYGSPQCQALQQQCCPQIRQVEPLPPVPGDIRGGSCKSFLQQQPAGRASRALNRRPQLTHTPLTAKLAALEICK

SEQ ID NO: 41564 - DNA, 745 bp, Zea mays
  misc_feature: Ceres CLONE 1437177-F
  misc_feature: Translation starting site: 365
  misc_feature (745)..(745): n is a, c, t, g, unknown, or other
aagctggagctccaccgcggtggcggccgctctattactagtggatcccccgggctgcaggaattcgcacgagaccattacctagaacatcctaatcgaaaaacacaaaaacccagcatcagtcaagctcgctcacacgaccatggccgcggcgatgaccggcagtactcgcgccagcgacggctccttcctcgtgcttctctttgtcgtgttggccggtgtcgtcgacgtcgcgtccgctgccaccactgcggcgagtgctactgttgccactaacagcggtgacggcaaggcaggggcactccttttcttctccagactctacttgtctggcgcatgtatcccctcctcatgaagataagacatgggtcaagcactcggcttgattcaagtggatcaatcgacagtagccatcaaggaaacttttgggaagtttgacgaggtcctagagcctggatgccacttcttgccatggtgcatagggaagcaaattgctgggtatctgtcactgcgtggtgcagcagcttgatgtccgctgcgaaacaaagacaaaggataatgtcttcgtcaatgttgtggcatctgtgcaatatcgtgcccttgccgataaggcatctgatgcattttacaggcttagtaacaccagggagcaaatccagtcatatgtttttgatgtcatccagggcaagtgttcccgagatgaacttggatgatgcctttgaacagaagaatgaaatcgcaaagn

SEQ ID NO: 41565 - DNA, 718 bp, Zea mays
  misc_feature: Ceres CLONE 1437190-F
  misc_feature: Encodes the peptide sequence at SEQ ID NO. 41566
  misc_feature (718)..(718): n is a, c, t, g, unknown, or other
cgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgataaacatcctcttccaaatcgtagtctagcccgtgcccaaaaccctagcgaccgccggagagctcgtccgaatcgaggccaccgaggggaaattagatcgcggcggacgatggagagccctgcgaaagaggaggccgggggagagctggcaatggagatcgagtcgtcggtcacggcggaggactggcgccgcgcgctttctcgcgtcgtgccgtccgtcgtcgtcctccgcaccactgcgccgcgcgcctttgacaccgaggtcgcgggcgccagctacgccacgggtttcgtcgttgacaagtcccgcggcataatcctcactaaccgccatgtcgtcaagcccggaacctgtggccgcgggagggcatgttccgggaacagggaaaagatccctgtgtacccactgtacaaaaatcccggacatgattttgggtttttttccctatgaaccaggggccattaagtttccttaan

SEQ ID NO: 41566 - protein, 113 aa, Zea mays
  misc_feature: Ceres CLONE 1437190-F
MESPAKEEAGGELAMEIESSVTAEDWRRALSRVVPSVVVLRTTAPRAFDTEVAGASYATGFVVDKSRGIILTNRHVVKPGTCGRGRACSGNREKIPVYPLYKNPGHDFGFFSL

SEQ ID NO: 41567 - DNA, 741 bp, Zea mays
  misc_feature: Ceres CLONE 1437191-F
  misc_feature: Encodes the peptide sequence at SEQ ID NO. 41568
acccgcggtggcggccgctctagaactagtggatcccccgggctgcaggaattcgcacgagaccattacctagaacatcctaatcgaaaaaaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttaaagacgaacagaagaacctcaagcgcgaactcctccgtgcgcaggaggaggtcaagcggatccagtccgtaccgctcgtcatcggccagtttatggagatggtcgacggcaacaacggcatcgtgggttctactacgggcagcaactactatgtgcggatcctcagcaccatcaaccgcgagctgctcaagccgtcagcatctgtcgcgttgcatcgtcactcccacgatttattcgaccttctgcccctccgacgctgactccagcatcctcctttctaggatcgactggagaaatctcatcgtctcctacattgttatataaaggattcgatactccttaagaaagaaataccccagggcgatatcagtgacacttaacaactcattgtatccccaacccaagtgagtgccgccccc

SEQ ID NO: 41568 - protein, 149 aa, Zea mays
  misc_feature: Ceres CLONE 1437191-F
MSAATTAPTPAVATPMAPPPSYPASSTISASVAASVEEEDDLYGRLKSLQRHMEFVEIQEEYVKDEQKNLKRELLRAQEEVKRIQSVPLVIGQFMEMVDGNNGIVGSTTGSNYYVRILSTINRELLKPSASVALHRHSHDLFDLLPLRR

SEQ ID NO: 41569 - DNA, 572 bp, Zea mays
  misc_feature: Ceres CLONE 1437192-F
  misc_feature (26)..(26): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (76)..(76): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
cctggcgcgtcggcgtcgtctcgggngggggggggcggggcgacctnnnnnnnnnnnnnnntannnnnnnnaaaantggagctccaccgcggtggcggccgctctagaatagtggatccccgcgggctgcaggtaattcgcaacggagaaccattacctagaacatcctaatcgaaaatacgttaaatctctcctcccggcgacgactggcgacagccgctgcccggctactcaggtcccaggtctacgtcggaacccttcgccgcggcgagcacccaccaaaatgggcaaagcccggggcgggtcaatgctgctgtcacggctcctccttccannnagaccgtgtccctgctggagaattacaaggggcaaattcccccccccggcgaaagtcccagaaccccctccccccgggggaaattcccggggcccccccccattttgcgggggaccccccccccctttttttgggaaaaatcattaccaaaaacccgtgggaggaaaaaaaaaccgggggggggggcccaactttttttttaaacccccacctggggcgccccctttttgggggc

SEQ ID NO: 41570 - DNA, 913 bp, Zea mays
  misc_feature: Ceres CLONE 1437199-F
  misc_feature: Encodes the peptide sequence at SEQ ID NO. 41571
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (15)..(15): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
nnnttttggtttttnttttttattatttgggcgnntnnnnnnnnaaagctgggactcaccgcggtggcggccgctctagaatagtggatcccccgggctgcaggaattcgcacgagaccattacctagaacatcctaatcgaaaaaagtccggagcaagagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggccgccctgctggcgctcgccgccgccctctccggcgtctcattcgcgcaccggatccctcctctcctcgtcctatccgctcccgcaggaaagctgctggtgctgctgcgggtggcggatggtggtagctgaaggggggggaagctgtatgacaccttttttataaagggggcccccccccacagggaggcgagcccatgatgtgtgtccgccgccggaaccaccggcctaccctgccgagtgaccccccccccaatcgggctatgggggagcccggggagaacccctcctacggtcagcgtgtatcttcttgtacccccctaccacaagagtgccgctcgccgagcgttcccgtaacgcggagcggtctggccgggccttacctctcggctttcgaagtcgtggtggtcggacatattataatgcgagcgagtctgtagccgctgtaccaaccacaatcgacatcacacgacacgagcggactgcgttcagattgtctagatgaggaggagacagacacaacctccccgccccccagtaagcattcgatggtgatctgagacgctccgaaccccagtggtggcgcatgacgtgtaaaaacaaatcctcca

SEQ ID NO: 41571 - protein, 53 aa, Zea mays
  misc_feature: Ceres CLONE 1437199-F
MASGAVPPQRAALLALAAALSGVSFAHRIPPLLVLSAPAGKLLVLLRVADGGS

SEQ ID NO: 41572 - DNA, 688 bp, Zea mays
  misc_feature: Ceres CLONE 1437208-F
  misc_feature: Encodes the peptide sequence at SEQ ID NO. 41573
  misc_feature (314)..(314): n is a, c, t, g, unknown, or other
  misc_feature (364)..(364): n is a, c, t, g, unknown, or other
  misc_feature (368)..(368): n is a, c, t, g, unknown, or other
  misc_feature (382)..(382): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (410)..(410): n is a, c, t, g, unknown, or other
aaagctggagctcaccgcggtggcggccgctctagaactagtggatcccccgggctgcaggaattcgcacgagaccattacctagaacatcctaatcgaaaaagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccngcctccctcgaggagctctccgtcgcgggggcgcgccctctctcgctcgngggnctggccccgctccnggggctcggnnngctctccctcccgaanaccgcctctcggggggccgccgccctcgccgccgtcgccgagggatggggggcccccgtttgcccaccttcaaactaaggaaccaacgggttcccggaaggtccagggaactctcgccccattccccgggggtcccgggccaagtccccacaacctgttccacgggccccctcccccaaggtgaaggggggcccagggagaaggggttttccccgtttattccccccccccaaataccctccgggggcgcccaacccttagggagaaacaaggttttt

SEQ ID NO: 41573 - protein, 178 aa, Zea mays
  misc_feature: Ceres CLONE 1437208-F
  misc_feature (54)..(54): Xaa is any aa, unknown, or other
  misc_feature (72)..(72): Xaa is any aa, unknown, or other
  misc_feature (80)..(80): Xaa is any aa, unknown, or other
  misc_feature (86)..(86): Xaa is any aa, unknown, or other
MAAAAAGEDDAAWERAISAATKSTSAPKTLTLDGAVKSSTGGLPSAALLERFAXLPRGALRRGGAPSLARGXGPAPGARXALPPEXRLSGGRRPRRRRRGMGGPRLPTFKLRNQRVPGRSRELSPHSPGVPGQVPTTCSTGPLPQGEGGPREKGFSPFIPPPQIPSGGAQPLGRNKVF

SEQ ID NO: 41574 - DNA, 735 bp, Zea mays
  misc_feature: Ceres CLONE 1437214-F
  misc_feature: Encodes the peptide sequence at SEQ ID NO. 41575
aaagctggagctccccgcggtggcggccgctctagaactagtggatcccccgggctgcaggaattcgcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggcgaagcgcggcgcgcgcgtggtgatcccggcgcggagcgccaaggcggcggaggacgtgcgcgcgcgcatcgtggccgagtgccccgccgccgccgtcctcgtgctcccgctcgacctcagctcgctcgcgtccgtgcgcgccttcgccgacaggttcctagcgctcggcctcccgctccacctcctcatgtacgtacgttcgtcgatcggggcgccgccaccgccgccctcgtccaagtcacagtacatgtatgtatgcgtatgtgtgtgatgcctgtgcgcgcgcgcgtgcagaaacaacgccggcaagttctcgcacgggcagctggcgctctcgaaggacgcgtggagatgacctttcgcacaactacctgggccactccctgctgacga

SEQ ID NO: 41575 - protein, 142 aa, Zea mays
  misc_feature: Ceres CLONE 1437214-F
MLRAARYLLGSPGASGFGSRSTAEEVTPDLGATTAIITGATSGIGAETARVLAKRGARVVIPARSAKAAEDVRARIVAECPAAAVLVLPLDLSSLASVRAFADRFLALGLPLHLLMYVRSSIGAPPPPPSSKSQYMYVCVCV

SEQ ID NO: 41576 - DNA, 699 bp, Zea mays
  misc_feature: Ceres CLONE 1437220-F
  misc_feature: Translation starting site: 163
cagaactagtggatcccccgggctgcaggaattcgcacgagaccattacctagaacatcctaatcgaaaaaaccatattattgagaccaacaggcaacatagaaagtggaatccagtgtcaacaacagagcaccactggcgaccaagatattttccctccttatgctccttgctctttctgcatggggtgctaacgcgacaattttccctcaatgctcacaagctcctatagcttcccttcttcccccataccttccatcagtgatagcttcagtatgtagaaaacccagctcttcagccctataggctccaacaagcaatcgcagcaagcaacatacctttatcacccttgttgttccaacaatcgccagccctatctttggtgcagacattggtacaaaccatctggtcacagatgctgcagcaactcatgctacctgtgatcaaccaagtagctctggcaaacctttctccctactctcagcaccaacaagttctgccatccaccaactatctacactgaaccctgctgcttatttgccagcacaactattaccattctgcccgggtgctactcgctcctctcaggacctcccactcgtccttttagccaattgggcggactgaaccccgctgcttattttcggcctgaatactcctgcgtttggccccgttgctgcgggcaacccggcgtgcccg

SEQ ID NO: 41577 - DNA, 672 bp, Zea mays
  misc_feature: Ceres CLONE 1437233-F
  misc_feature: Encodes the peptide sequence at SEQ ID NO. 41578
  misc_feature (672)..(672): n is a, c, t, g, unknown, or other
gctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgcctccaacttcgaccctcttcaggctgctgcggccgactggcgcgacacgctcttctgcgaggtggctcccaacccgccgccccgggagagctgcccgagcccctcagaacgtgatgctgaan

SEQ ID NO: 41578 - protein, 184 aa, Zea mays
  misc_feature: Ceres CLONE 1437233-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASNFDPLQAAAADWRDTLFCEVAPNPPPRESCPSPSERDAE

SEQ ID NO: 41579 - DNA, 720 bp, Zea mays
  misc_feature: Ceres CLONE 1437235-F
  misc_feature: Translation starting site: 206
  misc_feature: SWISSPROT Homolog: EC 2.7.1.20 Adenosine kinase
ctccccgcggtggcggccgctctagaactagtggatcccccgggctgcaggaattcgcacgagaccattacctagaacatcctaatcgaaaaacttcacacccagcgcactcgagctcgagccctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaaggcaaatacatctacattgctggatttttccttacagtgt

SEQ ID NO: 41580 - DNA, 625 bp, Zea mays
  misc_feature: Ceres CLONE 1437245-F
  misc_feature: Encodes the peptide sequence at SEQ ID NO. 41581
  misc_feature (234)..(234): n is a, c, t, g, unknown, or other
  misc_feature (329)..(329): n is a, c, t, g, unknown, or other
aaagctggagctccccgcggtggcggccgctctagaactagtggatcccccgggctgcaggaattcgcacgagaccattacctagaacatcctaatcgaaaaactaaactagtgcggggtataaagctctctccctccgcgcttccgaacagttcacgacgactccaggaggggcgcacttgactttcccctcctcctcctgcgagcaccttcctcgcctcgctctcatggccntcatcagagccctattagagtggcaggtttgtgcgctgagggtgtcgatcactgccagggatgcagaagaggtgaagaggtgctcagaacatcancgcgtgtaccgatgcaaatcgatgccggagccacaggtcgtggcaacggtctccacgaactcaacccctaaatgctgtcccccaactgcccaagtccgggaaacaagcgaaacttttgccggaacacccggggccacaacaagaaacacccggcccccccccttaaaacccaaggggggggggggcccaaaaaaaccccccctggggaaccgggggaaacccccaaacccttccagagagggggggggccccccccaaaaaaaagaaaaaggcccccccgtgaaaaaacaaaaaac

SEQ ID NO: 41581 - protein, 132 aa, Zea mays
  misc_feature: Ceres CLONE 1437245-F
  misc_feature (3)..(3): Xaa is any aa, unknown, or other
  misc_feature (34)..(34): Xaa is any aa, unknown, or other
MAXIRALLEWQVCALRVSITARDAEEVKRCSEHXRVYRCKSMPEPQVVATVSTNSTPKCCPPTAQVRETSETFAGTPGATTRNTRPPPLKPKGGGGPKKPPLGNRGKPPNPSREGGGPPQKKEKGPPVKKQK

SEQ ID NO: 41582 - DNA, 680 bp, Zea mays
  misc_feature: Ceres CLONE 1437247-F
  misc_feature: Encodes the peptide sequence at SEQ ID NO. 41583
  misc_feature (302)..(302): n is a, c, t, g, unknown, or other
  misc_feature (309)..(309): n is a, c, t, g, unknown, or other
  misc_feature (330)..(330): n is a, c, t, g, unknown, or other
aaagctggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcaccccccggcagggtatccttgctgctgatgagtccactggcaccatggggcagcgctttccagcatncatgtcnagaacgttgaagaggacccgncgtgcccctcgtgagctcctattctgctggcctggtgctcttcagtacatcaacgtgtggatcctctttccaggaaaccctgtaccaaagaacagggagggcaagcctttttgttgatttctccaggaaaggaagcgttcctccctgggactcaaggtgaacaagggaccccttgaggttttttgggctgataaaggggaccacccccccaaggcattacaaccttgggaaagcgtttcgcccaaaactaccaaagggaggtgccccctttttgcaaaagggcccctttttttctaaaaatggccccaaaggggccattccgactttgccttcaacctgaacccttcggg

SEQ ID NO: 41583 - protein, 90 aa, Zea mays
  misc_feature: Ceres CLONE 1437247-F
  misc_feature: SWISSPROT Homolog: EC 4.1.2.13 Fructose-bisphosphate aldolase
  misc_feature (43)..(43): Xaa is any aa, unknown, or other
MSAYCGKYKDELIKNAAYIGTPRQGILAADESTGTMGQRFPAXMSRTLKRTRRAPRELLFCWPGALQYINVWILFPGNPVPKNREGKPFC

SEQ ID NO: 41584 - DNA, 695 bp, Zea mays
  misc_feature: Ceres CLONE 1437250-F
  misc_feature: Encodes the peptide sequence at SEQ ID NO. 41585
aaagctggagctccccgcggtggcggccgctctagaactagtggatcccccgggctgcaggaattcgcacgagaccattacctagaacatcctaatcgaaaaacttcacacccagcgcactcgagctcgagccctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtggaaggtcattgattgcaaatctgtcagcggcaactggtacagatctgagcatctaaagagaccagagaactggcactagttgaaaggcaaatact

SEQ ID NO: 41585 - protein, 146 aa, Zea mays
  misc_feature: Ceres CLONE 1437250-F
  misc_feature: SWISSPROT Homolog: EC 2.7.1.20 Adenosine kinase
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGGRSLIANLSAATGTDLSI

SEQ ID NO: 41586 - DNA, 710 bp, Zea mays
  misc_feature: Ceres CLONE 1437251-F
  misc_feature (353)..(353): n is a, c, t, g, unknown, or other
  misc_feature (394)..(394): n is a, c, t, g, unknown, or other
aaagctggagctccccgcggtggcggccgctctagaactagtggatcccccgggctgcaggaattcgcacgagaccattacctagaacatcctaatcgaaaaatcgaagggtcgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcatcgcgacggcaggagagggcaaacccttttcttctcagtactctacttgtctgcgcctggatcccctccgcangaagaatagacatgggtcaagcactcggcttgattcaagtnggatcatcgacagtagccatcaaagaaactttttggaagttggacgaagtcctagagcctggatgccacttcttgcatggtgcaaagggacgcaattcgctgggatctgtcacctgcgggggccccaccttgatccccctgccaaaaaaagaccaagaaaagggcctccccaaggggtggggatttggtgcaaatacggccccttgccaaaaaggccctgaggcttttttacggcttttaaaccccgggggacaaaccccccctatgttttttttatgtcccgggggggggtgttccaaaaaaaacctttgggatc

SEQ ID NO: 41587 - DNA, 634 bp, Zea mays
  misc_feature: Ceres CLONE 1437267-F
  misc_feature: Encodes the peptide sequence at SEQ ID NO. 41588
  misc_feature (1)..(1): n is a, c, t, g, unknown, or other
ncctgtcccaaacgggccccgggctgcaggaattaccacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgggcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagcttgaaga

SEQ ID NO: 41588 - protein, 167 aa, Zea mays
  misc_feature: Ceres CLONE 1437267-F
MSWFGHHHHNQPAPPASGPNQVFKIFCRANENYCLAVRDGAVVLAPVNPKDDHQHWYKDMRFSTRVKDEEGMPAGALVNKATGLAIKHSLGQSHPVKLAPFSPDQEDASVLWTESKDVGKGFRCIRMVNNTRLNFDAFHGDKDHGGVHDGTAVVLWEWCKGENQSLK

SEQ ID NO: 41589 - DNA, 656 bp, Zea mays
  misc_feature: Ceres CLONE 1437288-F
aaagctggagctccccgcggtggcggccgctctagaactagtggatcccccgggctgcaggaattcgcacgagaccattacctagaacatcctaatcgaaaaactctgtctccctctctctgcctgactactgtactaccccatatcttcctccctgctcctgccgctcatgatgagagttttgtgcattaggctgccggctgctcgacagagatcttgagccgtggccgccttcctcctttcccgactgcatgacgacatctcctctcccgccggccccggattcgctccctctgctgatctttcctccctcccttcctacctccagatcctcatcttctgcctcgcttctcggggccctacccgcgcttctgctgcaccgtctgcttcgaagcctacctccacggtattggccctcgggacctctcgatcaaggattgtatgtgacgacacacaccggtacttcttctcccacagggaccgctagtacccgagccttctgatatctcatcgtctctcctgaggacgtttgccgacacgtcagttctacggattctggtgtctacgactcctgtcagcgtgtgcgcgtactggtctgtccttacactacgctcgctctctgctgacctcggtctcaccggggctgacacaaccgc

SEQ ID NO: 41590 - DNA, 667 bp, Zea mays
  misc_feature: Ceres CLONE 1437298-F
  misc_feature: Encodes the peptide sequence at SEQ ID NO. 41591
aagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggct

SEQ ID NO: 41591 - protein, 146 aa, Zea mays
  misc_feature: Ceres CLONE 1437298-F
  misc_feature (49)..(146): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTG

SEQ ID NO: 41592 - DNA, 642 bp, Zea mays
  misc_feature: Ceres CLONE 1437303-F
  misc_feature: Encodes the peptide sequence at SEQ ID NO. 41593
agctccccgcggtggcggccgctctagaactagtggatcccccgggctgcaggaattcgcacgagaccattacctagaacatcctaatcgaaaaaaatcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgactatcgctcacggcggtgtgctcccccatatcaaccctgttctgctgcccaagagacggcggagaagggcgtcagtgtggggagcaagggagcaaagtcgccccaagagggccgcaaat

SEQ ID NO: 41593 - protein, 154 aa, Zea mays
  misc_feature: Ceres CLONE 1437303-F
  misc_feature (31)..(104): Pfam Name: Histone Pfam Description: Core histone H2A/H2B/H3/H4
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPHINPVLLPKRRRRRASVWGAREQSRPKRAAN

SEQ ID NO: 41594 - DNA, 644 bp, Zea mays
  misc_feature: Ceres CLONE 1437304-F
  misc_feature: Encodes the peptide sequence at SEQ ID NO. 41595
  misc_feature (386)..(386): n is a, c, t, g, unknown, or other
tccccgcggtggcggccgctctagatctcgtggatcccccgggctgcaggaattctcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggccgtanaagaagcggggggagggctcgtcaagacgctgcagctggggtcgctcttcgggctctggtacctcttcaacatctacttcaacatctacaacaagcaagttctgaaggttctgccataccctaataacatcaccacagtggcagttgccgttgggagtgccattgctttgtttatgtggatcaccggtatccttaaaaagcccaagaattctgggtgccagctttttgctaatcctcctctagctatcggtcatacag

SEQ ID NO: 41595 - protein, 170 aa, Zea mays
  misc_feature: Ceres CLONE 1437304-F
  misc_feature (85)..(85): Xaa is any aa, unknown, or other
MQSTAAIGLVRPCAARPLPTYPSPRRGAGACSGAAQPILAPRGLCLSARASLLPDSPLEEEYRRCRAGRHVAAAGKVAAADGAVXEAGGGLVKTLQLGSLFGLWYLFNIYFNIYNKQVLKVLPYPNNITTVAVAVGSAIALFMWITGILKKPKNSGCQLFANPPLAIGHT

SEQ ID NO: 41596 - DNA, 774 bp, Zea mays
  misc_feature: Ceres CLONE 1437329-F
  misc_feature: Encodes the peptide sequence at SEQ ID NO. 41597
  misc_feature (1)..(1): n is a, c, t, g, unknown, or other
  misc_feature (23)..(23): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (500)..(500): n is a, c, t, g, unknown, or other
  misc_feature (604)..(604): n is a, c, t, g, unknown, or other
ngggggggggcgcgggggtggtntccccccccnnnntggtaannnnnnnnnaagggggggggcaccatgggggtgcccgcggtggcggccgctctagactagtggatcccccgggctgcaggaattcgcacgagaccattacctagaacatcctaatcgaaaagctttcttagaggtgggttggcttctcctccccctccgtttcctcttccggttcttgaagttctccggggttcggtttcatgggtgagcggatccagatggcggcgtctgatgttgagtacccctgcttcgtcggcggcctcgcctgggtcacggacgaccactgcctccaaaagggcttcagcacctacggcgagctcctccagtccaagatcatcctaggatcgggagacgcaataagtcccgcggcttcggccgtcctcaccttcgccacgggaggaggggatggggcaacccccaccaatggcgtggaaggggaatgaaattttaaaaggggngggacgggggtggggtggcaggggtcgatgggccgcgggcgggcccggggggagaggcgggggcgggggggttaccggcgggtgggccaacttaaaaccccccnaacctacttcccccccccccccccccccctttaattccggcgcggggcgcctacaaggacgggtgacacccccacttccccgctaggccccgcggccccctaacagggggggggagtgcccacggaaggctcgcggcggagcgcccacgccgggggcccgcccgccgccg

SEQ ID NO: 41597 - protein, 74 aa, Zea mays
  misc_feature: Ceres CLONE 1437329-F
MAASDVEYPCFVGGLAWVTDDHCLQKGFSTYGELLQSKIILGSGDAISPAASAVLTFATGGGDGATPTNGVEGE

SEQ ID NO: 41598 - DNA, 596 bp, Zea mays
  misc_feature: Ceres CLONE 1437332-F
  misc_feature: Encodes the peptide sequence at SEQ ID NO. 41599
  misc_feature (513)..(513): n is a, c, t, g, unknown, or other
  misc_feature (519)..(519): n is a, c, t, g, unknown, or other
  misc_feature (520)..(520): n is a, c, t, g, unknown, or other
tccccgcggtggcggccgctctagatccaaaacagggccgggctgcaggaattctcacgagaccattacctagaacatcctaatcgaaaaaaaacgcgtccaaaacattctgcggcctgttggagggcagcaccaagtatcacagtctagctactgcctggcaccagcaagcttctgccctgccccgccccgccgccagaatccgaaaccagtaaaccacagcggcaacaacctcgcggcgcccgcgtggaggcaggcggcgcataaagccagccggcgctgctcctgctgtgcgcaacggtcccctcctcctcctcctcctccgctctcctctccccaaagtaataactagtaaacagagctgcgtccaggcttcttcgatcggtccatggctgtcgtcacgagggacgcggcgtgcctgcccctcgtcctcctgctcctagtcttctccgcggccccgtctccggctgacggctgcgaccgctgcgtgcgccggtccaaggccacctactnacaggnnctctcgctcgccctcaacgccgggtcgtgcgggtacggctccttggggcgcgtccctcaacggggggctggctcgc

SEQ ID NO: 41599 - protein, 69 aa, Zea mays
  misc_feature: Ceres CLONE 1437332-F
  misc_feature (42)..(42): Xaa is any aa, unknown, or other
  misc_feature (44)..(44): Xaa is any aa, unknown, or other
MAVVTRDAACLPLVLLLLVFSAAPSPADGCDRCVRRSKATYXQXLSLALNAGSCGYGSLGRVPQRGAGS

SEQ ID NO: 41600 - DNA, 627 bp, Zea mays
  misc_feature: Ceres CLONE 1437344-F
  misc_feature: Encodes the peptide sequence at SEQ ID NO. 41601
  misc_feature (423)..(423): n is a, c, t, g, unknown, or other
  misc_feature (453)..(453): n is a, c, t, g, unknown, or other
  misc_feature (457)..(457): n is a, c, t, g, unknown, or other
  misc_feature (459)..(459): n is a, c, t, g, unknown, or other
  misc_feature (460)..(460): n is a, c, t, g, unknown, or other
  misc_feature (477)..(477): n is a, c, t, g, unknown, or other
  misc_feature (482)..(482): n is a, c, t, g, unknown, or other
  misc_feature (490)..(490): n is a, c, t, g, unknown, or other
  misc_feature (496)..(496): n is a, c, t, g, unknown, or other
aagctggagctccccgcggtggcggccgctctagaactagtggatcccccgggctgcaggaattcgcacgagaccattacctagaacatcctaatcgaaaaaatgagtccgcgcccacggccgaggcagctgcaggcagcggcccggccggcggagaagggcggaagggcaaggcgcccaagggcgggcccgagaacggcaagttccggtaccgcggcgtgcggcagcggagctggggcaagtgggtggcggagatccgcgagccgcggaagcgctcccgcaagtggctcggcaccttcgccaccgccgaggacgccgcgcgcgcctacgaccgcgccgcgctcctcctctacggcccccgcgcgcacctcaacccctcactcccgccgccgactacgctcgccgcgacgagctcgcacccgnactcctcccctcgcacgtcgtctgccccgncagngnntcgcccgcttctggcgngcccngcactggnacaggntctcagcggacgtgctcctggcaccgattccactaccaccatcagttccagcggcgtctcctggcgcagccgaccccacactatactacgccacacgggaccggggtcacgtggacaccagtgggcgacag

SEQ ID NO: 41601 - protein, 208 aa, Zea mays
  misc_feature: Ceres CLONE 1437344-F
  misc_feature (68)..(119): Pfam Name: AP2 Pfam Description: AP2 domain
  misc_feature (141)..(141): Xaa is any aa, unknown, or other
  misc_feature (151)..(151): Xaa is any aa, unknown, or other
  misc_feature (152)..(152): Xaa is any aa, unknown, or other
  misc_feature (153)..(153): Xaa is any aa, unknown, or other
  misc_feature (159)..(159): Xaa is any aa, unknown, or other
  misc_feature (163)..(163): Xaa is any aa, unknown, or other
  misc_feature (165)..(165): Xaa is any aa, unknown, or other
AGAPRGGGRSRTSGSPGLQEFARDHYLEHPNRKNESAPTAEAAAGSGPAGGEGRKGKAPKGGPENGKFRYRGVRQRSWGKWVAEIREPRKRSRKWLGTFATAEDAARAYDRAALLLYGPRAHLNPSLPPPTTLAATSSHPXSSPRTSSAPXXXRPLLAXPALXQXLSGRAPGTDSTTTISSSGVSWRSRPHTILRHTGPGSRGHQWAT

SEQ ID NO: 41602 - DNA, 663 bp, Zea mays
  misc_feature: Ceres CLONE 1437360-F
  misc_feature: Encodes the peptide sequence at SEQ ID NO. 41603
aaagctggagctccccgcggtggcggccgctctagaactagtggatcccccgggctgcaggaattcgcacgagaccattacctagaacatcctaatcgaaaaattttgcaggaatccaaatcattcgccctctagatcgtgctgccatgtctctgtccacccccaccaccttgtgttccgcgacgtctcctctctctctctctctctctagagttgctgatagtttttttactaactcactccaccaaatccgttccaattccggtgcaaactgcttgttcgtgcgagacaataaagccatggaactagctaacccttgctgaactgtggaatggtttctgagcagagcgtggcggagctgaagcagaccctgctggctaccacgctggagctggaggcggcgagggaggagctgacgcggaaggagcagagcatcgccaagctgtcggacctggtgcgcgaggtggccaaagagcgcgacgacgcgcgggaccaggcgcagaagctccgcctactcgctgcccaggccgcgccgccgctcgtcacgttcagcgtcaccgactccgactgcagcctcgcgtcgtccccccgtggacccgttcttcgaccccgtcacgtccgccgacacaggcggcgctgcaagttcagccccgccacgccgcc

SEQ ID NO: 41603 - protein, 110 aa, Zea mays
  misc_feature: Ceres CLONE 1437360-F
MVSEQSVAELKQTLLATTLELEAAREELTRKEQSIAKLSDLVREVAKERDDARDQAQKLRLLAAQAAPPLVTFSVTDSDCSLASSPRGPVLRPRHVRRHRRRCKFSPATP

SEQ ID NO: 41604 - DNA, 690 bp, Zea mays
  misc_feature: Ceres CLONE 1437361-F
  misc_feature (690)..(690): n is a, c, t, g, unknown, or other
aagctggagctccccgcggtggcggccgctctagaatagtggatcccccgggctgcaggaattcgcacgagaccattacctagaacatcctaatcgaaaaatctccgcgcattttatatgcaggcttgcgcctgtcacttctcccctggtcttgctccccctcgatcccgcatcagtgcgtcacattcaccgggaatggcacgctcaaggtcccaggcactggtcctcccgtcgccgatgactgggaacagctgccaaaacatttcaagggtggggaaaaaacaaggggttaataatttcaccttgggcaaccgaaaccccggaaagccccccccaccgcccggtttaacccaaagcctaagggaagaaatcccctcctcccatcgaaaaaaaaattcgggaaatttaaaagggggctaacttttggaacctggcacccccgaaaaagcaccggggttttgtaaaaaaagggggccaaaaaaaaaaaaccgagaaacgtgtttctccaaaaaaccccccccccccccccccccaaaatttttcccaaaaagggggttataaaaaaaggggtaaaccccctttaaaaaaaaaaaaatcccccccccccggggggggctcccccaaaattgggggcccccttataaaaacccccccaaaaaaaaaaaaaaaaaaaaaagggggggcccaaan

SEQ ID NO: 41605 - DNA, 666 bp, Zea mays
  misc_feature: Ceres CLONE 1437363-F
  misc_feature: Encodes the peptide sequence at SEQ ID NO. 41606
aagctggagctccccgcggtggcggccgctctataactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgtaccattggagatgactcgtcatgtttcaatgatatcgatttccttgtcacctaaggagcataacaagaattcacctg

SEQ ID NO: 41606 - protein, 123 aa, Zea mays
  misc_feature: Ceres CLONE 1437363-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISISLSPKEHNKNSP

SEQ ID NO: 41607 - DNA, 650 bp, Zea mays
  misc_feature: Ceres CLONE 1437365-F
  misc_feature: Encodes the peptide sequence at SEQ ID NO. 41608
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
aaaagctggagctccccgcggtggcggccgctctagaactagtggatcccccgggctgcaggaattcgcacgagaccattacctagaacatcctaatcgaaaaacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggccccgcatcggggaaccttcgggggaagcccccaaaaacctcggaagggggccgggggnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnct

SEQ ID NO: 41608 - protein, 125 aa, Zea mays
  misc_feature: Ceres CLONE 1437365-F
  misc_feature (29)..(172): Pfam Name: SOR_SNZ Pfam Description: SOR/SNZ family
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKAPHRGTFGGSPQKPRKGAGG

SEQ ID NO: 41609 - DNA, 631 bp, Zea mays
  misc_feature: Ceres CLONE 1437366-F
  misc_feature: Encodes the peptide sequence at SEQ ID NO. 41610
aaagctggagctccccgcggtggcggccgctctagaactagtggatcccccgggctgcaggaattcgcacgagaccattacctagaacatcctaatcgaaaacagatgcgtccaaattcctcatattttctctcctcccctggtcccttctcgttctcgcccgcgtaattcctctctggcgtctaccaaaagcggagcaaccgaggcaagaaaaaggggtgggcgaggaaaagcgattaggcttctcttccagttcctgattcagtctgagaaacaatggatatctgaagcatgaaaagtcaacccacctcactcttttaaacagttcggttaacacacttaatggctgcggtgtttgcatgacattctctttgagcttatatgggagcagtggctgtattggtaatttaagcagatctcagtcacttccgattctaaaacgaagcgatctttgaaaagaaaattccgggatcctcaactggaaaaagaaaaacaatggcaatcgggtcttaaaaccaagggaaaaaaaatgtttcccatttttgttttcccttgaggggaaaaatccttttcttttccccattttaaaagcccaagaaccttaaaaaccccaatggaaaaaaacggggaa

SEQ ID NO: 41610 - protein, 31 aa, Zea mays
  misc_feature: Ceres CLONE 1437366-F
MTFSLSLYGSSGCIGNLSRSQSLPILKRSDL

SEQ ID NO: 41611 - DNA, 740 bp, Zea mays
  misc_feature: Ceres CLONE 1437371-F
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
aaactggagctccccgcggtggcggccgctctagaactagtggatcccccgggctgcaggaattcgcacgagaccattacctagaacatcctaatcgaaaaacttacctggagagaaatttgctattttgccactctcaattttggctgcctgttattataccatcccgtgtctatgactagtgggaccgtctgtgtctatgatttatgggttcgatggtatattggcgaagcccacaaatgataatggcaaaattgtcaatggcctaggccagtgactctcattgcacttggacggtaggccagtgactctcattgcacttggagggtacgctgacttaccatctccccaagggtacgctgacttaccatctccccaagtgggagagtggacgtcataatttgtgttagaggggtcataatttctccagtgactctcattgcacttggagggtacgctgacttaccatctccccaagtgggagagtggacgtcataatttgttaccatctccccaagtgggagagtggacgtcataatttgtgttagacttaccatctctccaagtgggagagtggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41612 - DNA, 685 bp, Zea mays
  misc_feature: Ceres CLONE 1437377-F
cagagctggagctccccgcggtggcggccgctctataactagtggatcccccgggctgcaggatttcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaatgcgccccgcaggcccaccttcgtgggcatctggaagaagcgtgcggtggagcagtactcgccgatcccgtacgtggcgacgctgctgaactgcat

SEQ ID NO: 41613 - DNA, 670 bp, Zea mays
  misc_feature: Ceres CLONE 1437381-F
  misc_feature: Translation starting site: 201
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataagatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtggggcgcgacatctccgggcgggcacgtgaaccctggccgggacttcggcgccttcgtgggcggcaacctcaccctgttccgggggcttcctgtactgggttggcgcaacttgctggggtccacccgggggggggttccctggctccccttccccaaccgggggggcaaggcccacgggcccccttccggggctgaacgggcgttgtcccgttgtggggaaaggccccgggggcctgaaaaaacca

SEQ ID NO: 41614 - DNA, 790 bp, Zea mays
  misc_feature: Ceres CLONE 1437386-F
agtgtgggtgaaggttgcggcggtcgggaatgcgcctgactttggctccaattgccgccgcccccccccctcggcattgcccttccacggcgccgtcggtgcgcgggggcgtctaggaatagtggatcccccgggctgccggaattcgcacgagaccattacctagaactcctaatcgaaaatccccaaatcggcctacgcccacggttccacctcctcggtccacgaggtgaggaaaccctagcgaccgaccatggcgttgctcccgcgcaccgcgcggctggccctcctttccaccccgcgggcgtactccgctgccgctgctgcggggcgcctcccccgacgtccccaggggccatacggggggcccccccccccccgcgatgtccaaagaggcccgaatttcttgggtctctcaaggggggacgaacctggattaaactgggccccgcgaagagggttttaatctgggtcccagggacccttccggcgctccccctgttttttgccggttggagaaaaagaaaaaaaccccccgggggcgggtcccccctttaaaaaaattttacacgaggggtttcgcgcggttttttttatttatccccgggtccgccccggctcgcgtttcgcgtatttgggcgtacctctttcgcgcggggcggttttttcccaaaaaaaaaaatggggtggtgcagcgcccccccccggggggggttttttgaaaaaaaaacaccgcctagaacccccagggggggggggtttttcttccttatgcggccccacccctccg

SEQ ID NO: 41615 - DNA, 652 bp, Zea mays
  misc_feature: Ceres CLONE 1437390-F
  misc_feature: Encodes the peptide sequence at SEQ ID NO. 41616
tggagctccccgcggtggcggccgctctagaactagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagtgacggcaggcatggtgagccgtgaaaatttgcacctggtgctggacccggcgtctctgggcgcgccttgggccgacccgtccgccgcagagatcccgccgcagctcctcgccgcgctgggagagtacctctcctccgcccgcggcgacgtcgagacggaggcggacgacgagttcatgatgcactagttcaaggtgcggcggcgcgcgcgcgcgcggagccacaactggacagcgtgcccctacgcgcacccgggggaggccgcgcggcggcgggacccgcaccgcgtggcctacgcgggggagccgtgcccggacttccggcgccgcccgggcccgggcgccgcgtgcccgcgcggggccgcctgcccgctcgcgcacggcaccttcgagctgtggctccacccgtcccgctaccgcacgcgcccctgccgcgcgagcgctgcctgcc

SEQ ID NO: 41616 - protein, 58 aa, Zea mays
  misc_feature: Ceres CLONE 1437390-F
MVSRENLHLVLDPASLGAPWADPSAAEIPPQLLAALGEYLSSARGDVETEADDEFMMH

SEQ ID NO: 41617 - DNA, 725 bp, Zea mays
  misc_feature: Ceres CLONE 1437394-F
  misc_feature: Encodes the peptide sequence at SEQ ID NO. 41618
agagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaagacctagtcgagcaggtgaggcacgcggcccgggacggtgggcttcttccggctggtggaacccgggagggccggaccaacccaaaggccggatggttccggggggggcccaagttcaccaggggcccccgggaagggaaaacagggcccctactcgagggaccttccttgcaacctgggcttttcccccaaaattcaacctctttcaagggttttttgggccaaatgggggcgaaaccccttttttggggagggggcctccaaaccccccccccccgggaggagatttcccgaacccctttaggaaacgttgtttggggaaaccgcgg

SEQ ID NO: 41618 - protein, 192 aa, Zea mays
  misc_feature: Ceres CLONE 1437394-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAARDGGLLPAGGTREGRTNPKAGWFRGGPKFTRGPREGKTGPLLEGPSLQPGLFPQNSTSFKGFLGQMGAKPLFWGGGLQTPPPREEISRTPLGNVVWGNR

SEQ ID NO: 41619 - DNA, 692 bp, Zea mays
  misc_feature: Ceres CLONE 1437403-F
  misc_feature: Encodes the peptide sequence at SEQ ID NO. 41620
aagctggagctccccgcggtggcggccgctctagaactagtggatcccccgggctgcaggaattcgcacgagaccattacctagaacatcctaatcaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcaacaacacaaactctttcatttaaccaatttggcccactgaaccccgctgcttattttgcgcaccaatactactac

SEQ ID NO: 41620 - protein, 162 aa, Zea mays
  misc_feature: Ceres CLONE 1437403-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSQQQQFLPFNQLSTLNRAAYLQQQLLPFSQLATAYSQQHKLFHLTNLAH

SEQ ID NO: 41621 - DNA, 655 bp, Zea mays
  misc_feature: Ceres CLONE 1437405-F
  misc_feature: Encodes the peptide sequence at SEQ ID NO. 41622
tggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcaaggaggctgcccagctggtcgccgcctccgccgtcgagaccccgaacgaggagaccgctgctccggcggtggagaccgaggtcttcttcgctaaggagccggagccggtggaggcctagactgatactgacaccaaggaggccgaggccgttgctgagcctaccgaggcatagcccaaagaagcagagccggaggccgccgcgccggcagcagagacggacgtcagggaatcataagacgaagccgctaccgcggcaacaaagacggaaggctgctggctccccgttcccagggttgctaaaacaaaaaaaaagcccccaaaaccccaaaaagtgggggggtgtgggggctcttgggaaagaagaaaagaggaaccc

SEQ ID NO: 41622 - protein, 53 aa, Zea mays
  misc_feature: Ceres CLONE 1437405-F
MAAVEVQVPTAAPVKEAAQLVAASAVETPNEETAAPAVETEVFFAKEPEPVEA

SEQ ID NO: 41623 - DNA, 686 bp, Zea mays
  misc_feature: Ceres CLONE 1437408-F
  misc_feature: Encodes the peptide sequence at SEQ ID NO. 41624
aaagctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacaggcagatctcgcggtccgagctggcggcgctgttcgagggcgtgggccacgccgtgaccgacgacgaggtgtcgcgcatgatggaggaggcggacgcggacggcgacggctgcatcagcctgcccgagttcgccgcgctcatggagtccgcgtccgccgacgccgccgccgtctaagaggacctgcgccacaccttcatggtcttcgacgccaacggcaacggcctcatcacgcccgcc

SEQ ID NO: 41624 - protein, 127 aa, Zea mays
  misc_feature: Ceres CLONE 1437408-F
  misc_feature (92)..(120): Pfam Name: efhand Pfam Description: EF hand
  misc_feature (56)..(84): Pfam Name: efhand Pfam Description: EF hand
  misc_feature: SWISSPROT Homolog: EC 2.7.11.1 Non-specific serine/threonine protein kinase
MGKVRSFFSRSRSGKRGSARRAGSSSPHSSAASAPPSPSPLPRRSPSSSSTTTRDETERVFRKFDANGDRQISRSELAALFEGVGHAVTDDEVSRMMEEADADGDGCISLPEFAALMESASADAAAV

SEQ ID NO: 41625 - DNA, 744 bp, Zea mays
  misc_feature: Ceres CLONE 1437412-F
  misc_feature: Encodes the peptide sequence at SEQ ID NO. 41626
  misc_feature (709)..(709): n is a, c, t, g, unknown, or other
aaagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcgctatgtgaaaacccaattcttcaaccctacaggatccaacaggcaattgcagctggcatcttacctttatcacccttgttcctccaacaatcatcagccctattacagcagtttacttttggtgcatttattggcacaaaacatcagggccacaacaactacaacaaacttgtgctagccaaaccttgctggcttactctcagcaacatcagttttcttccattcaaaccaactagctggcattgaaactccggctttctattttgaaacaacaaccacctaccattccaccaagtattctgttgcccacccccccgccatttttttctcttcaccccactgtaaagcattggaactcccccgctctattttagggggggcacaaatttttttactttttcccccgctcagngggggggtgaacccctggttcctttttttagcccg

SEQ ID NO: 41626 - protein, 127 aa, Zea mays
  misc_feature: Ceres CLONE 1437412-F
MAAKIFCLLMLLGLSASAATATIFPQCSQAPIASLLPSYLSPAVSSLCENPILQPYRIQQAIAAGILPLSPLFLQQSSALLQQFTFGAFIGTKHQGHNNYNKLVLAKPCWLTLSNISFLPFKPTSWH

SEQ ID NO: 41627 - DNA, 632 bp, Zea mays
  misc_feature: Ceres CLONE 1437417-F
  misc_feature: Encodes the peptide sequence at SEQ ID NO. 41628
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcgggcgcgctggggctcgggggcctgtctccctcacgtgctcgccaaacggcgcggcaggggtccagcgcaccccgatacttgaaggagcccaccccagaatgcgagc

SEQ ID NO: 41628 - protein, 142 aa, Zea mays
  misc_feature: Ceres CLONE 1437417-F
  misc_feature (44)..(141): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGALGLGGLSPSRARQTARQGSSAPRYLKEPTPECE

SEQ ID NO: 41629 - DNA, 704 bp, Zea mays
  misc_feature: Ceres CLONE 1437418-F
  misc_feature: Encodes the peptide sequence at SEQ ID NO. 41630
agagctggagctccccgcggtggcggccgctctagaactagtggatcccccgggctgcaggaattcgcacgagaccattacctagaacatcctaatcgaaaaattccgtcgtcgtcatcagcagcttctgcttgctctgggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctccctcgccccaggtcgttcgcggcgaaaggacgagtgttctgcctgttcgagggggtgctggacaaccctgggtcgtctgagccagcagcacgggctgtcaaagcaaggcgccaacgagttgctcctcgtcatcaagggctaacagaagttggggaacgcgggccctaaccggccagtttaatgcttgcccagtttacggggtccaacccctttgtccctttgaaaaagcaccccaatcccttggttttcaatccgaccccagagggagggggcgccccctttggggggaaccccccccaagg

SEQ ID NO: 41630 - protein, 119 aa, Zea mays
  misc_feature: Ceres CLONE 1437418-F
MLAVFSGQVVEVPAELVAAGSRTPSPKTKASQLVGRFLAASEPAVSVQLGDHGHLAYSHTNQALPRPRSFAAKGRVFCLFEGVLDNPGSSEPAARAVKARRQRVAPRHQGLTEVGERGP

SEQ ID NO: 41631 - DNA, 731 bp, Zea mays
  misc_feature: Ceres CLONE 1437419-F
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (676)..(676): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcattcatggtgggcgttcctcctgctcgccggcgtggttgctggtcgtagcaaccacggccggggcgggaggacggagtggtctaacgggaccgcaaggagggacctgcggtggtgcaagcacggcctgccaatggcaatacggaaaggacaccccgtcggagagggaaatgccagagacgagtgccgcgaggcggcaccagcaaagtttaaccggggcaaggaaggcgacagcggccgtgggacgcctacgtctcccgctccgggaaaggggggaaatggccggccccgtgggcttgcccccccaccaaggggcaaccgttgggagaaacccacgatggctgtgagggggggggcgcccgccccccccggaaatggccgtcaaatttggagacaagaatatccgccgtcccgccaccaaaannnacaccggcgcaaagntcccccgggagnaaagggcgagccccccccccccggggaattggtggaaaaagcg

SEQ ID NO: 41632 - DNA, 678 bp, Zea mays
  misc_feature: Ceres CLONE 1437420-F
  misc_feature: Pfam Name: PEX11 Pfam Description: Peroxisomal biogenesis factor 11 (PEX11)
aaagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagcgaaggccgggacaagatctgcagggcgatccagtacggctccaaagtcgtaagcaacgggcagcctggcactgcgcagg

SEQ ID NO: 41633 - DNA, 696 bp, Zea mays
  misc_feature: Ceres CLONE 1437421-F
  misc_feature: Encodes the peptide sequence at SEQ ID NO. 41634
agagctggagctccccgcggtggcggccgctctagaactagtggatcccccgggctgcaggaattcgcacgagaccattacctagaacatcctaatcgaaaaagagcgcaagatgttcggcttcgggcaccacggccaccacggccagaacccgccggcgcaccccccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgaacagggccacggcggcgtgcacgacggcaccaccgtggtgctgtgggagtgggccaaaggagacaaccagagctggaagatccctgcctggggcgacgaggcctacgccgcgggaagcagcagcgccgcccacgcggcccgctt

SEQ ID NO: 41634 - protein, 194 aa, Zea mays
  misc_feature: Ceres CLONE 1437421-F
MFGFGHHGHHGQNPPAHPPAHGGVHQPTFKIFCKADEGYCLTVRDGNVVLAPANPRDEHQHWYKDMRFSTQVKDEEGNPAFALVNKATGLAIKHSLGQSHPVKLVPFNPEYQDESVLWTESGDVGKGFRCIRMVNNIRLNFDAFHGEQGHGGVHDGTTVVLWEWAKGDNQSWKIPAWGDEAYAAGSSSAAHAAR

SEQ ID NO: 41635 - DNA, 496 bp, Zea mays
  misc_feature: Ceres CLONE 1437427-F
  misc_feature (238)..(238): n is a, c, t, g, unknown, or other
  misc_feature (265)..(265): n is a, c, t, g, unknown, or other
  misc_feature (266)..(266): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (346)..(346): n is a, c, t, g, unknown, or other
  misc_feature (351)..(351): n is a, c, t, g, unknown, or other
  misc_feature (354)..(354): n is a, c, t, g, unknown, or other
  misc_feature (358)..(358): n is a, c, t, g, unknown, or other
  misc_feature (383)..(383): n is a, c, t, g, unknown, or other
  misc_feature (389)..(389): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (423)..(423): n is a, c, t, g, unknown, or other
  misc_feature (424)..(424): n is a, c, t, g, unknown, or other
  misc_feature (427)..(427): n is a, c, t, g, unknown, or other
  misc_feature (429)..(429): n is a, c, t, g, unknown, or other
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcacccgtccccctgcagctgtgctctgggttggagggaggtgaacttcnagggaaccggaggggcaaaaaatttanncccaaattttcccccgaagaagaaaaaaaaaatttttttttttgtgggggggccgcccctttttttttttttccnnnggnggggnggnggcnccccccccccccccccccgcccccngttggngggtgtgtgggggggcgggnnnnnnnnnnnnggnncgngncgggggcgcccccccccnttttttttttttttaccccccccccccccccccccttggtttttttttt

SEQ ID NO: 41636 - DNA, 696 bp, Zea mays
  misc_feature: Ceres CLONE 1437433-F
  misc_feature: Encodes the peptide sequence at SEQ ID NO. 41637
aaagctggagctccccgcggtggcggccgctctagaactagtggatcccccgggctgcaggaattcgcacgagaccattacctagaacatcctaatcgaaaaaccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagggcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgcccaggaacatgagctttgagtccttgagatcatccatcatttcgtcgagatactggaccgctatttttgcagtgtatgtgagttgggatttgatattcaattttcataaggcctactacatactggaaagaagatctcatcccttgtgaaacttcagaaatctagcaaagagaaatgttgcaagaacttattgcttccagaggattc

SEQ ID NO: 41637 - protein, 78 aa, Zea mays
  misc_feature: Ceres CLONE 1437433-F
  misc_feature (1)..(79): Pfam Name: Clat_adaptor_s Pfam Description: Clathrin adaptor complex small chain
MINFVLLISRQGKVRLTKWYSPYTQKERTKVIRELSGLILTRGPKLCNFVEWRGYKVVYRRYASLYFCMCIDAQEHEL

SEQ ID NO: 41638 - DNA, 708 bp, Zea mays
  misc_feature: Ceres CLONE 1437435-F
  misc_feature: Encodes the peptide sequence at SEQ ID NO. 41639
  misc_feature (396)..(396): n is a, c, t, g, unknown, or other
  misc_feature (397)..(397): n is a, c, t, g, unknown, or other
  misc_feature (406)..(406): n is a, c, t, g, unknown, or other
  misc_feature (513)..(513): n is a, c, t, g, unknown, or other
  misc_feature (541)..(541): n is a, c, t, g, unknown, or other
  misc_feature (553)..(553): n is a, c, t, g, unknown, or other
  misc_feature (560)..(560): n is a, c, t, g, unknown, or other
  misc_feature (587)..(587): n is a, c, t, g, unknown, or other
  misc_feature (654)..(654): n is a, c, t, g, unknown, or other
  misc_feature (666)..(666): n is a, c, t, g, unknown, or other
agctccccgcggtggcggccgctctagaactagtggatcccccgggctgcaggaattcgcacgagaccattacctagaacatcctaatcgaaaaaccccgacggtgaattccccattcacatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaaacactccagcagaacgccgcaccactacgatcgacctctcctccgacgagagccgccgccgcctcccctcataggtggtgtaccnngagcagcangcagcagtgcgtccaggcttgcgagcgccggcgacagcagcgcggcggcagccgtgactccaacgtcaacgaagacgacagcgacgggcggtgcagatgaaatgccngcgccacagcgatcggcaggcgaagcantggtgcgtgcancgctgcnagcgtaacaacaaggagaagacgccgnccgcgacaacaacacagcggccggtgccagagagatgccagcacacaacaactcgcaagcgaagcantggtgcctgcanccctgcaagctaaccaacagaggagcccgccgcgacaaaaaa

SEQ ID NO: 41639 - protein, 126 aa, Zea mays
  misc_feature: Ceres CLONE 1437435-F
  misc_feature (71)..(71): Xaa is any aa, unknown, or other
  misc_feature (74)..(74): Xaa is any aa, unknown, or other
  misc_feature (119)..(119): Xaa is any aa, unknown, or other
  misc_feature (123)..(123): Xaa is any aa, unknown, or other
  misc_feature (125)..(125): Xaa is any aa, unknown, or other
MATALLRRALHLRRVLPSPAVTAAASQRLIPAFSTTPTPTPKHSSRTPHHYDRPLLRREPPPPPLIGGVPXAAXSSASRLASAGDSSAAAAVTPTSTKTTATGGADEMPAPQRSAGEAXVRAXLXA

SEQ ID NO: 41640 - DNA, 668 bp, Zea mays
  misc_feature: Ceres CLONE 1437441-F
  misc_feature: Encodes the peptide sequence at SEQ ID NO. 41641
aagctggagctccccgcggtggcggccgctctagaactagtggatcccccgggctgcaggaattcgcacgagaccattacctagaacatcctaatcgaaaaagatccacaacaaatagcgaaaccctagcccaaactcgaccgcctctgctataagtagctccactctctctcctccaagcctaccccagccgccgccgccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacaagaaggtgctcgaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacaaggagaccatggagatgctcgctgccctcggcatggccgacctgcccggcgttgagcgccaggctgaggtctccaacgcccccgcctacggccgcccgcagtacggtggtccccgccgtgaccgcgtt

SEQ ID NO: 41641 - protein, 142 aa, Zea mays
  misc_feature: Ceres CLONE 1437441-F
  misc_feature (1)..(122): Pfam Name: Ribosomal_S17e Pfam Description: Ribosomal S17
MGRVRTKTVKKTSRQVIEKYYSRMTLDFHTNKKVLEEVSILPSKRLRNKVAGFSTHLMRRIQRGPVRGISLKLQEEERERRMDFVPEKSALEVEEIRVDKETMEMLAALGMADLPGVERQAEVSNAPAYGRPQYGGPRRDRV

SEQ ID NO: 41642 - DNA, 727 bp, Zea mays
  misc_feature: Ceres CLONE 1437458-F
  misc_feature: Encodes the peptide sequence at SEQ ID NO. 41643
  misc_feature (282)..(282): n is a, c, t, g, unknown, or other
  misc_feature (334)..(334): n is a, c, t, g, unknown, or other
  misc_feature (727)..(727): n is a, c, t, g, unknown, or other
aaagctggagctccccgcggtggcggccgctctagaactagtggatcccccgggctgcaggaattcgcacgagaccattacctagaacatcctaatcgaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctnggttgctgcgagaggtccgggccttcgtgggatcttgaaaattgaatgttcntatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagcccatctgatatctctgtcgtcatccccatcctagtagcgtagaaacacctgcattttcattttgatctccctaatccctccggctagctgctttccagtgaccaaagatatcaaagaccacttcccgtcttcctccggtggctgtctgtcatctggctctgaaacgatggcagtccttgcaagtgctgctgctgcccctcccctgtctctgtgattggggtcgagggatttgagaagcgcttgn

SEQ ID NO: 41643 - protein, 51 aa, Zea mays
  misc_feature: Ceres CLONE 1437458-F
  misc_feature (1)..(51): Pfam Name: AdoMetDC_leader Pfam Description: S-adenosyl-l-methionine decarboxylase leader peptide
MESKGGKKKSSSSRSSLMYEAPLGYSIEDIRPAGGIKKFSAAYSNCARKPI

SEQ ID NO: 41644 - DNA, 649 bp, Zea mays
  misc_feature: Ceres CLONE 1437465-F
  misc_feature: Translation starting site: 383
agagctggagctccccgcggtggcggccgctctagaactagtggatcccccgggctgcaggaattcgcacgagaccattacctagaacatcctaatcgaaaattttctcgcgctcctaccgccgccgcttcgttctctaaccttggctcccgctccctccgcaggagcatctcaacaccgccttgagaaccccccaactcgccggctgcagccatggtaagatctccctcccccttactctctcgcctgttgcatcttcgctgccctgcagccatggatttggcgtcgcccttgcgaactcctgacgtgcaacgggccttgtttctggttccaggtgaaatattcgacggagccaaccaaccccaccaagtcaaccaaggccatgggccgtgacctacgtgttcacttcaagaacacccgtgagacagcttttgcccctaggaggtgtcactcaccaaggccaaaagtaccttgaggatgtgattgcccacaagcaggccatccccttccgcaggttttgtggcggggttggaacgtcccgctccagctaagtctcctccctccaaatgggaaaagaaacccggccccgccaaaacctgctaaaattcattccaaaacctttccacaaaaatggtgaaaagcaatcgcc

SEQ ID NO: 41645 - DNA, 655 bp, Zea mays
  misc_feature: Ceres CLONE 1437466-F
  misc_feature: Encodes the peptide sequence at SEQ ID NO. 41646
tggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcgc

SEQ ID NO: 41646 - protein, 108 aa, Zea mays; identical to SEQ ID NO: 16131
  misc_feature: Ceres CLONE 1437466-F

SEQ ID NO: 41647 - DNA, 747 bp, Zea mays
  misc_feature: Ceres CLONE 1437478-F
  misc_feature: Encodes the peptide sequence at SEQ ID NO. 41648
  misc_feature (292)..(292): n is a, c, t, g, unknown, or other
  misc_feature (303)..(303): n is a, c, t, g, unknown, or other
  misc_feature (343)..(343): n is a, c, t, g, unknown, or other
  misc_feature (357)..(357): n is a, c, t, g, unknown, or other
  misc_feature (366)..(366): n is a, c, t, g, unknown, or other
aagctggagctccccgcggtggcggccgctctagaactagtggatcccccgggctgcaggaattcgcacgagaccattacctagaacatcctaatcgaaaaacacgcaaaattccccatcccccaaggaagccacgccctcgcgcaccagcgcgaccggaccacaccgcccgtctgaccgacgcaacccagccgtccagacgcgccgccgaccgtccttccaccaccacgcccgcgccgtcgcacgctccctagggttccgcagggccggggatcgccggagatggactggnagcgcgtgacngcggaggacttggtgggacgcgctgcggaagtggactggntcatgccgccgcgncctgtcccnggagtcttcttccgcttcacgtccaagctcctattcaagtggaccacccgcctcaagtgcaacttcactactaccggacaactttttcccctggaccggtccacccctggaaagggcttccttttgaaccccagggccaaaagggcgggtttttagaagggggcttaacccccttttcccaaggagaattttgggccccctttttaaggaaaaaaccccggggcgccaaaaaaatttttccccccttttttgggggaaaggggggggccctttaatacttctttgttttttgggggccaacccttttaaaaaaaaattattttttttttgtgggcgccccccccgcgggggtttgttccccttcttttttttttaggggaa

SEQ ID NO: 41648 - protein, 79 aa, Zea mays
  misc_feature: Ceres CLONE 1437478-F
  misc_feature (4)..(4): Xaa is any aa, unknown, or other
  misc_feature (21)..(21): Xaa is any aa, unknown, or other
MDWXRVTAEDLVGRAAEVDWXMPPRPVPGVFFRFTSKLLFKWTTRLKCNFTTTGQLFPLDRSTPGKGFLLNPRAKRAGF

SEQ ID NO: 41649 - DNA, 580 bp, Zea mays
  misc_feature: Ceres CLONE 1437479-F
  misc_feature (282)..(282): n is a, c, t, g, unknown, or other
  misc_feature (297)..(297): n is a, c, t, g, unknown, or other
  misc_feature (306)..(306): n is a, c, t, g, unknown, or other
  misc_feature (346)..(346): n is a, c, t, g, unknown, or other
  misc_feature (382)..(382): n is a, c, t, g, unknown, or other
  misc_feature (383)..(383): n is a, c, t, g, unknown, or other
  misc_feature (402)..(402): n is a, c, t, g, unknown, or other
aaagctggagctccccgcggtggcggccgctctagaactagtggatcccccgggctgcaggaattcgcacgagaccattacctagaacatcctaatcgaaaacaccactgggtcttcagaccattagctttatctactccagagcgcagaagaacccgatcgacaccatgagggtgttgctcgttgccctcgctctcctggctctcgctgcgagcgccacctccacgcatacaagcggcggctgcgtgactgccagccaccgaccgccgggatcatctaccngcccgccgggtgcantctgcaccntcccgggttcaacctgcccacctccgggtgcatctccccncgggcgggtccactgacgccgcggtccactgccacnngcgtcatgtgccgcgccgntcatctgcccccccccccccatggccctttaccctttttttaaaccgcccccggggggttttaagccctttttcccccaggaacaaaccccacatttggcccgggggtccaaaaaggcccggtttttaaaaaacccccccggtttttttttttttttggggaaaaaacacccctcggg

SEQ ID NO: 41650 - DNA, 711 bp, Zea mays
  misc_feature: Ceres CLONE 1437482-F
  misc_feature (530)..(530): n is a, c, t, g, unknown, or other
aaagtggagctccccgcggtggcggccgctctagaactagtggatcccccgggctgcaggaattcgcacgagaccattacctagaacatcctaatcgaaaaactcaatctctctcctctcctcgcctctccttggtgtccgtgttcacgccgtcgctagcgcctgccgcggcgaagcttctgccctccccggcgccgggctcgggtcgtcgtcggccaggcagctgctacgcgtgaacacggtcacaccagtaccacgtgacgtgaacggtgaactcgtgaagaacagagccgccactgaggaaccctagcgacggcggcgtgctaccggtgacattgtccccctcggtccctccctcatcccgacgcagcggcgccagcctgcaggaagcctatttcgagacaggtcgatctttgctgcctgggcgagcttcagccgaatcaaggtcaagcatggcggcaggccattaaatagagcaacacaaaccccttcaaaatcatggagaactcttgcagaaccccgacccgggncgccaaacaggggggccctttccccatcgccatccccccttcttcttcttttgaaggctggggaaggccaggggggcccacccaaaattggccaaaacagggggtccccatttgaacccccccccaaagaaacaaaggggttgggcccccctttttttaaaggtctttgcgcccgcccccc

SEQ ID NO: 41651 - DNA, 621 bp, Zea mays
  misc_feature: Ceres CLONE 1437483-F
  misc_feature: Encodes the peptide sequence at SEQ ID NO. 41652
  misc_feature (192)..(192): n is a, c, t, g, unknown, or other
  misc_feature (392)..(392): n is a, c, t, g, unknown, or other
  misc_feature (393)..(393): n is a, c, t, g, unknown, or other
  misc_feature (396)..(396): n is a, c, t, g, unknown, or other
  misc_feature (397)..(397): n is a, c, t, g, unknown, or other
  misc_feature (433)..(433): n is a, c, t, g, unknown, or other
  misc_feature (435)..(435): n is a, c, t, g, unknown, or other
  misc_feature (436)..(436): n is a, c, t, g, unknown, or other
  misc_feature (438)..(438): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (611)..(611): n is a, c, t, g, unknown, or other
  misc_feature (612)..(612): n is a, c, t, g, unknown, or other
  misc_feature (614)..(614): n is a, c, t, g, unknown, or other
  misc_feature (617)..(617): n is a, c, t, g, unknown, or other
ggctgcaggaattcgcacgagaccattacctagaacctcctaatcgaaaaacgaaccactcctcctacagaaatcacctgccggcctggcctttccgtagctacaaccgaagccaccaccagcagtcccgcacgactagcggaataatatccaccggcgacgggaacgggaggcggcgcggccggagattcnaagcgatggcgttcacgatgcgggcagtgaaggtgcctccgaactcggcctcgctggaggaggcccggcaccgcgtcttcgatttcttcaagcaggcatgccgctctatccccaccgtcatggagatctaccacctccacgacgttgtcacgccctctcagctgcgctccaccatcgctaatgatacccccccacaccannaanngtcacaacccccaagggggtgatattcttttggttnanncnacggatacctcactcaccctgtgtcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnngnggngggg

SEQ ID NO: 41652 - protein, 73 aa, Zea mays
  misc_feature: Ceres CLONE 1437483-F
  misc_feature (65)..(65): Xaa is any aa, unknown, or other
  misc_feature (66)..(66): Xaa is any aa, unknown, or other
  misc_feature (67)..(67): Xaa is any aa, unknown, or other
MAFTMRAVKVPPNSASLEEARHRVFDFFKQACRSIPTVMEIYHLHDVVTPSQLRSTIANDTPPHXXXSQPPRG

SEQ ID NO: 41653 - DNA, 665 bp, Zea mays
  misc_feature: Ceres CLONE 1437491-F
  misc_feature: Encodes the peptide sequence at SEQ ID NO. 41654
agagctggagctccccgcggtggcggccgctctagaactagtggatcccccgggctgcaggaattcgcacgagaccattacctagaacatcctaatcgaaaaagttggcgttggcctccaagtttaatcctggagcttcaggctccagcagcgtctccgaccttgacagtcggctgcttactccgccagcatggggaagacacgtggtatgggagctgggcgcacgttcagaacggaccgctgaaaccagatgtgggatgacccagtactcaagatgagtcacttgggcaatgagtggaaaaaaccttttgctggatcatctcctgtgaagggcatccttgtggataagattggtattgatgccaatcagccaaattcggccatacgtaagtgtgcccgtgttcacctggtgaataatgcaaagaagattgctgcctttgtgtccaatgatagttgcctagactacatctacgagaatgatgatgtgttgattgctggatttagtcgcaagggtcctgctgtgacagacatgcctggtgtcagttcaacgttgttaaggcgtctggcgtgccgctgcttgctctctctctggagaacaaggagaagcccatgtcttacatcactttcggtagtcaataatggcgtaaactggctaacgctatatt

SEQ ID NO: 41654 - protein, 138 aa, Zea mays
  misc_feature: Ceres CLONE 1437491-F
  misc_feature (2)..(122): Pfam Name: Ribosomal_S12 Pfam Description: Ribosomal protein S12
MWDDPVLKMSHLGNEWKKPFAGSSPVKGILVDKIGIDANQPNSAIRKCARVHLVNNAKKIAAFVSNDSCLDYIYENDDVLIAGFSRKGPAVTDMPGVSSTLLRRLACRCLLSLWRTRRSPCLTSLSVVNNGVNWLTLY

SEQ ID NO: 41655 - DNA, 738 bp, Zea mays
  misc_feature: Ceres CLONE 1437492-F
  misc_feature (278)..(278): n is a, c, t, g, unknown, or other
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctncctcaacaatgttcaaactgccaaccacaacatcctcctccatagcccgacctctcacacattccaacttggtgcggcgtaaacgcgcagcagcacttcaacccggtcggccacggcctgcccctaggcgttgacatccagatccatctcgctccgatctacattcgagaagtttgtctccgacatcgattccccagtctgaaatcgtgtcgacgtcttctttgggtggacggtcgaagtcacgcgcacgcacatcccacactttgttctcccccggcggtgcattncagcacactgtctttctttctcgtgtcggaagcactcggggcacaggggcggacccgtgaacgacgttctttcggcgtgtcacgatctccggtcgcaagctcgatgctctccccatcgacccgcgagcccctttggagggcccccgacctaaattttactggagatttctccc

SEQ ID NO: 41656 - DNA, 737 bp, Zea mays
  misc_feature: Ceres CLONE 1437511-F
  misc_feature: Encodes the peptide sequence at SEQ ID NO. 41657
  misc_feature (268)..(268): n is a, c, t, g, unknown, or other
  misc_feature (276)..(276): n is a, c, t, g, unknown, or other
  misc_feature (368)..(368): n is a, c, t, g, unknown, or other
  misc_feature (369)..(369): n is a, c, t, g, unknown, or other
  misc_feature (482)..(482): n is a, c, t, g, unknown, or other
  misc_feature (483)..(483): n is a, c, t, g, unknown, or other
  misc_feature (526)..(526): n is a, c, t, g, unknown, or other
  misc_feature (612)..(612): n is a, c, t, g, unknown, or other
  misc_feature (626)..(626): n is a, c, t, g, unknown, or other
  misc_feature (715)..(715): n is a, c, t, g, unknown, or other
  misc_feature (737)..(737): n is a, c, t, g, unknown, or other
aagctggagctccccgcggtggcggccgctctagaactagtggatcccccgggctgcaggaattcgcacgagaccattaccagaacatcctaatcgaaaaatcaccaccactgggtcttcagaccattagcttatctactccagagcgcagaagaacccgatcgacaccatgagggtgttgctcgttgccctcgctctcctggctctcgctgcgagcgccacctccacgcatacaagcggcggctgcggctgccagccaccgccgccnggttcatnctaccgccgccggtgcatctgccacctccggttcacctgccacctccggtgcatctccccacgccggtccacctgccccgcgcggtccaccnntgcacgccggtccatgtgcccgccgcggttcatctgccgcccgcacccatgcactaccctactcaaccgccccggcctcagcctcatcccccagcacacccatgcccgtgccnnacagcgcatccaagcccgtgccagctgcaggaaacctgcggcngtggcagcaccccgatcctggggcagtgcgtcgagttcctgaggcatcagtgcagcccgacggcgacgccctactgctcgcctcantgccagtcgttgcngcagcagtgtttgcagcagctcaggcaggtggaagccgcgccaccgtacccaagcgatcttcggcttggtccctcagtccatcctgcancagcagccgcaaaggcgccagn

SEQ ID NO: 41657 - protein, 106 aa, Zea mays
  misc_feature: Ceres CLONE 1437511-F
  misc_feature (22)..(22): Xaa is any aa, unknown, or other
  misc_feature (37)..(37): Xaa is any aa, unknown, or other
  misc_feature (65)..(65): Xaa is any aa, unknown, or other
  misc_feature (70)..(70): Xaa is any aa, unknown, or other
  misc_feature (100)..(100): Xaa is any aa, unknown, or other
MHYPTQPPRPQPHPPAHPCPCXTAHPSPCQLQETCGXGSTPILGQCVEFLRHQCSPTATPYCSPXCQSLXQQCLQQLRQVEAAPPYPSDLRLGPSVHPAXAAAKAP

SEQ ID NO: 41658 - DNA, 723 bp, Zea mays
  misc_feature: Ceres CLONE 1437512-F
  misc_feature: Encodes the peptide sequence at SEQ ID NO. 41659
aaactggagctccccgcggtggcggccgctctagaactagtggatcccccgggctgcaggaattcgcacgagaccattaccagaacatcctaatccaaaaatcaccgccactgggtcttcagaccattagcttatctactccagagcgcagaagaacccgatcgacaccatgagggtgttgctcgttgccctctctctcctggctctcgctgcgagcgccacctccacgcatacaaacagcggctgcggctgccagccaccagccgccggtttcatctatccgcatgccggtgcatctggcacctacggttcaactgccaccatcggtgcatctcctagcgtgggttcacctgctagcgactgaccatctgccatcggcggtccatgtgtctccggcgagtcatctggctctgcaacatgccactaccctacttaacgtcctcggctcagactgatgcgcagcacagccatgtccgtggcagcagctccatctaacccatgccagctgcaagaacctgcggcgtggcagcaccccgatcctgggctactgcgtctagttcctgaagcatatgtgtagcccgagcgctacgccctactgatctactcagtgcaaatcgttaggtagcaatgctgccagcagatcaggcagggggagcccctcaccccccccccgggcaaacatccggtttgagcctccaaccatgcctgcattagcgaccccaa

SEQ ID NO: 41659 - protein, 64 aa, Zea mays
  misc_feature: Ceres CLONE 1437512-F
MRVLLVALSLLALAASATSTHTNSGCGCQPPAAGFIYPHAGASGTYGSTATIGASPSVGSPASD

SEQ ID NO: 41660 - DNA, 596 bp, Zea mays
  misc_feature: Ceres CLONE 1437527-F
  misc_feature: Encodes the peptide sequence at SEQ ID NO. 41661
  misc_feature (379)..(379): n is a, c, t, g, unknown, or other
  misc_feature (404)..(404): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgcntgtgctgtcggggctggcgctaacngcctccgtggtggggctggccgtgggcacgcgggtgttcctgatcttcagccccgtgctcgtccccccccgcgctgctcatcggggacggccgtcatgggggttcctccacctcgggccccgctggggcctccgggggggcttgtccctccccctccacgttggccctccgcccaaaacggggggggggggg

SEQ ID NO: 41661 - protein, 134 aa, Zea mays
  misc_feature: Ceres CLONE 1437527-F
  misc_feature (44)..(116): Pfam Name: Oleosin Pfam Description: Oleosin
  misc_feature (62)..(62): Xaa is any aa, unknown, or other
MADRDRSGIYGGAHATYGQQQQQGGGGRPMGEQVKGMLHDKGPTASQALTVVTLFPLGGLLXVLSGLALTASVVGLAVGTRVFLIFSPVLVPPRAAHRGRPSWGFLHLGPRWGLRGGLSLPLHVGPPPKTGGGG

SEQ ID NO: 41662 - DNA, 726 bp, Zea mays
  misc_feature: Ceres CLONE 1437533-F
  misc_feature: Encodes the peptide sequence at SEQ ID NO. 41663
  misc_feature (321)..(321): n is a, c, t, g, unknown, or other
  misc_feature (526)..(526): n is a, c, t, g, unknown, or other
aaactggagctccccgcggtggcggccgctctagaactagtggatcccccgggctgcaggaattcgcacgagaccattacctagaacatcctaatcgaaaaaatttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccacgtacgccgcnagagaggaagagagcccgtatcctccgccccgctgcccgcggaccgatggactcgagcactggatctcgcgcctggccgccgcgaagcgcttctacgcggcgcagctcggccacagcgatcgggccgggatggacgaagctgagatggacgaagaggtcaggcccgagttcccctgcccctactgctacgaagaccacgacgtcngatccctctgcgcgcacctggaagaggagcacccgttcgaaaccccaagcgcgggctgccctgtctgctcagagatgggtacgaaagatatggttaaacataatactacgccacatggatatttatccaagaatcgccggcggctgcgcaaaatcatcatttccaggcagccagggccctctcttttgctgagtcgagaa

SEQ ID NO: 41663 - protein, 92 aa, Zea mays
  misc_feature: Ceres CLONE 1437533-F
  misc_feature (26)..(26): Xaa is any aa, unknown, or other
MDEAEMDEEVRPEFPCPYCYEDHDVXSLCAHLEEEHPFETPSAGCPVCSEMGTKDMVKHNTTPHGYLSKNRRRLRKIIISRQPGPSLLLSRE

SEQ ID NO: 41664 - DNA, 550 bp, Zea mays
  misc_feature: Ceres CLONE 1437544-F
  misc_feature: Encodes the peptide sequence at SEQ ID NO. 41665
  misc_feature (40)..(40): n is a, c, t, g, unknown, or other
ccccgcggtggcggccgctctagaactagtggatcccccngggctgcaggaattcgcacgagaccattacctagaacatcctaatcgaaaaacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgttcggtgctgcccgtcggcacgccggtgacattggatttccgcccccaaccgggttcgcatcttcgtcgacacggtcggggaggcacccccacatcgggtgggaatcaaaccttaaattgaataactcggaaaattgcatggggggattggccccccccaaaaaaggggaggggggggctcccctcccaaaaaatggccaaaaaaaaaaaagggggcccccccgggtttggcgagaaaaaaaggggtcccaaaagggtgcccccctttccccaaaaggggaaaaa

SEQ ID NO: 41665 - protein, 47 aa, Zea mays
  misc_feature: Ceres CLONE 1437544-F
MSSTGGDDGAKKSWPEVVGLSLEEAKRVILCDKPDADIVRCCPSARR

SEQ ID NO: 41666 - DNA, 700 bp, Zea mays
  misc_feature: Ceres CLONE 1437545-F
  misc_feature: Encodes the peptide sequence at SEQ ID NO. 41667
  misc_feature (456)..(456): n is a, c, t, g, unknown, or other
  misc_feature (471)..(471): n is a, c, t, g, unknown, or other
  misc_feature (474)..(474): n is a, c, t, g, unknown, or other
  misc_feature (501)..(501): n is a, c, t, g, unknown, or other
  misc_feature (506)..(506): n is a, c, t, g, unknown, or other
  misc_feature (532)..(532): n is a, c, t, g, unknown, or other
aagctggagctccccgcggtggcggccgctctagaactagtggatcccccgggctgcaggaattcgcacgagaccattacctagaacatcctaatcgaaaactcctcaactcaagagatctgagctgaaagatggctcttcttcctcctctgcttctgtcctgcatcttggtgctggctctcccagcgtttcattttgctgcagggccggcggtggtgacggtagggggcgtcacgttccacgtaactaacaagtgcccgttcccggtgtggccggcggtcgcgccaaacgccggccaccccgtgctcgccgcgggcggcttcttcctccctccgggacagtcgaagcgcgtcggggcaccggccacctggaacggccgcctctggggccgcaccggctgcaccttcgcgggcaccgacgccaacgccgccagctgcctcaccggcgactgcgacngacgccctcactgcnaancggtcgtcggcgccccttcccgcaccntcgtngaagtgaacttgcacgcggacaaaancagggggagctctaccacgtgagcgtggggaacgggtacacctcccgggggccggtgtggaccagcccggaaaccccaaggggaattgcttttttccccggggggcccaaaaacgtaaaccccgtggcccccccagaacttctggtcccaaaaaaggggggccgggga

SEQ ID NO: 41667 - protein, 140 aa, Zea mays
  misc_feature: Ceres CLONE 1437545-F
  misc_feature (109)..(109): Xaa is any aa, unknown, or other
  misc_feature (114)..(114): Xaa is any aa, unknown, or other
  misc_feature (115)..(115): Xaa is any aa, unknown, or other
  misc_feature (124)..(124): Xaa is any aa, unknown, or other
  misc_feature (134)..(134): Xaa is any aa, unknown, or other
MALLPPLLLSCILVLALPAFHFAAGPAVVTVGGVTFHVTNKCPFPVWPAVAPNAGHPVLAAGGFFLPPGQSKRVGAPATWNGRLWGRTGCTFAGTDANAASCLTGDCDXRPHCXXVVGAPSRTXVEVNLHADKXRGSSTT

SEQ ID NO: 41668 - DNA, 679 bp, Zea mays
  misc_feature: Ceres CLONE 1437560-F
  misc_feature: Encodes the peptide sequence at SEQ ID NO. 41669
aagctggagctccccgcggtggcggccgctctagaactagtggatcccccgggctgcaggaattcgcacgagaccattacctagaacatcttaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggccgcgcgctcgcgctccccggggtctgccgcgtcgccac

SEQ ID NO: 41669 - protein, 130 aa, Zea mays
  misc_feature: Ceres CLONE 1437560-F
  misc_feature (58)..(130): Pfam Name: Tryp_alpha_amyl Pfam Description: Protease inhibitor/seed storage/LTP family
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGIAVDYGRALALPGVCRVA

SEQ ID NO: 41670 - DNA, 664 bp, Zea mays
  misc_feature: Ceres CLONE 1437668-F
  misc_feature: Encodes the peptide sequence at SEQ ID NO. 41671
cgcggtggcggccgctctataactagtggatcccccgggctgcaggaattcgcacgagaccattacctagaacatcctaatcgaaaaatgggtttggtgggcgggcgaagaagccagcgggcccagcatctttatcgtctgccgcaaagagggctgaaggagaagcgaggaaaggtgaggccgatagatagaggagctgcggcgccgccggcgagcgaagagtggaggatccgatccgaagcgagaggactgaatcctgcggccgggagggacgcgggaccacgacgagcgtcgtcgtcggtgccaagcaacggcagttgtccctgtccagagcacaggcaagatggttaacgcgatcaaggggctgttcatctcctgcgacgtacctatggcacagttcatccccaacctgaacgcgtcgatgccgccgtcggagaggttcatcgtgcacatgctcgaccctaccaacatgttcgtgcagcctcacgtggcgcacatgatcaggagcaagatcggggagttcagggaccagaacagctaccagaagccgcagtagtggaggatctaccgcgtcctacactccttccttgggacttgctttcgttggctgtattatttctgctgtgagctgagcacctcagcgggaacgagtacgccaaataga

SEQ ID NO: 41671 - protein, 70 aa, Zea mays
  misc_feature: Ceres CLONE 1437668-F
  misc_feature (1)..(70): Pfam Name: Tbf5 Pfam Description: Transcription factor TFIIH complex subunit Tfb5
MVNAIKGLFISCDVPMAQFIPNLNASMPPSERFIVHMLDPTNMFVQPHVAHMIRSKIGEFRDQNSYQKPQ

SEQ ID NO: 41672 - DNA, 551 bp, Zea mays
  misc_feature: Ceres CLONE 1437689-F
  misc_feature (350)..(350): n is a, c, t, g, unknown, or other
ggagctccccgcggtggcggccgctctagaactagtggatcccccgggctgcaggaattcgcacgagaccattacctagaacatcctaatcgaaaaatcccacgcattcgcatccttccccgctctcgctctctcagccgcagagccactcgtgtcggtgacggcggcgaaggcaatgtcatccctccgcccgtccctcctgctcgtggtgtcgctgctcgcggcggctctgcttgcagcggcgcccgtcctccgcgtctcgcgacctccgccgctcaggcgagctcgtcgtggcggcgcgtctgtgcgacactgcccgcgggcttcagaccccgcatccactacatgcngagctaggtggagtcactgcatcaagaccacggggcatactgcgcttcaagggaactgacgaaccggactaaaaatcttgtattgatacatgacatgactctgaaaccttcttggaaccccccgaaaaggggggccaatgtttggctggccgaaaaggcccccttttctttaaaaaaaaaaagggtttacccccagttttt

SEQ ID NO: 41673 - DNA, 641 bp, Zea mays
  misc_feature: Ceres CLONE 1437702-F
  misc_feature: Encodes the peptide sequence at SEQ ID NO. 41674
  misc_feature (568)..(568): n is a, c, t, g, unknown, or other
gtccccgcggtggcggccgctctagaactagtggatcccccgggctgcaggaattcgcacgagaccattacctagaacatcctaatcgaaaaacacggcacgacacgatcgtggttggtgttggttacacgcgcctatatcgccggttcggccgcacgtccgcctcctcctctcctcccctcttctcactcagctcaccagtgctcgctcacctttcccctccctttcctttcctttgctttcctatccttgtgccctcgaactcgaatcggaaacccagccagccatgtcgtactacggcgaccggcgcgcggagtcgtcgatcggggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgaaggagagccgctggaanggccgctacgagcggggccccgccgagggcagctcgccctggggcgtcgccttgctcgtcctcctcctcctcg

SEQ ID NO: 41674 - protein, 118 aa, Zea mays
  misc_feature: Ceres CLONE 1437702-F
  misc_feature (94)..(94): Xaa is any aa, unknown, or other
MSYYGDRRAESSIGEAFTLSPLPYPVILVLLMVTLLLGASWFFTYDDFIEEASQQLSWALLGVPIALVLLIRWISSVDSFEGYLGFYPKESRWXGRYERGPAEGSSPWGVALLVLLLL

SEQ ID NO: 41675 - DNA, 633 bp, Zea mays
  misc_feature: Ceres CLONE 1437710-F
  misc_feature: Encodes the peptide sequence at SEQ ID NO. 41676
gctctagaactagtggatcccccgggctgcaggaattcgcacgagaccattacctagaacatcctaatcgaaaaactcccagaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaaaagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgcgccagacgacgcctacatccttgacgcagccgagactgccggtgtggagttgccatactcgtgccgtgctggggcttgcctcacctgtgccggcaaaatccaatcctggttcggttgaccagtccgatgggcccttccttgatgacggccaccaagagga

SEQ ID NO: 41676 - protein, 112 aa, Zea mays
  misc_feature: Ceres CLONE 1437710-F
  misc_feature (63)..(109): Pfam Name: Fer2 Pfam Description: 2Fe-2S iron-sulfur cluster binding domain
MSTSTFATSCTLLGNVRTTQASQTAVKSPSSLSFFSQVTKVPSLKTSKKLDVSAMAVYKVKLVGPEGEEHEFDAPDDAYILDAAETAGVELPYSCRAGACLTCAGKIQSWFG

SEQ ID NO: 41677 - DNA, 663 bp, Zea mays
  misc_feature: Ceres CLONE 1437722-F
  misc_feature: Encodes the peptide sequence at SEQ ID NO. 41678
tggagctccccgcggtggcggccgctctagaactagtggatcccccgggctgcaggaattcgcacgagaccattacctagaacatcctaatcgaaaaatcgatccattcggtctctctctgcctgcccgctcgccccacgcctcccctcgccgccgccgccgccgcccgcagctagggttccggccgccgcggatccgcccgcccgcccccacgccccgcggcagatcggcccccccgctcccccggcgccgaggtctccgccccgccgcggcaggcatgatgagtcgccaacagcagcatgcacctcttaggacttcagccaacggagccccccaccggaagcttgatagggagggtagtggaaggcatgatagtaaatcacacctgatgagatcttcatctggtggttttaccagtgcagaaaatggaggcaaacttgggcatgcaaacccttcacgggatcgactagtctatgttatgacacaaattattgggcatcatgtggatgtgcatgtcaaaaatggatctgttatctctggaatcttccatgcaacaaacaccgataaagactttggaattatcttaaaaatggcacagccgataaaggatacttctgtgggaggacaaattaatacctctgaatgtgtaagaaagccggagat

SEQ ID NO: 41678 - protein, 127 aa, Zea mays
  misc_feature: Ceres CLONE 1437722-F
MSRQQQHAPLRTSANGAPHRKLDREGSGRHDSKSHLMRSSSGGFTSAENGGKLGHANPSRDRLVYVMTQIIGHHVDVHVKNGSVISGIFHATNTDKDFGIILKMAQPIKDTSVGGQINTSECVRKPE

SEQ ID NO: 41679 - DNA, 683 bp, Zea mays
  misc_feature: Ceres CLONE 1437723-F
  misc_feature: Encodes the peptide sequence at SEQ ID NO. 41680
acccgcggtggcggccgctctagaactagtggatcccccgggctgcaggaattcgcacgagaccattacctagaacatcctaatcgaaaagtaaatgggctaggcgtcgaagcctctccgcataagacacgggcctacgtccacagatcggaggagagagcactgactcgtctcccttctcgtctacagcgacggcgaaggcgaagcggaggagcgggagcagaaacagaagaggcagccatggccgtgatggagaagctcaagatcttcgttgtgaaggagcctgttgtcgcagcttcctgtctcatcgccggattcggtgtctttcttccagcagttgtccggccaatcctggattcatgggagaccgcagaaaaagttcctcccacaccctctaatgatgtgggtgcggggtgtccccggcagaaaaagtagtgaacttgcatggttttctcatgccgaggctgtcccaccatttcttccccatgtttttcctgccgtccagattggaaagcctccccaaagcccggtctccaaagggacagcttggtgatttttaaccgggcccaagggggttttgcctttaccccaattgcaaaaatggggggttaaacagtttcgttttaacccaaaacgaaaagggtttttttccgggaactaagcggggagggggcccttttaaa

SEQ ID NO: 41680 - protein, 64 aa, Zea mays
  misc_feature: Ceres CLONE 1437723-F
MAVMEKLKIFVVKEPVVAASCLIAGFGVFLPAVVRPILDSWETAEKVPPTPSNDVGAGCPRQKK

SEQ ID NO: 41681 - DNA, 664 bp, Zea mays
  misc_feature: Ceres CLONE 1437735-F
  misc_feature: Encodes the peptide sequence at SEQ ID NO. 41682
  misc_feature (421)..(421): n is a, c, t, g, unknown, or other
cgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcgggtgtccgtcctggtggtgggcgcggcggcggtgtgcgacatgagcaacgagcagttcatgtcgtgccagcccgcggcggccaagacgacggaccccgcggccgcgccgtcgcaggcgtgctgcgacgcgctggcgggggcggaccctcagtgcctgtgcgggctacagaactcgccgtggatgggcgtctacnacatcgaccccaagcgcgccatggagcttcccggcaagtgcggcctcccccacgccgcccgactgctagcagtgtgctagcccaagccaggcccagcaggaaggccccccgcattgctaaccttgtactggccggtggtggcttctgcaacaggggtggcaggcagggcccccatacgaacggggcccctttcccccccccaccctgggcccccggaccttttttgaaatgggggggggtccc

SEQ ID NO: 41682 - protein, 77 aa, Zea mays
  misc_feature: Ceres CLONE 1437735-F
  misc_feature (9)..(77): Pfam Name: Tryp_alpha_amyl Pfam Description: Protease inhibitor/seed storage/LTP family
  misc_feature (52)..(52): Xaa is any aa, unknown, or other
MSNEQFMSCQPAAAKTTDPAAAPSQACCDALAGADPQCLCGLQNSPWMGVYXIDPKRAMELPGKCGLPHAARLLAVC

SEQ ID NO: 41683 - DNA, 683 bp, Zea mays
  misc_feature: Ceres CLONE 1437736-F
  misc_feature: Translation starting site: 183
  misc_feature (611)..(611): n is a, c, t, g, unknown, or other
  misc_feature (658)..(658): n is a, c, t, g, unknown, or other
  misc_feature (683)..(683): n is a, c, t, g, unknown, or other
gctggagctccccgcggtggcggccgctctagaactagtggatcccccgggctgcaggaattcgcacgagaccattacctagaacatcctaatcgaaaatagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgtgcgtccttctccctcgccgccggctcttttaaatctccccgcttattctttttgagcgggtgaggagatgcgtgattgttcctcttcttggcaggccgagaagatcgccacgatcgtgaaggcagccaacgatcaaggtcgagtcctactgggcggggctcttcgccaagctcctggagaagcgcaacggcgaggacctcatcctctccgttggatctggtggcggagctgctccagttgctgctgccgcccgctgctggtggtgctgcggccgcggctgccccggctgtcggggagaagaaggaagaggccaaggaggagtctgatgacgacatgggcttcagcctgttcgactgangagacccctcgcccccagccattagcaaatttcacttgtgctgtccnagactatcttgtccctatgtatgcn

SEQ ID NO: 41684 - DNA, 682 bp, Zea mays
  misc_feature: Ceres CLONE 1437748-F
  misc_feature: Encodes the peptide sequence at SEQ ID NO. 41685
ggctggagctccccggggtggcggccgctctataacgggtggatcccccgggctgcaggaattcgcgcgagaccattacctagaacatcctggtcgaaaaaagccaggccaggcaacccacaacacaaggagaaggggaagggcggcgagggaagggctccgcgtcgtgtcccttctcttcctcctcctcctcctcctctctccaacaccccatccatcagcgctgccgtccgcattgctcttgatcgcatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagaggctgaaggaaattacaaaaaacttcagcagtgatgccctcgttgccgagggctcgtatgccagaatctattttggtgtgctgaaagatgggacaaaatctgcagtgaaaaaacttgactccaacaaacagcctgaatcagaattccttgtgcaagtttcagctgtctcaaaata

SEQ ID NO: 41685 - protein, 101 aa, Zea mays
  misc_feature: Ceres CLONE 1437748-F
  misc_feature: SWISSPROT Homolog: EC 2.7.11.1 Non-specific serine/threonine protein kinase
MTIPMFLSLLMFIILDLAGSQPQPLSSPLAELSQLQYRPFIWKRLKEITKNFSSDALVAEGSYARIYFGVLKDGTKSAVKKLDSNKQPESEFLVQVSAVSK

SEQ ID NO: 41686 - DNA, 633 bp, Zea mays
  misc_feature: Ceres CLONE 1437753-F
  misc_feature: Translation starting site: 259
  misc_feature: Pfam Name: DUF814 Pfam Description: Domain of unknown function (DUF814)
  misc_feature (539)..(539): n is a, c, t, g, unknown, or other
  misc_feature (633)..(633): n is a, c, t, g, unknown, or other
cctgaactagtggatcccccgggctgcaggaattcgcacgagaccattacctagaacatcctaatcgaaaaacgaaaccctagactagataaaaagttcccatttccctcaattccccaacttccctcgccgcaatctctcgccgcctccagtccagagccaccgtgagatctgcccgattccgccgcccggacccggggactccctcccctcctcgatccgttcgggcggccggccggcctagcttcaagtgcggggatggtgttctacttcaaggcgcggcccgaggccggcgactataccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagctggtcaaagctaattccattcaggtaataaggtcataacattgatgtagtttatactccatggntacatttgaagaagacccctttcatgggatgtaggcaagtttggttttcacaaccctaagttggttcgcactattaaaggtggaaagaggatcn

SEQ ID NO: 41687 - DNA, 699 bp, Zea mays
  misc_feature: Ceres CLONE 1437844-F
  misc_feature: Encodes the peptide sequence at SEQ ID NO. 41688
ggagctccccgcggtggcggccgctctataactagtggatcccccgggctgcaggaattcgcacgagaccattacctagaacatcctaatcgaaaaacattcacatcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccctgccagcgagctcctcgcacgggcgccgcgaggtggccgccatgatggacgagctggacacggaccgcgacggcttcgtggacctcggcgagttcagggcgttccacgcgcgcggcggcggcggcgttgacgacgacgccgagctccgcgccgccttcgacgtctacgacgtcgacggcgacggccgcgtcacggcggccgagctgggcaaggtgctcgcgcgcatcggcgagggcggatgcagcgcccacgagtgcgagcggatggtcgccggcgtcaacgccgacggctgcgtcgggttcgaggacttccagaagatgatgtgcccccagccgcaagcctgaagcggcgccgccggacggga

SEQ ID NO: 41688 - protein, 172 aa, Zea mays
  misc_feature: Ceres CLONE 1437844-F
  misc_feature (106)..(134): Pfam Name: efhand Pfam Description: EF hand
  misc_feature (29)..(57): Pfam Name: efhand Pfam Description: EF hand
  misc_feature (69)..(97): Pfam Name: efhand Pfam Description: EF hand
  misc_feature: SWISSPROT Homolog: EC 2.7.11.1 Non-specific serine/threonine protein kinase
MSNSAASEKQSQQAGHRQRPPAASAADAEMQRVFCRIDADGDGRISASELAAVTRAISLPASSSHGRREVAAMMDELDTDRDGFVDLGEFRAFHARGGGGVDDDAELRAAFDVYDVDGDGRVTAAELGKVLARIGEGGCSAHECERMVAGVNADGCVGFEDFQKMMCPQPQA

SEQ ID NO: 41689 - DNA, 720 bp, Zea mays
  misc_feature: Ceres CLONE 1437847-F
  misc_feature: Encodes the peptide sequence at SEQ ID NO. 41690
  misc_feature (392)..(392): n is a, c, t, g, unknown, or other
  misc_feature (462)..(462): n is a, c, t, g, unknown, or other
cgcggtggcggccgctctagaactagtggatcccccgggctgcaggaattcgcacgagaccattacctagaacatcctaatcgaaaacatgatgtttttggtcatatccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcactactaaaccagcttgaaggcagccaaaaggagctcaatggtgctctgagcaaatatctcnaactccttgagaagtcttttcatcagatatatctaaagcatacagaaatgtgaattttgaggtccatacngtaaacaatatcatagcgaatcttttctacggccaaggctccttgaccttggggacctgtttgccccaggaggggggggactagggggaactcctttaaacttccgtttcagggaaattatgccttctcttggaccctggaaggcgaaaaacctccaccccggctcctttgggggggccaaaaaccctagaacacgttttggaaaaaggggtcttttgggggaaatcaactttttctccctctcgttttggaaaaaag

SEQ ID NO: 41690 - protein, 107 aa, Zea mays
  misc_feature: Ceres CLONE 1437847-F
  misc_feature: SWISSPROT Homolog: EC 2.7.11.1 Non-specific serine/threonine protein kinase
  misc_feature (91)..(91): Xaa is any aa, unknown, or other
MEIDSLREGFDRVAEKRSLSSAKALEVVDQIVNEIEQAIVKLQMMNTDSTGNVDHPSILAELKAKLNEMALLNQLEGSQKELNGALSKYLXLLEKSFHQIYLKHTEM

SEQ ID NO: 41691 - DNA, 689 bp, Zea mays
  misc_feature: Ceres CLONE 1437854-F
  misc_feature: Encodes the peptide sequence at SEQ ID NO. 41692
caccgcggtggcggccgctctagatctagtggatcccccgggctgcaggaatttgcacgagaccattacctagaacatcctaatcgaaaaaaaaaccaaacacacacacacacgcaggcagcagtcaagcggccaacctctgtttcacaccgtacatgcgtgccacgcccacaccgcagcccccgatgtcgtcgcagcgcccgggccgtcaccagcgccgcgcgtcgcagagcgtgttcgtgctcccagagaacctggcctccctcgacgtcgacgcggcggccgacgcgggcgccaaggccggcgggccagaaggcgccggcgccggcgccgagcagcaggcgaggccgcccgcggggcgtcaccaccgccgcgccatgtccgtggccgcggccgtggcctccacgcaccttgagctgatcaaggaggacctcggcagctacaactacaaggtcggcgcctgagagagagagagagagaggagccggcacgctgcgtcatgtgtatagagcttgtgggttaaccgtacccagagctggctttgatcgacgattaacagtggcttaattacatggacaaaaaaaaaaaaaaaaaagcttatcgataccgtcgacctcgagggggggcccggtacccaattccgccctataggggagcggattaccccgccctcactgggccgtcctttt

SEQ ID NO: 41692 - protein, 92 aa, Zea mays
  misc_feature: Ceres CLONE 1437854-F
MSSQRPGRHQRRASQSVFVLPENLASLDVDAAADAGAKAGGPEGAGAGAEQQARPPAGRHHRRAMSVAAAVASTHLELIKEDLGSYNYKVGA

SEQ ID NO: 41693 - DNA, 943 bp, Zea mays
  misc_feature: Ceres CLONE 1437856-F
tttttccctctcttctaccggcgttctcgtcccctacgattgctgttacgctccatactaccgttactctacgccgtggcggccgctctagactagcggatcccccgggctgcaggaattcgcacgagaccattacctagaacatcctaatcgaaaaaagtggtacttgaagtcgaaggcagcgcagcaggtacgccaggacgtcattagcagcggttggccaccacccgacgccggaggcccggaggaggaggcggcgatggcggggaagcacgggcgcaacggcttcgacgacgacaacgtcaaccctttcgtgggaggaagtgttccccctgtcacttaattctcgtcttctccctctatcaccatgaaccggtatgatttctacgagggtggacattccgtcatcgcttccttaaacggattttgaagaaaaacagtaaaaaataaattcccaggccttttggagggtcgggagttggaggtcccccccgaacccgggaaattcggaaacgaaaaggaaagccgaggccgtcttctcttaaagtttggcttgtttttgtgctcataaaaagacaataaggttggggcccttcccgctttatgttgtcccccttgttatgcccttcccgcgccacatttttctcgactgaaagaaaataactcctcaaattcttcttcttgcctcaagaggtgtcgatggaggaagcgcggcactttaccttctcttcacccttatagcgtacattacacacccacttgggctcgtcactgcttggcccaaagtggcttatattatacctgtcccgtcctcgtttttttcctatactctcgagtggcgcccgtgattgtgtttgttaaagccacgtaccgcccctcttgttctcctgttctcccctcgcccgaaatgccggatagcgcggcagggcgtctgtttattact

SEQ ID NO: 41694 - DNA, 670 bp, Zea mays
  misc_feature: Ceres CLONE 1437865-F
  misc_feature: Encodes the peptide sequence at SEQ ID NO. 41695
tctttactagtggatcccccgggctgcaggatttcgcacgagaccattacctagaacatcctaatcgaaaaaaaatgtctcgttgagacaccgctgcagtgcagactcgccgaaaacgactcctcacgaactagtccgtttccgtgcgccgctgctgacgagggagtgggagggatcatggtggcgccggatgtgaaggcggagacgatgaagctgatggatcagcggggtgccctagaggcggagatggacgccatcatcgcccgcctcactgcggcaggcggaccgggcatcaccggcggcctcgtcgacgccgagggtttccctcggtccgacatcgacataccgaacgtcctcgcccagcgccggaggcttgctgaattgccaaatgaccacccggatattacatacaaaattggtaaaaatcttgaggttttacactcttcacagttctcacggaatgaatcatcaacctcaagggagatctgataccacagatccttcccactttggatcatcttccagggcaacctatgggagaggaccatgtgactgggacttcccttttgcccatgattgaggaaatcgcttaagggttctccccgcttctgtggcatggcctcgccacttgggaagacgagacttgcccaatttcggccaatggagaatg

SEQ ID NO: 41695 - protein, 103 aa, Zea mays
  misc_feature: Ceres CLONE 1437865-F
MVAPDVKAETMKLMDQRGALEAEMDAIIARLTAAGGPGITGGLVDAEGFPRSDIDIPNVLAQRRRLAELPNDHPDITYKIGKNLEVLHSSQFSRNESSTSREI

SEQ ID NO: 41696 - DNA, 658 bp, Zea mays
  misc_feature: Ceres CLONE 1437866-F
  misc_feature: Translation starting site: 223
agtggatcccccgggctgcaggaatttgcacgagaccattacctagaacatcctaatcgaaaagcccttccccagcgcacctacgtcgtctccaccgcaatcaccgcgacggctttagcatgtcaccacaatcaccggagcggccagatcccacctcggctacacccgccctggctcctcgccgcaatcgccgaagcgggcggatccgacctcgcccaccccatggaaaacgcccaagctgcccgagtcccgcaaaatccgccccagatcctccatcgacgacagagcgtgcagcctcaatcttcaccacatcgcggcgattgtgtccacgcccccgactcgagccctcgtgttgaccgccccgcccccaccgtggacttcaacccgaggagacaacaccgcacccccgcgtgcgtccctgcccccgcgcattccggaggaccgtgcccgctctccccctcatagatttctccctcgccgaggagctggaagcgacgggggcgtggctacgtcaggagaaggaggttgcagaggaccccacgcgctaccgttccgctccagtgtcagggaagcctcgggactccgtcttcccgtgggcgaccaagtagcagccccaggaactggcccgacctccgctgcttctgcctaaaagaaatcc

SEQ ID NO: 41697 - DNA, 713 bp, Zea mays
  misc_feature: Ceres CLONE 1437869-F
  misc_feature: Encodes the peptide sequence at SEQ ID NO. 41698
ggagctccccgcggtggcggccgctctagaactagtggatcccccgggctgcaggaattcgcacgagaccattacctagaacatcctaatcgaaaacacgattgcagagccagagcgagacgcgactgcttttctgcttcatccacattggtagctagcttacgacgttcacgcatcgctttccgggccgtctccggtggtttagctcagcagagcggggaaggaagaagatgacctccgtgagcgcgaggcccgttggcgtggggtactgcttcggcggggcgaggtgccagccacggtcgcgggtgcgggtttcggccgcggcctcggcagtgaccgcgcgcgcgcccacgatggcggcgacgatgtacgagctgctcgccgtcgaggagacggcggggcccgacgagatcaaggcggcgtaccggcgcgccgcgcggcggtggcacccggacgcgtgcccccggcgcgccgaccgcttcatggcggcgcgggagcctacgaggtgctgtctgacccgagcgcaggcgcggttacgacatccagctcgctgcggcgcctacttcggcaaccccggtaacgggccggacgccccgccgggttcccgactgggaggcgcacctaacccggtttcattggcccccgcgggggcggcccggcccccccgccggaaaactggggcaacaaaaatcccagggggccccccaccctct

SEQ ID NO: 41698 - protein, 161 aa, Zea mays
  misc_feature: Ceres CLONE 1437869-F
  misc_feature (45)..(105): Pfam Name: DnaJ Pfam Description: DnaJ domain
MTSVSARPVGVGYCFGGARCQPRSRVRVSAAASAVTARAPTMAATMYELLAVEETAGPDEIKAAYRRAARRWHPDACPRRADRFMAAREPTRCCLTRAQARLRHPARCGAYFGNPGNGPDAPPGSRLGGAPNPVSLAPAGAARPPRRKTGATKIPGGPPPS

SEQ ID NO: 41699 - DNA, 705 bp, Zea mays
  misc_feature: Ceres CLONE 1437872-F
  misc_feature: Encodes the peptide sequence at SEQ ID NO. 41700
  misc_feature (402)..(402): n is a, c, t, g, unknown, or other
gctctagaactagtggatcccccgggctgcaggaattcgcacgagaccattacctagaacatcctaatcgaaaagattattctgttcgctctcgcccaagtcatcgtctggtcgtcgcccgcagaggcgcagacgcccaaaaccggaaggggcgccatggccgcgtcggatctggagagcaaggccaaggaggccttcgtcgacgacgacttcgagctggccaccgagctctacagccaggccatcgacgccgggcccgccaccgccgacctctatgccgaccgcgcccaggcgcacatcaagctcggcaactacactgaggctgtggcggatgctaacaagcaattgagcttgatcctatgatgcataaagctttactaccggaaggtgctgcatgcattnagcttgaaaataccaaactgcaaaggctgctcttgaattggggtcttcctaagcattcagcgatttcagggttggttctcctattgaggaaagggatgaccccttccttgaggaatctaccccgggccccattaaaaaatgtaaagcttcctggggctgctccctttgggggaaaggggggatttcccaaatatgggaaaaaaccccccccgggaaaaaaacccccccagaaacccaaaaataggggttggatttcacaccggggccccaaaaaggggtcccacaaaaatttttgcagggggg

SEQ ID NO: 41700 - protein, 68 aa, Zea mays
  misc_feature: Ceres CLONE 1437872-F
  misc_feature: SWISSPROT Homolog: EC 3.1.3.16 Phosphoprotein phosphatase
MAASDLESKAKEAFVDDDFELATELYSQAIDAGPATADLYADRAQAHIKLGNYTEAVADANKQLSLIL

SEQ ID NO: 41701 - DNA, 460 bp, Zea mays
  misc_feature: Ceres CLONE 1437877-F
ggagctccccgcggtggcggccgctctagaactagtggatcccccgggctgcagaattcgcacgagaccattacctagaacatcctaatcgaaaactctttcttgttgcacgcctggcctgggcgaaccgttgccgctatacaccaggcgcccagggcttcgccggcgccgagtagccaccagctgccgctcaacattcaccctctgccagggcatggaccacatgacgattgcctcggcgccgggagcccccccacccagcttcttccagggctggaacccatggccttgaccgaaaggtcaaggttctggcaaaacggaattggccccccctgggcccttcgaaaaaaaacaaaaatctgggccccccgggccttgggggccccttttccccgctttaaatgggttcccccaaaaaaagggccccccccccccccaacccccttaatggggcccccaa

SEQ ID NO: 41702 - DNA, 717 bp, Zea mays
  misc_feature: Ceres CLONE 1437884-F
  misc_feature: Translation starting site: 212
  misc_feature: SWISSPROT Homolog: EC 3.6.3.14 H(+)-transporting two-sector ATPase
  misc_feature (402)..(402): n is a, c, t, g, unknown, or other
tccccgcggtggcggccgctctagaactagtggatcccccgggctgcaggaattcgcacgagaccattacctagaacatcctaatcgaaaaatcagaaattcagaatcgatccgatctccgcttgcgctgagctccatcagattcaattctctgcaggtgcaggaccgcgaacacgaggaggcaggggagcagcatccacaaccacaagccatggcggggaggaccaacatccccactaacaactccgccctcatcgcaatcatcgccgacgaggacaccgtcactggcttcttgatggccggcgttggcaatgttgatctgcgcaagaaaaccaattacctcctcgtcgacaacaagacgacagttaaacaaatcgaggacgcgttcaaagaatttactancaggggaggatattgctattgtgctcatcagtcagtatattgccaacatgataagatttctggtggatagctacaacaagccagtccctgctattctggagatcccatcaagggaccatccatatgatccagggccacgactcggtgctgtctcgagtgaagtatctcttccctgcggaattcgggggcctcttgaaaggccatagaaggcatccttgggaaagaacaccctttggggggatcctgtttttgttttggatttaaaaaaaagggggttgggtccccaaacgggaaccccaaaatataaaaaagggg

SEQ ID NO: 41703 - DNA, 719 bp, Zea mays
  misc_feature: Ceres CLONE 1437894-F
  misc_feature: Translation starting site: 159
  misc_feature (350)..(350): n is a, c, t, g, unknown, or other
  misc_feature (407)..(407): n is a, c, t, g, unknown, or other
ccccgcggtggcggccgctctagaactagtggatcccccgggctgcaggaattcgcacgagaccattacctagaacatcctaatcgaaaatttttttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttncagtccgcacccacttcggaggcggcaagtctaccggattcggtctcatctacgacnacgtcgactcagccaagaggtcgagccccagtacaggcttatcaggaacggtcttgctacaaaggggagaattcccgccagccaattgaggaaaagaagaacggggccaaaaaaatcccgcgtggtaaaaaaaacaaggttggggaccccaaaaaaaatgaaccaggttctcgggacttttacccttcttaaaatccaaaaaaccccgtttccccccccaaaaatttttcacccccgggggcacatggtgtttaaataaaaaaaaagaatttttttttccgggttttaccccccacaaggggggaattatga

SEQ ID NO: 41704 - DNA, 721 bp, Zea mays
  misc_feature: Ceres CLONE 1437895-F
  misc_feature: Encodes the peptide sequence at SEQ ID NO. 41705
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (446)..(446): n is a, c, t, g, unknown, or other
tggagctccccgcggtggcggccgctctagaactagtggatcccccgggctgcaggaattcgcacgagaccattacctagaacatcctaatcgaaaaagaaaccgatccttgtccctagcagcgcgcgacacgcacgtacccagcgcgcgagaaatcttacatcgatcatcacctgcgagccagccggccgagcagcaccgatggcggcgtacatgcgcgtgacgcaccgcgacgaggaaggcaagaaggtgacggagaagatgccggtcccggaaacgcggcgcccggacacggccaagcacttcgagcgcaagctggaggagcagggccctcaccgctttcgagcgcacccggcgaacgcgcccgggggcgtgggcatcggcgcccccgcgccccagtccgggcgcgnnncgcaagtacacctgggagggcccgggcagcgtcntcaaggaccagttcgacccggggccccccggcattgacccccaagaccccaattaaaaggaggcgaagacaaccaaggcccccggggaggtggcccctcgggaaggggaagtcccttaaggcccccaggggaggggaggggctccccgggtccaaattcccccgggctttttcccggaaaaaagggtaaaaaaaagttgttttttctggaaaccccaaaggccaaacccccccggggggggccggggtttaaattttttccgcggggaaggaggc

SEQ ID NO: 41705 - protein, 93 aa, Zea mays
  misc_feature: Ceres CLONE 1437895-F
  misc_feature (70)..(70): Xaa is any aa, unknown, or other
  misc_feature (71)..(71): Xaa is any aa, unknown, or other
  misc_feature (82)..(82): Xaa is any aa, unknown, or other
MAAYMRVTHRDEEGKKVTEKMPVPETRRPDTAKHFERKLEEQGPHRFRAHPANAPGGVGIGAPAPQSGRXXQVHLGGPGQRXQGPVRPGAPRH

SEQ ID NO: 41706 - DNA, 718 bp, Zea mays
  misc_feature: Ceres CLONE 1437906-F
  misc_feature: Encodes the peptide sequence at SEQ ID NO. 41707
  misc_feature (302)..(302): n is a, c, t, g, unknown, or other
  misc_feature (351)..(351): n is a, c, t, g, unknown, or other
  misc_feature (358)..(358): n is a, c, t, g, unknown, or other
  misc_feature (361)..(361): n is a, c, t, g, unknown, or other
  misc_feature (367)..(367): n is a, c, t, g, unknown, or other
  misc_feature (387)..(387): n is a, c, t, g, unknown, or other
tggagctccccgcggtggcggccgctctagaactagtggatcccccgggctgcaggaattcgcacgagaccattacctagaacatcctaatcgaaaaattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggtacgcacgttcgtacacaccggccctccctctcngcattcctgcacggatcttcgtcgtcgccgccgctaattcctgagtccngaactgnacngcccantgcaggggatgcgctgctcnatgcgcaagagggggttgcacctggagatctacgaggactcaaggggtactgcaacgccaagctggtccttgtgacgggggccaccaaccgggatacccgggggaaggtggtccgaaacccccccttcaaatggcggaaaccctccgccctggggcttgggaccccaaaaaaaaattcccccaaaaaggggggccctaagaagaattctccccaaaaccctttgggggaagaacccccagggcgccccttatttttccccagggggaaacattaggggccccccccctttccccccccgggggggggggccccccgcattttttttttcct

SEQ ID NO: 41707 - protein, 53 aa, Zea mays
  misc_feature: Ceres CLONE 1437906-F
  misc_feature (42)..(42): Xaa is any aa, unknown, or other
MTLSLSTSFLPIPAAARTTARTLRSVVPSQVRTFVHTGPPSXHSCTDLRRRRR

SEQ ID NO: 41708 - DNA, 710 bp, Zea mays
  misc_feature: Ceres CLONE 1437932-F
  misc_feature: Encodes the peptide sequence at SEQ ID NO. 41709
  misc_feature (710)..(710): n is a, c, t, g, unknown, or other
tggagctccccgcggtggcggccgctctagaactagtggatcccccgggctgcaggaattcgcacgagaccattacctagaacatcctaatcgaaaaagaccattacctagaacatcctaatcgaaaaatttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacagggatgaggtcttcgcgctgattcccagcctcaagtacctcgatggcgctgacgctgagggcaacgagcgn

SEQ ID NO: 41709 - protein, 169 aa, Zea mays
  misc_feature: Ceres CLONE 1437932-F
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTKVKGYRDEVFALIPSLKYLDGADAEGNER

SEQ ID NO: 41710 - DNA, 698 bp, Zea mays
  misc_feature: Ceres CLONE 1437937-F
tggagctccccgcggtggcggccgctctagaactagtggatcccccgggctgcaggaattcgcacgagaccattacctagaacatcctaatcgaaaaattcaccgggtacaaaccggaactggacacaagaaaatcagtaattttgtggccagatcctatccgagacctgctccggttgcgctctccggggagggcctcagtccctctccgtccgcgatgcatcggaggaagccgctaccgctccacgcctcggcttcgcccgacattccctaccgatgtcgtgcggaggcggccttctgggcgttactccgcacacattcgagatccaggcaagaacacccctatctggttcgtcacctaagactgctctgaggcggcctcgcacacctacgacttctgctgtacgatctgctttttgtgccagcgcccgcaccaacttccacagaggtggctctcgagcgctgctgcagacgactccatccgcctcctgcgcatttcctagggtacctgcggatgcggtgcatgtctggtcatgtcattaccctcgagctcgtggagacggtttctacctcgatgcttcgccctgccgtacagcgccctggccatggatgatgactatgactaggactggcacgactactgcgagatcgtcgtgttccgtgctctgcgacgactatgattatcacgacattttgtt

SEQ ID NO: 41711 - DNA, 693 bp, Zea mays
  misc_feature: Ceres CLONE 1437941-F
  misc_feature: Translation starting site: 117
  misc_feature: Pfam Name: QLQ Pfam Description: QLQ
  misc_feature: Pfam Name: WRC Pfam Description: WRC
  misc_feature (538)..(538): n is a, c, t, g, unknown, or other
  misc_feature (577)..(577): n is a, c, t, g, unknown, or other
  misc_feature (587)..(587): n is a, c, t, g, unknown, or other
  misc_feature (608)..(608): n is a, c, t, g, unknown, or other
  misc_feature (615)..(615): n is a, c, t, g, unknown, or other
gggagctccccgcggtggcggccgctctagaactagtggatcccccgggctgcaggaattcgcacgagaccattacctagaacatcctaatcgaaaaaataccggagccctccgaaatggccgaggacaaggagaccgactcgccgcagccgccggccaagctgccccgcctctcccgcgccgacacgagcgccggtaagcacgcgcgggcaggcagtagagaggtgaccatggcggcctcgtcgccgctggttcttgggctggggctgggcctcggcgggcgcggcggcggcggcgagcgagacgcggatgtgtcccccgcgacggtgactcccaagaggccgtcggcgctgacgttcatgcagcagcaggagctggagcaccaggtgctcatctaccgctacttcgccgcgggcgcgccggtgccggtgcacctggtgctccccatctggaagagcgtcgccgcgtcctccttcggcccgcagcgctttccctcgctgatgggcctgggcagcctgtgcttcgactaccgcagcancatggagccggagcccggggcggtgctggcgcacggacngcaagaagtnggcgtgctcccgcgacgtggntgccggnctacagtactgcgagcggcacgtccacggcggcctgcgccgttcaaaaaagccctgtgaagccgctgctgcaccggcg

SEQ ID NO: 41712 - DNA, 893 bp, Zea mays
  misc_feature: Ceres CLONE 1437948-F
  misc_feature: Encodes the peptide sequence at SEQ ID NO. 41713
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (893)..(893): n is a, c, t, g, unknown, or other
tggttctctttccctatttcccgccccccaatccgnnngtcccncctcccaaactggagctccccgcggtggcggccgctcttcaatagtggatcccccgggctgcatgtattcgcacgagaccattacctagaacatcctaatcgaaaaaatgcaggcttgctcctgccacttctcccctgttcttgctccccctcgatcccgcatcagtgcgtcacattcaccgggaatggcaacgctcaaggtaccagccactgttcctcccgtcgccgatgactgcgaccagctgcgcaaagcattccaaggctggggcacgaacgaggcgctcatcatctccatcccacgccacagggacatccgcggaagcgcctcgccttccgcccccgtttacccccgaggcctaccgccgaggaagctccttatccaatacccgtcgaaccctcgagggggggcccccggttaccctaattcgccccccccccccggagtcagctttttcggctcccctcccttgggccttttcgttgttaaaaacattgaagaaccgggggaaaaccccttgggggttttcccttcgacataatcgcctttttggtggccgctttcccccttttctctcacccgcgggtatataatacagcaaagaaaagactccccaacctggattccgcccttttcccccaattgattgcgccacacccgaaaaaaaggcgggccgcgaatatgggctaagcgcgccaaattgtttcttacaaaaccgccgccccgggagtgatctaccgctgaacactcccctccaattttttcgtttaagatacggcgcgcgcaaaacgcgcggacacacctctcgtttgacaaccagtgtatcatatacctcgcgctcacttgctctn

SEQ ID NO: 41713 - protein, 117 aa, Zea mays
  misc_feature: Ceres CLONE 1437948-F
MATLKVPATVPPVADDCDQLRKAFQGWGTNEALIISIPRHRDIRGSASPSAPVYPRGLPPRKLLIQYPSNPRGGAPGYPNSPPPPGVSFFGSPPLGLFVVKNIEEPGENPLGVFPST

SEQ ID NO: 41714 - DNA, 691 bp, Zea mays
  misc_feature: Ceres CLONE 1437954-F
  misc_feature: Encodes the peptide sequence at SEQ ID NO. 41715
gctcttttccagtggatcccccgggctgcaggttttcccacgagaccattacctagaacatcctaatcgaaaagtttttcttctcccgttcgcagtccgcttggcgtgcgcgacagctagggcgaccgcccccgccctacgccctacgtccagatgcccatgtcttcttcgggccccttgccggcgggaactcaccacaccaggaatcgtgctggcaaccggcgcaagtctggagatagggctgataaagctaattactcctacaataatgatggagagaagagcactgttccttcattaaagaaccttcctccaattgttcatcaggaaacattctttcccaatgttcagaatgaccaccctccaacaggactatgtgtctttgaaccccccctcctgccagtgaggcttaacagcttctcggtgatccccggactgcttcctccaattcgtaccatgaccaaactcttccacccctcataaaaaaccgggcactggactctggatctaacaccacacactgggtccacctgacgctttcctcatcagaggaccttcctcgagggatttgcccccctgccctgctaccctcactacagatcttagtgctttccggcacaccgccgtgaaacctaacccgaatcctgccctcctgattcatttatccggtatctcatatattctttgcgca

SEQ ID NO: 41715 - protein, 107 aa, Zea mays
  misc_feature: Ceres CLONE 1437954-F
MSSSGPLPAGTHHTRNRAGNRRKSGDRADKANYSYNNDGEKSTVPSLKNLPPIVHQETFFPNVQNDHPPTGLCVFEPPLLPVRLNSFSVIPGLLPPIRTMTKLFHPS

SEQ ID NO: 41716 - DNA, 706 bp, Zea mays
  misc_feature: Ceres CLONE 1437957-F
  misc_feature: SWISSPROT Homolog: EC 2.4.1.242 NDP-glucose--starch glucosyltransferase
  misc_feature (565)..(565): n is a, c, t, g, unknown, or other
gcggtggcggccgctctagaactagtggatcccccgggctgcaggaattcgcacgagaccattacctagaacatcctaatcgaaaagttttttcgtggtcctcggtggtcggtgcgctgcgatgccgcttgcttcctcctctacttgagtgtcatgtcccctccgcgctctgcagagcccccgatccggaatccgaagccaaggaacagccgctcctccttcttccgcggctgcagccagcgtgaggtatctgggtggcattttgcatttgaggtcatcattgaatggctgccacgatgggttcaatatctgccgatggttcttaccaaacaaataggcccagtgcactagagcacgcacctcacatgcgattacaacaatgttgcaacggtggacttacgttcttaagcaagcattcgctatctacgcgaagtaagatacaggtggctacaagacgagctacagatcatgcaattcatccaaagactacgggacatcgggcacctactgtatcgtctgctgggatgactattgtatttgctgcaactgacgtgctaccatggtngcaaactggtaggctcggtgatgtagaagaagactgcccccccctttgctgctatgggacacggtgtatgacaataggtcctcgttagatcaaacccggatgcctggaaaccaatgtcctggttgagaaatattgcggacc

SEQ ID NO: 41717 - DNA, 731 bp, Zea mays
  misc_feature: Ceres CLONE 1437961-F
  misc_feature: Encodes the peptide sequence at SEQ ID NO. 41718
  misc_feature (414)..(414): n is a, c, t, g, unknown, or other
  misc_feature (431)..(431): n is a, c, t, g, unknown, or other
  misc_feature (452)..(452): n is a, c, t, g, unknown, or other
  misc_feature (453)..(453): n is a, c, t, g, unknown, or other
  misc_feature (471)..(471): n is a, c, t, g, unknown, or other
  misc_feature (485)..(485): n is a, c, t, g, unknown, or other
  misc_feature (486)..(486): n is a, c, t, g, unknown, or other
  misc_feature (526)..(526): n is a, c, t, g, unknown, or other
tggagctccccgcggtggcggccgctctagaactagtggatcccccgggctgcaggaattcgcacgagaccattacctagaacatcctaatcgaaaaaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaggtcactgtccaccacttccatggnaaacatgtcgaccttgnaaaactgctgtgtaatacttnncggtctgctgcctcagcnattatgatcctggnngatctgatatcatcagactacccggggtgagcaataagancccctggcagtagggggatcttacggcattgttcttcgggcctggaaaacagcattacctggtaaaaaatggagtattccgacacttggcctaatttgaatttttcccccggggtttgccccttaaaagaggcttttcttttaaccctttttccgggccccctgttttttttcctttaaacacccaaaaaaaaggtcccccgggg

SEQ ID NO: 41718 - protein, 109 aa, Zea mays
  misc_feature: Ceres CLONE 1437961-F
  misc_feature (12)..(103): Pfam Name: Ribosomal_L7Ae Pfam Description: Ribosomal protein L7Ae/L30e/S12e/Gadd45 family
  misc_feature (82)..(82): Xaa is any aa, unknown, or other
  misc_feature (89)..(89): Xaa is any aa, unknown, or other
  misc_feature (100)..(100): Xaa is any aa, unknown, or other
MVATKKTKKSTDNINNKLQLVMKSGKYTLGYKTVLRTLRNSKSKLVIIANNCPPLRKSEIEYYAMLAKVTVHHFHGKHVDLXKLLCNTXRSAASAIMILXDLISSDYPG

SEQ ID NO: 41719 - DNA, 698 bp, Zea mays
  misc_feature: Ceres CLONE 1437965-F
  misc_feature: Encodes the peptide sequence at SEQ ID NO. 41720
tggagctccccgcggtggcggccgctctagaactagtggatcccccgggctgcaggaattcgcacgagaccattacctagaacatcctaatcgaaaactttctcctttcgcttattattctggcctccttagtaccctctaaagcttacacgtcttgctaccgtaactatttcttcagaactatttcttcagaacgccgctgtgccaccggagaacgtccttattattctggcctcctcagtaccccctaaagcttacacgtcttagcttcactgatgtcgatgaaggaagaagttcaagaagcacaaagagtgaaaatgctgtgttgcccaagcaaggcaatggacactgagaacgagatccaagttttgtgtgatcaactggctgaaaaatctccagattctctttgccttttgaaagagggcgtaccgggtggagggttgtggagagaggctgttgcgagttgcgaccgatggtgacggcgacctccccgactgtcacacccggttttagaaggcgaagagccacaatccatatgcttttgctgcatgagggttcttccacctccggatgaccttctaggaccgtaataagttggaaggttcctaccttccaggactgtaataagttttatcacactttagaaaccaagttttgtaataataatgactcctatatcataagtttagaacatatga

SEQ ID NO: 41720 - protein, 67 aa, Zea mays
  misc_feature: Ceres CLONE 1437965-F
MSMKEEVQEAQRVKMLCCPSKAMDTENEIQVLCDQLAEKSPDSLCLLKEGVPGGGLWREAVASCDRW

SEQ ID NO: 41721 - DNA, 626 bp, Zea mays
  misc_feature: Ceres CLONE 1437972-F
  misc_feature: Encodes the peptide sequence at SEQ ID NO. 41722
  misc_feature (337)..(337): n is a, c, t, g, unknown, or other
  misc_feature (462)..(462): n is a, c, t, g, unknown, or other
  misc_feature (474)..(474): n is a, c, t, g, unknown, or other
  misc_feature (477)..(477): n is a, c, t, g, unknown, or other
  misc_feature (495)..(495): n is a, c, t, g, unknown, or other
aagctggagctccccgcggtggcggccgctctagaactagtggatcccccgggctgcaggaattcgcacgagaccattacctagaacatcctaatcgaaaatctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgangcagccgcagtgcagcccgctggcggcggcgccctactacgccggggtgtgggcagacgagcgccatgtaccagccgctccggcaacagtgctgccagcagcagatgaagatgatggacgtgcantccgtcccgcancanctgcaaatgatgatgcancttgaacgtggccgctgcgccagcagcagcctgttacaagccacttctgatgcagcaacagcagcagctggtgggaagcccagggttctaaccccctgtggccttgataatgggcccaaacttgcccgccc

SEQ ID NO: 41722 - protein, 109 aa, Zea mays
  misc_feature: Ceres CLONE 1437972-F
  misc_feature (57)..(57): Xaa is any aa, unknown, or other
  misc_feature (99)..(99): Xaa is any aa, unknown, or other
  misc_feature (103)..(103): Xaa is any aa, unknown, or other
  misc_feature (104)..(104): Xaa is any aa, unknown, or other
MKMVIVLVVCLALSAASASAMQMPCPCAGLQGLYGAGAGLTTMMGAGGLYPYAEYLXQPQCSPLAAAPYYAGVWADERHVPAAPATVLPAADEDDGRAXRPAXXANDDA

SEQ ID NO: 41723 - DNA, 650 bp, Zea mays
  misc_feature: Ceres CLONE 1437973-F
  misc_feature: Encodes the peptide sequence at SEQ ID NO. 41724
ccccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagctgga

SEQ ID NO: 41724 - protein, 166 aa, Zea mays
  misc_feature: Ceres CLONE 1437973-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKGENQSW

SEQ ID NO: 41725 - DNA, 596 bp, Zea mays
  misc_feature: Ceres CLONE 1437977-F
  misc_feature: Encodes the peptide sequence at SEQ ID NO. 41726
  misc_feature (377)..(377): n is a, c, t, g, unknown, or other
  misc_feature (380)..(380): n is a, c, t, g, unknown, or other
  misc_feature (388)..(388): n is a, c, t, g, unknown, or other
tggagctccccgcggtggcggccgctctagaactagtggatcccccgggctgcaggaattcacacgagaccattacctagaacatcctaatcgaaaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggcccacggcgcaggcccccggcctcgtcgcccaaagcgcactccagcgccagcgccacccaggacgttcttccttccgccgcccngcnggggccangggggggcccccctaataatgggccccccccccccccccccccccccccccctggggtgggggttgtgtatttggtcgctctacagagggggtttttcttctcgtagggtatcccactcttccccttttcacctttgttccccagctcccccccaacacgtgcccattagtggcccccggggggggggggaggggtgcgggggggggt

SEQ ID NO: 41726 - protein, 120 aa, Zea mays
  misc_feature: Ceres CLONE 1437977-F
  misc_feature (48)..(48): Xaa is any aa, unknown, or other
  misc_feature (49)..(49): Xaa is any aa, unknown, or other
  misc_feature (51)..(51): Xaa is any aa, unknown, or other
MDRVAALVVALLALFFAAGAHGAGPRPRRPKRTPAPAPPRTFFLPPPXXGXGGAPLIMGPPPPPPPPPLGWGLCIWSLYRGGFSSRRVSHSSPFHLCSPAPPQHVPISGPRGGGEGCGGG

SEQ ID NO: 41727 - DNA, 642 bp, Zea mays
  misc_feature: Ceres CLONE 1437983-F
  misc_feature: Encodes the peptide sequence at SEQ ID NO. 41728
aagctggagctccccgcggtggcggccgctctagaactagtggatcccccgggctgcaggaattcgcacgagaccattacctagaacatcctaatcgaaaaacctttctttccctcttccgtcttccccaacccaaccacccgcaccaagccgacccagagagaggagagcctgcttgcctgcctgggctggactcccccttcgcctcctcctcgtccgatcggccccgccccgcctagctgctgctgctgctgctgctgctgctgcgcgcgcgccgcggcgggacccgggaggagcgccggtggtggtggccgggcccgatggagtgggcgtcggcggcgtacacggctgcggcgctggtgtgcgccgcggcggcgagcgtggtcgcgctcgcgcacatctaccgccacctcctccactacgccgagcccatctaccagcggttcatcgtccgcatcatattcatggtcccggtatatgctgtgatgtcattcctttcccttatcctccctgacaacgcgatatattttaattctattcgagagatatatgatgcttgggtcatctacaattttctctcactctgcttggcatgggtgggaggtcctggtgctgtggtggtaagcttgagtggccgaaccc

SEQ ID NO: 41728 - protein, 107 aa, Zea mays
  misc_feature: Ceres CLONE 1437983-F
  misc_feature (5)..(107): Pfam Name: DUF300 Pfam Description: Domain of unknown function
MEWASAAYTAAALVCAAAASVVALAHIYRHLLHYAEPIYQRFIVRIIFMVPVYAVMSFLSLILPDNAIYFNSIREIYDAWVIYNFLSLCLAWVGGPGAVVVSLSGRT

SEQ ID NO: 41729 - DNA, 749 bp, Zea mays
  misc_feature: Ceres CLONE 1437991-F
  misc_feature (1)..(1): n is a, c, t, g, unknown, or other
  misc_feature (189)..(189): n is a, c, t, g, unknown, or other
  misc_feature (204)..(204): n is a, c, t, g, unknown, or other
  misc_feature (246)..(246): n is a, c, t, g, unknown, or other
  misc_feature (480)..(480): n is a, c, t, g, unknown, or other
  misc_feature (551)..(551): n is a, c, t, g, unknown, or other
  misc_feature (576)..(576): n is a, c, t, g, unknown, or other
  misc_feature (589)..(589): n is a, c, t, g, unknown, or other
  misc_feature (590)..(590): n is a, c, t, g, unknown, or other
  misc_feature (612)..(612): n is a, c, t, g, unknown, or other
  misc_feature (624)..(624): n is a, c, t, g, unknown, or other
  misc_feature (625)..(625): n is a, c, t, g, unknown, or other
  misc_feature (642)..(642): n is a, c, t, g, unknown, or other
  misc_feature (683)..(683): n is a, c, t, g, unknown, or other
  misc_feature (729)..(729): n is a, c, t, g, unknown, or other
naggagtggagctcaccgcggtggcggccgctctagaactagtggatcccccgggctgcaggaattcgcacgagaccattacctagaacatcctaatcgaaaaattcccatttccattctcgcaccgcatccaccgcgccgccgggagagagagagggtgagtactgaggaggagggtttcccatgganaacggcgaggatacnttcgcctccccaccgccggcgccggggatttttcaccaaccncggggaacgggccccccaaccttccccaaccggggggaaaaaaatgtattccctcccgggggggggaaaccccacctgcaaagaaaaagcctcataggcccgggccgccccagaaaaaaacgattttccttgtgttttttaacaccccccccccccgtggggggggggggggggggaggggggcccaatccccccgcggatcagaaggttcttcccccccccccgcgccccccnaacgaggcctccgcccccccccacacccaaaaccggcggggggggggcccacgctcctttccctccctctncagtgggggggggttgggaggcggnccgcgggaggatnncttttctcccgccccccgcggnaaggagaccggnnggggcgtcggggggggngggggaacaccccggggggttgggtggtgggtgtggggggngcgcccgcaccacccccccccgaccggctgcggtgattgatggagngtgactcggcacgccggcac

SEQ ID NO: 41730 - DNA, 643 bp, Zea mays
  misc_feature: Ceres CLONE 1437993-F
  misc_feature: Encodes the peptide sequence at SEQ ID NO. 41731
  misc_feature (510)..(510): n is a, c, t, g, unknown, or other
  misc_feature (579)..(579): n is a, c, t, g, unknown, or other
  misc_feature (584)..(584): n is a, c, t, g, unknown, or other
  misc_feature (585)..(585): n is a, c, t, g, unknown, or other
  misc_feature (606)..(606): n is a, c, t, g, unknown, or other
tggagctccccgcggtggcggccgctctagaactagtggatcccccgggctgcaggaattcgcacgagaccattacctagaacatcctaatcgaaaaaccaaaagttcaaaaccccatccaattccaaatcccacttctcgccagttcacctccgcctccgctcctcccctccccctcccgtcctgccatggccaccgcagcacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattccacctattccccgctgcgttcgggccagggcggtgaccgtgcaccgactgaaatggcgcctctgttccctggctgcgactacgagcactggctcatcgtcatggacaagcccggggggcgaaggcgccaccaagcagcaaatgatagattgttacatccagacccttgcccangtgggtaggagtgaagaggaagcgaagaagaagatatataatgtgtcctgcgagcgctatttttgatcngatgnncgaatgacgaagagacctccnacaactcgaaggcctttccaggggtctttttgtgctt

SEQ ID NO: 41731 - protein, 109 aa, Zea mays
  misc_feature: Ceres CLONE 1437993-F
  misc_feature (108)..(108): Xaa is any aa, unknown, or other
MATAARALVAARPARPLLPSRRLPSSSSIRPARQRAGVGCVRCMARRPDSTYSPLRSGQGGDRAPTEMAPLFPGCDYEHWLIVMDKPGGRRRHQAANDRLLHPDPCPXG

SEQ ID NO: 41732 - DNA, 725 bp, Zea mays
  misc_feature: Ceres CLONE 1437997-F
  misc_feature (193)..(193): n is a, c, t, g, unknown, or other
  misc_feature (204)..(204): n is a, c, t, g, unknown, or other
  misc_feature (216)..(216): n is a, c, t, g, unknown, or other
  misc_feature (221)..(221): n is a, c, t, g, unknown, or other
  misc_feature (272)..(272): n is a, c, t, g, unknown, or other
  misc_feature (287)..(287): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (568)..(568): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (654)..(654): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaaccgtcaggctgtcactgtccccctcaccgccgccgtcctcgtcaccacacctcacccgttgctcccactcccttcagaaacacctcctcgnccacgtggctngctgccctgccngctantagactcttcactcccgctgcgacgcagtccttcacagcccccgaccattnactagcttcttctancctcaactaggctcgtcgcgctcaaaaaagaacccccccagcctggaagggaaaggggaaaacttcccctgtggcccaaaaattttcggagaggcggcccttgggaggggggggggggacaaaaaaaaaaaaataaaggagcccccgcggggccctttttttagggggggggaaaattgttgggttctttcccccgcccgcccccaaaaattcccctccctgcgnnnnnnnnnnnnnnnnnnnnnnnnnnnnnnnnnnnnctnnnnnnnnnnnnccggggnannnnnnnnnnnnnnnnnnnnnnnnnnnnnnnnnnnnnnnnnagnnnnnnnnnncgnnnnnnnnnnnnnnnnnnnnnnnnnnncangggggggggggggggggggggggggggggggnnnnncgnnnnnnnnnnnnnnnnnnnnnnnnnnnnnnnng

SEQ ID NO: 41733 - DNA, 681 bp, Zea mays
  misc_feature: Ceres CLONE 1437999-F
  misc_feature: Translation starting site: 168
  misc_feature (360)..(360): n is a, c, t, g, unknown, or other
  misc_feature (374)..(374): n is a, c, t, g, unknown, or other
  misc_feature (376)..(376): n is a, c, t, g, unknown, or other
aagctggagctccccgcggtggcggccgctctagaactagtggatcccccgggctgcaggaattcgcacgagaccattacctagaacatcctaatcgaaaagaagccagagaaaatgttactccgcagaaagcaaaaccctagcccactccggcgcgccaccggccgatggtttctatgagcaccacgccgaagccgcttgactccgccgtcatcagcgcagccgttgactgtacggatgagggtggtggtgtacgcggtgccggaaagaacaggcgcacgcggcgctgatggcgccaccaccgatagtggtctctgccagcacacccgccgacgaggatgacgttcctacgtcaggaanccctactccatctncnagtcgcggtaaagctggacggagcccgagcactacaagtcctcgagccctgcagctttttgatcgtgattggacaaaattgaacctatgttggctcaaagactgtataccaataggaaccctgcaaagaagtccctcctgaagtccaaaaagggttagggggaaatttttccccccccccggccaaaacgaaggggggttttcttttttcccaaaagggattaaaaaggttcccccccttttttttgcgaaaaacccccccccccagggggcaaaagtctcccccgccccgggagacccccccgg

SEQ ID NO: 41734 - DNA, 654 bp, Zea mays
  misc_feature: Ceres CLONE 1438003-F
  misc_feature: Encodes the peptide sequence at SEQ ID NO. 41735
cgcggtggcggccgctctagaactagtggatcccccgggctgcaggaattcgcacgagaccattacctagaacatcctaatcgaaaaagctgcggagacatctgcttcttatttcttcgcatcccccttcgctaccctcatcccaactcgctcagcatcgatggcgcccaaggccgagaagaagcccgcggcgaataagccggcggatgatgagcccgcttctgataatgcgcccgccgggaagaatcctaaggatgataagcggggccccgctggcaagtccgctgccaatgatggcggcgagtcctagatgtgcatgaacataggcaatacgagcgtgtagacgtacgatatctacatctccaaggtgctgaagcatgtgcacccagacattgacatctcctcgacgtcatgtcgatcatgaactcctgattcacgatatctcaaacatctagctgctgagcatccatctcgcggcttaacgacaagccaccacaccttccgtgaaataaaagtccggggggcctgtccttccgggaagctcccaaatacccctgccccagggccccgggggggcgacattttcacctgccctaagctccacccccccccttgtcaaatttgcccaaggtgtccccccttgtccccgaatcg

SEQ ID NO: 41735 - protein, 49 aa, Zea mays
  misc_feature: Ceres CLONE 1438003-F
MAPKAEKKPAANKPADDEPASDNAPAGKNPKDDKRGPAGKSAANDGGES

SEQ ID NO: 41736 - DNA, 646 bp, Zea mays
  misc_feature: Ceres CLONE 1438010-F
  misc_feature: Encodes the peptide sequence at SEQ ID NO. 41737
aagctggagctccccgcggtggcggccgctctagaactagtggatcccccgggctgcaggaattcgcacgagaccattacctagaacatcctaatcgaaaaaatcaatcaaaaaaaaagttcgttttctttctcaaaccctttctagcgatgtcaggttaccctccgacgagccaaggctacagttacggctacggcggtggaaatcaacctccccctcctcagccaccttactcctccaccggaaacaatcctccgacgagccaaggtcacggttacggctacggcggcggaaacaatcctccgtacggatcatcatctccttacgctgtcccctacggcgcgtcgaagccccaatcctcgtctgctccttctgctccaccgtacgctccttctcctcctccaggggacttcaacccgccaaaggacaagcctttcggcggcggctacggagcttcgccggcgtctgggccttacggtgctgctcctccccgtccgggaggatacggagctgctcccgcgcattcccaatacggcgggtacggcgctgcgccccggtcttacggcggatacggagctgctgctccggcgtcgggggtttctgaatacggcagttacggtggtgctccgtctcgtccaggaagata

SEQ ID NO: 41737 - protein, 165 aa, Zea mays
  misc_feature: Ceres CLONE 1438010-F
MSGYPPTSQGYSYGYGGGNQPPPPQPPYSSTGNNPPTSQGHGYGYGGGNNPPYGSSSPYAVPYGASKPQSSSAPSAPPYAPSPPPGDFNPPKDKPFGGGYGASPASGPYGAAPPRPGGYGAAPAHSQYGGYGAAPRSYGGYGAAAPASGVSEYGSYGGAPSRPGR

SEQ ID NO: 41738 - DNA, 683 bp, Zea mays
  misc_feature: Ceres CLONE 1438011-F
  misc_feature (285)..(285): n is a, c, t, g, unknown, or other
  misc_feature (304)..(304): n is a, c, t, g, unknown, or other
  misc_feature (317)..(317): n is a, c, t, g, unknown, or other
  misc_feature (322)..(322): n is a, c, t, g, unknown, or other
  misc_feature (361)..(361): n is a, c, t, g, unknown, or other
  misc_feature (373)..(373): n is a, c, t, g, unknown, or other
  misc_feature (379)..(379): n is a, c, t, g, unknown, or other
ggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccngctgcggagaaggaaagcngtgaggtgcgcanctgcngaagctgcggccaaaggcggtgagggggaatcgggaaangaggagtcaggnaatttnacaccaccttgagaaacttggagaactgctttccaacctgaacccctccgcgaaggaattcgggcccattcccccccccggggggaaggggggattcccccccttttggcccaaacccccgtgtttttttccccggggaaaaaaaaaaaggggccccccacaaatccccccccccctttttttggaaaaaaaaaaaaaaaaaggtttttttttttggggggccccccggtgttttttttggggggggggggggggtgtctcccccggagatacccccccccgcccccaaacaaaaaaaaaaatt

SEQ ID NO: 41739 - DNA, 511 bp, Zea mays
  misc_feature: Ceres CLONE 1438020-F
  misc_feature (258)..(258): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (278)..(278): n is a, c, t, g, unknown, or other
  misc_feature (279)..(279): n is a, c, t, g, unknown, or other
aagctggagctccccgcggtggcggccgctctagaactagtggatcccccgggctgcaggaattcgcacgagaccattacctagaacttcctaacgaaaaaactactccgtcactttgtttgcaaagctcctcctcgatccatcgatcactgcaccggccggcggcaccgcgctcgcaggggctagccaacgagacggcagcaatggcggaaccgtgaccgcagcgggcatcctacggggggcgcccacgccacttancgggggaggcaaccnnnccnnccgggggaaaaaaaggcgggcccccaagggaaaccggaaaggtttccccaaaaaggggcaaagggcccaggggttaaaggggaaacttttcccccggggggggtctggggggtttttgggggggcaccaaaaccccccggggggggggggggggggcccccccggggttttttaatattatccccccccggggggcccccccccccccttttttaagagggggggggggggg

SEQ ID NO: 41740 - DNA, 654 bp, Zea mays
  misc_feature: Ceres CLONE 1438038-F
aaactggactccccgcggtggcggccgctctagaactagtggatcccccgggctgcaggaattcgcacgagaccattacctagaacatcctaatcgaaaaatatctcacatattatctgagaccacactagcaacataaaaagcacaatactgtaccaacaaaggtcagacaaaatcattttgcctccttatgctccttggtctttctgcaagtgctgctacagagaccattttcccgcaatgctcacaagatactataaatacccttcatcgccccgtacctctcaccagtggtgtcttcagtatgtcaaaacccaattcgtctgaaccctacaagagccaacaggcaagctcagctgggatcttacctttatcacccttgatactccaacaatcatcagccctattacagcaattacctttggtgcaattgttgctacaaaacatcatggcacaacaactactacaacatgtgcaaccaaagctagctgactactctcaacagcagcagtttcttccattcaaccacctaactgcattgaactctgctttctaaatgccacaacaaatttcaccattgagccacttacctgctgcccaagccacagcaatattctttcatttgaccccaatcggcaagctttgaactactcg

SEQ ID NO: 41741 - DNA, 655 bp, Zea mays
  misc_feature: Ceres CLONE 1438045-F
  misc_feature: Encodes the peptide sequence at SEQ ID NO. 41742
  misc_feature (655)..(655): n is a, c, t, g, unknown, or other
ggagctccccgcggtggcggccgctctagaactagtggatcccccgggctgcaggaattcgcacgagaccattacctagaacatcctaatcgaaaaggttctgtttgtttggtgagatgtgttttcctctttctcctacgttgtgagtttccatttggtggacatccttttccagatcccttcgtggattagatccacgctcctctagtcgagatcgtcttgcatttttctgagatggagattgggaccgaaaaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaaccttgttacagcagttacaacttcn

SEQ ID NO: 41742 - protein, 93 aa, Zea mays
  misc_feature: Ceres CLONE 1438045-F
MFPEEGCTVTISSIVQNSRWWYPSCSRCHKSSSQTSTGYHCTSCGCTNIKFRYKLSFIATDGTCEAEFFCFDSIARKIVGEPWGNLVTAVTTS

SEQ ID NO: 41743 - DNA, 632 bp, Zea mays
  misc_feature: Ceres CLONE 1438056-F
ggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttggggcctagggacagcgtatgcgcagtgcattggtcacggggaggctcttatctttccattggcaccggcctttggagatgtc

SEQ ID NO: 41744 - DNA, 706 bp, Zea mays
  misc_feature: Ceres CLONE 1438058-F
  misc_feature: Encodes the peptide sequence at SEQ ID NO. 41745
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaagaagcgggcgcctgatgggtgaagcagtgaagggcatgctccacgaacaggggcggaacgcgtcccaggcgctgaacggtgcgacgctgttcccccctggccgggctgctgctggtgcttttcgggcctggccctaacgcctccgtggggggggttggccggggccaccccgggtttcctgaattttaaccccggggttgggccccccccctgtcttaagggaaaggccgttagggggtcccccccttgggggccccttgggctcgggggtttttcccttcaatttgtgccccaaaaaaggggggggggggttccccccccccccccaaatatggggagggccccccccaggggtggggggagggggggnnncttgggacaaaaaacaaggggggggggcctccttgtgggggggggggagggggggg

SEQ ID NO: 41745 - protein, 69 aa, Zea mays
  misc_feature: Ceres CLONE 1438058-F
MADRDRSGIYGGAHATYGQQQQQGRSGRLMGEAVKGMLHEQGRNASQALNGATLFPPGRAAAGAFRAWP

SEQ ID NO: 41746 - DNA, 661 bp, Zea mays
  misc_feature: Ceres CLONE 1438061-F
  misc_feature: Encodes the peptide sequence at SEQ ID NO. 41747
  misc_feature (388)..(388): n is a, c, t, g, unknown, or other
  misc_feature (460)..(460): n is a, c, t, g, unknown, or other
gcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacaactacacatggggaagggtagtgtgggtgcatcatggtgggcgttcctcctgctcgccggcgtgctgctggtcgtagcagccacggccggggcggaggacggagtggtccaacgggaccgcaaggaggacctgctgtggtgcaagcacgcctgcgagtggcactactgaaaggacaccccgcggaagaatgtatgcnacagcgagtgcctcgagcggcaccagctagctgaacgcggcgaggactgcgaacagcgcgtgtacgcctacntctcccgctccgggagggcctagtgcctgccccagtgcctgctccgcaccaaggccaagcggtggaataccaagtagtgctttaaggggggcccccacccgggaatggcttccaaatggagcaaaaattccggtccccccaacaaaacccggccaaattccgggaaaagttccaaccccaccccccggggattggtgggaa

SEQ ID NO: 41747 - protein, 53 aa, Zea mays
  misc_feature: Ceres CLONE 1438061-F
MGKGSVGASWWAFLLLAGVLLVVAATAGAEDGVVQRDRKEDLLWCKHACEWHY

SEQ ID NO: 41748 - DNA, 636 bp, Zea mays
  misc_feature: Ceres CLONE 1438068-F
  misc_feature: Encodes the peptide sequence at SEQ ID NO. 41749
  misc_feature (636)..(636): n is a, c, t, g, unknown, or other
ggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgacgctggtgggcaagcgacgccgacggcagtgatggcagatgacaagaaagcaggcggn

SEQ ID NO: 41749 - protein, 152 aa, Zea mays
  misc_feature: Ceres CLONE 1438068-F
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDAGGQATPTAVMADDKKAGG

SEQ ID NO: 41750 - DNA, 629 bp, Zea mays
  misc_feature: Ceres CLONE 1438076-F
  misc_feature: Encodes the peptide sequence at SEQ ID NO. 41751
  misc_feature (468)..(468): n is a, c, t, g, unknown, or other
  misc_feature (469)..(469): n is a, c, t, g, unknown, or other
  misc_feature (522)..(522): n is a, c, t, g, unknown, or other
  misc_feature (581)..(581): n is a, c, t, g, unknown, or other
  misc_feature (582)..(582): n is a, c, t, g, unknown, or other
  misc_feature (589)..(589): n is a, c, t, g, unknown, or other
ggagctccccgcggtggcggccgctctagaactagtggatcccccgggctgcaggaattcgcacgagaccattacctagaacatcctaatcgaaaatcttcctcttcctcttcctcttcgtcgcaccaccaccaccaccaccctccctctcctcgcctcccaaaaaaggcgcggcaccaaaaggcgcgagagagaggcacggggaccgcccgcctcgctcgcctgcgcaccggattcgtcgctgcggcggtggttgcagcggcggcggcctggcggggagatgtcttcgcgctcggggtccacgggcggagggagcaccggcggcggcagcagcgcggggggaggcggcgcggtgccgctggccgtgctgctcaggcgggaggtggccagcgagcgcaccgcgtccgagcgcccggagctgcactggggcctcttcagcccagccaagaagggcgaggacttcacctnntctcagcccgaatgcgagcgcgtccctgacgtcccgtcctcctccttctccgncttcgggctggttgatgggcataatgggaacgagccgcaatttacccgagggagatctnnctgacancatctgagtgcggtccaggcgatctgaacgggaaaactgg

SEQ ID NO: 41751 - protein, 100 aa, Zea mays
  misc_feature: Ceres CLONE 1438076-F
  misc_feature (63)..(63): Xaa is any aa, unknown, or other
  misc_feature (81)..(81): Xaa is any aa, unknown, or other
MSSRSGSTGGGSTGGGSSAGGGGAVPLAVLLRREVASERTASERPELHWGLFSPAKKGEDFTXSQPECERVPDVPSSSFSXFGLVDGHNGNEPQFTRGRS

SEQ ID NO: 41752 - DNA, 631 bp, Zea mays
  misc_feature: Ceres CLONE 1438086-F
  misc_feature: Encodes the peptide sequence at SEQ ID NO. 41753
ggagctccccgcggtggcggccgctctagaactagtggatcccccgggctgcaggaattcgcacgagaccattacctagaacatcctaatcgaaaaacattcctaaagtttgtgtccgcaatgatccaaagtccaccaaaccgagatcatgtggaggatcatcaatcatttgatctggaagattggcttccaataacagcatcaagaaatgcaaattggtactattcagctttccacaacgtaactgcaatggttggtgctggagttcttggccttccctacgccatgtcagagcttggatggggacctggggttgcggtgctgatcctgtcatgggtgatcacgttgtacaccctctggcaaatgattgagatgcacgagatgtttgaagggcaacggtttgataggtaccacgagctgggtcaggcagcctttggaaggaagcttggtttgtatatcatcgtgccgctacagcttcttgttgaaaccagtgcgtgcattatctatatggtgaccggaggtgaatcgttgaaaaaggttcatcaactttctgtgggagatgacaagtgcacaaagctgagaatcgaatacttcattttgatatttgcctcttcacagtttgtgctctccc

SEQ ID NO: 41753 - protein, 170 aa, Zea mays
  misc_feature: Ceres CLONE 1438086-F
MIQSPPNRDHVEDHQSFDLEDWLPITASRNANWYYSAFHNVTAMVGAGVLGLPYAMSELGWGPGVAVLILSWVITLYTLWQMIEMHEMFEGQRFDRYHELGQAAFGRKLGLYIIVPLQLLVETSACIIYMVTGGESLKKVHQLSVGDDKCTKLRIEYFILIFASSQFVLS

SEQ ID NO: 41754 - DNA, 633 bp, Zea mays
  misc_feature: Ceres CLONE 1438094-F
  misc_feature: Translation starting site: 233
ctggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaggacaaggtggtgtacggcaccgcggacctcgggcggccgtgcgcgccgttcgccaagaacgcgtcggagatgcacggcttcacgcagggctgcctgaccctgcgcaggtgggacgagctcaacgccttcttccagaaat

SEQ ID NO: 41755 - DNA, 622 bp, Zea mays
  misc_feature: Ceres CLONE 1438098-F
  misc_feature: Encodes the peptide sequence at SEQ ID NO. 41756
tacccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagctggcaaacctttctccctactctcagcaacaacaatttcttccaattcaccaaatgt

SEQ ID NO: 41756 - protein, 158 aa, Zea mays
  misc_feature: Ceres CLONE 1438098-F
MAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSWQTFLPTLSNNNFFQFTKC

SEQ ID NO: 41757 - DNA, 691 bp, Zea mays
  misc_feature: Ceres CLONE 1438131-F
  misc_feature: Encodes the peptide sequence at SEQ ID NO. 41758
  misc_feature (263)..(263): n is a, c, t, g, unknown, or other
  misc_feature (315)..(315): n is a, c, t, g, unknown, or other
  misc_feature (318)..(318): n is a, c, t, g, unknown, or other
  misc_feature (335)..(335): n is a, c, t, g, unknown, or other
  misc_feature (372)..(372): n is a, c, t, g, unknown, or other
  misc_feature (375)..(375): n is a, c, t, g, unknown, or other
  misc_feature (377)..(377): n is a, c, t, g, unknown, or other
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatncgcgtcatcggcaatggcaccgcccttgtgctcttccctctcccggtgcccnacnttcgtggcatctggaanaagcgtgcggtgaagcagtactcgccgatcccgtacntgncnacgctgctgaactgcatgatgtgggtgctttacggcctgccccttgggcaacccacaaaaatggcggggggggacaataaagggaccgggagggccacccagtaaaacacagggggcctttttacccccgtgtccccgggggggggggccccagggggttgttcctttttccccccaaaaagccctctttttcccctttggggggggtgggggccccccgggcccacccacaaagaggggggggtttggcggggggtcttcccccttttttttaaaggaagaggacccccccccccccctaaaattttattttt

SEQ ID NO: 41758 - protein, 83 aa, Zea mays
  misc_feature: Ceres CLONE 1438131-F
  misc_feature (11)..(11): Xaa is any aa, unknown, or other
  misc_feature (29)..(29): Xaa is any aa, unknown, or other
  misc_feature (30)..(30): Xaa is any aa, unknown, or other
  misc_feature (35)..(35): Xaa is any aa, unknown, or other
  misc_feature (48)..(48): Xaa is any aa, unknown, or other
  misc_feature (49)..(49): Xaa is any aa, unknown, or other
MVSADTIRTAXRVIGNGTALVLFPLPVPXXRGIWXKRAVKQYSPIPYXXTLLNCMMWVLYGLPLGQPTKMAGGDNKGTGRATQ

SEQ ID NO: 41759 - DNA, 643 bp, Zea mays
  misc_feature: Ceres CLONE 1438136-F
  misc_feature: Encodes the peptide sequence at SEQ ID NO. 41760
  misc_feature (584)..(584): n is a, c, t, g, unknown, or other
aaagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaacaggaggacgcgtcggtgctgtggacggagagcaaggacgtgggcaagggcttccgctgcatccgcatggtcaacaacacccgccctcacttcgacgccttccacggggacnaggaccacggcgggctggcacgaggccaccgccctcctgctctggggagtggttgcagg

SEQ ID NO: 41760 - protein, 161 aa, Zea mays
  misc_feature: Ceres CLONE 1438136-F
  misc_feature (142)..(142): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPEQEDASVLWTESKDVGKGFRCIRMVNNTRPHFDAFHGDXDHGGLARGHRPPALGSGCR

SEQ ID NO: 41761 - DNA, 675 bp, Zea mays
  misc_feature: Ceres CLONE 1438150-F
  misc_feature: Encodes the peptide sequence at SEQ ID NO. 41762
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcctcagccagactggtgctgggaagcacgttccccgtgcaatcttcgttgatctagaacccactgtgatcgatgaggtgcgcactgggacgtaccgccagctcttccagcctgagcagctcatcagtgggcagggagatgccgctaacatttccgcccgtgggcacaaccaatttggcaaagaaaattgtgatcggggcttggaccgatcccgaagtttgttgaccatggcaccggcctccaggggttcttggctttaatg

SEQ ID NO: 41762 - protein, 137 aa, Zea mays
  misc_feature: Ceres CLONE 1438150-F
MRECISVHIGQAGIQVGNACWELYCLEHGIQPDGQVPGDKTAGHHDDAFSTFLSQTGAGKHVPRAIFVDLEPTVIDEVRTGTYRQLFQPEQLISGQGDAANISARGHNQFGKENCDRGLDRSRSLLTMAPASRGSWL

SEQ ID NO: 41763 - DNA, 645 bp, Zea mays
  misc_feature: Ceres CLONE 1438151-F
  misc_feature: Encodes the peptide sequence at SEQ ID NO. 41764
  misc_feature (445)..(445): n is a, c, t, g, unknown, or other
  misc_feature (458)..(458): n is a, c, t, g, unknown, or other
  misc_feature (499)..(499): n is a, c, t, g, unknown, or other
  misc_feature (548)..(548): n is a, c, t, g, unknown, or other
  misc_feature (563)..(563): n is a, c, t, g, unknown, or other
  misc_feature (599)..(599): n is a, c, t, g, unknown, or other
  misc_feature (603)..(603): n is a, c, t, g, unknown, or other
aagctggagctccccgcggtggcggccgctctagaactagtggatcccccgggctgcaggaattcgcacgagaccattacctagaacatcctaatcgaaaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcanggactaccgtggncagatttgaactgagctcacccagatctgtgatggcatccntcagcttctcgaatctcaccttgtgccgtcttccaccgctcccgagtcnagggtctctatctcnagatgaagggtgactactacagataccttgctgaantcangactggagctgaaagaaagacgctgctgaaacaccatggtgg

SEQ ID NO: 41764 - protein, 95 aa, Zea mays
  misc_feature: Ceres CLONE 1438151-F
  misc_feature (89)..(89): Xaa is any aa, unknown, or other
MASAELSREENVYMAKLAEQAERYEEMVEFMEKVAKTVDSEELTVEERNLLSVAYKNVIGARRASWRIISSIEQKEEGRGNEDRVTLIXDYRGQI

SEQ ID NO: 41765 - DNA, 770 bp, Zea mays
  misc_feature: Ceres CLONE 1438163-F
  misc_feature (20)..(20): n is a, c, t, g, unknown, or other
  misc_feature (259)..(259): n is a, c, t, g, unknown, or other
  misc_feature (260)..(260): n is a, c, t, g, unknown, or other
  misc_feature (277)..(277): n is a, c, t, g, unknown, or other
  misc_feature (285)..(285): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (310)..(310): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (331)..(331): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (337)..(337): n is a, c, t, g, unknown, or other
  misc_feature (342)..(342): n is a, c, t, g, unknown, or other
  misc_feature (344)..(344): n is a, c, t, g, unknown, or other
  misc_feature (345)..(345): n is a, c, t, g, unknown, or other
  misc_feature (351)..(351): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (438)..(438): n is a, c, t, g, unknown, or other
  misc_feature (451)..(451): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (461)..(461): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (519)..(519): n is a, c, t, g, unknown, or other
  misc_feature (520)..(520): n is a, c, t, g, unknown, or other
  misc_feature (522)..(522): n is a, c, t, g, unknown, or other
  misc_feature (525)..(525): n is a, c, t, g, unknown, or other
  misc_feature (539)..(539): n is a, c, t, g, unknown, or other
  misc_feature (546)..(546): n is a, c, t, g, unknown, or other
  misc_feature (547)..(547): n is a, c, t, g, unknown, or other
  misc_feature (625)..(625): n is a, c, t, g, unknown, or other
  misc_feature (627)..(627): n is a, c, t, g, unknown, or other
cccgctggagctcaccgcgntggcggccgctctagcactagtggatcccccgggctgcaggaattcgcacgagaccattacctagaacatcctaatcgaaaactacactgagaaccgcagagacaggagtcttcgtactcgactatctcggagactcaatgctttccccaattcccccacttctctcatttctcagcacgggcggcgcgcaccccgttgcggagctccacggcgcgagtgtttgttgatttttataaannacagtgggggggggggngtctgccnccaagcnnnnngggggtggaggggncgggcggggggggggnnnggncnnncnccccncnnaggggngggttgggtttcggtgtggttttttgttgtttgtttcagngnnnngttgtgtttgtccccccccccccccccccccccccccccccngggggggggggtnggnnnnngcngannnnnnnnnnngnnnnnnnggccgnnnnggggggggggtgggcggggggggggggnngnagncagaacagcgcccngccccannttgaagccccaagcaacaaaacacgcaaatatgtatgacaagaaaaaaacccttcttcagaaaaccaacaccggcgcngncgcagcgttctccttcgtgtcgcgggtttttcgccccctccccccccccggcgggcacacggagcggccggaacgaatcatcttatcgacaaacgaaagcaccgcacgttcccaccgctctcccagttctataacctgcttcc

SEQ ID NO: 41766 - DNA, 675 bp, Zea mays
  misc_feature: Ceres CLONE 1438164-F
  misc_feature: Encodes the peptide sequence at SEQ ID NO. 41767
  misc_feature (402)..(402): n is a, c, t, g, unknown, or other
  misc_feature (502)..(502): n is a, c, t, g, unknown, or other
tggagctccccgcggtggcggccgctctagaactagtggatcccccgggctgcaggaattcgcacgagaccattacctagaacatcctaatcgaaaaacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtcccgtcagtacaactgccggaccagaacccgcgtccccaagctcngggtgatgcttgtggggtggggaggcacaacgggtcacgctgacggctggggtcattgccacagggaggggatctcatgggcgaccaaggacaggggaanaaaggcaactactacgggtcccctccccaggcctcaccatcggaagtcgaagctacaacggggaagaaatcttatggccgtttcaaaagccccctcccctgggggaaacccaaacaaatttgggttcggaggggggggaatttaacaaatggaccctggcccaatccctgaac

SEQ ID NO: 41767 - protein, 143 aa, Zea mays
  misc_feature: Ceres CLONE 1438164-F
  misc_feature: SWISSPROT Homolog: EC 5.5.1.4 Inositol-3-phosphate synthase
  misc_feature (63)..(63): Xaa is any aa, unknown, or other
  misc_feature (96)..(96): Xaa is any aa, unknown, or other
MFIESFRVESPHVRYGPTEIESEYRYDTTELVHEGKDGASRWVVRPKSRQYNCRTRTRVPKLXVMLVGWGGTTGHADGWGHCHREGISWATKDRGXKATTTGPLPRPHHRKSKLQRGRNLMAVSKAPSPGGNPNKFGFGGGGI

SEQ ID NO: 41768 - DNA, 655 bp, Zea mays
  misc_feature: Ceres CLONE 1438166-F
  misc_feature: Encodes the peptide sequence at SEQ ID NO. 41769
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (655)..(655): n is a, c, t, g, unknown, or other
aaaactggagctccccgcggtggcggccgctctagtctagtggatcccccgggctgcaggaattcgcacgagaccattacctagaacatcctaatcgaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctcnnntgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgnnntcgaggccggcaggctcaagggctccacgctccttaccgaaggagtggtgacggatggatcagatgaatgggcaatctacggcgggaccggagagtttgctatggcgagaggtgtcgttnnnntaaggactccagcatctctgtcaccaagattgggttatggggtggcgaaagagggtcggcgcaggacatcacgacgacggagccaccgcagcgn

SEQ ID NO: 41769 - protein, 168 aa, Zea mays
  misc_feature: Ceres CLONE 1438166-F
  misc_feature (7)..(156): Pfam Name: Dirigent Pfam Description: Dirigent-like protein
  misc_feature (51)..(51): Xaa is any aa, unknown, or other
  misc_feature (96)..(96): Xaa is any aa, unknown, or other
  misc_feature (97)..(97): Xaa is any aa, unknown, or other
  misc_feature (137)..(137): Xaa is any aa, unknown, or other
  misc_feature (138)..(138): Xaa is any aa, unknown, or other
MENPAPSIVVPPIAAPVSANFSRLAFRNLYIRRTGPDSREMVTVEGRRGSXDQTGDMRYVSDFPVYDGRGSDAVLVARVQGVTTTFGNSNQFFTVXXEAGRLKGSTLLTEGVVTDGSDEWAIYGGTGEFAMARGVVXXRTPASLSPRLGYGVAKEGRRRTSRRRSHRS

SEQ ID NO: 41770 - DNA, 644 bp, Zea mays
  misc_feature: Ceres CLONE 1438167-F
  misc_feature: Encodes the peptide sequence at SEQ ID NO. 41771
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
ctccccgcggtggcggccgctctagaactagtggatcccccgggctgcaggaattcgcacgagaccattacctagaacatcctaatcgaaaaatccgatagaccggggacgcacaggcctctcgccctccgcgcggctccacaggagagcaaaaatggcgaccctctccatggtctccgtccccatcgcaccctcctccttgtccctttccacccggggccgcagctcctccgcatccttccccgctaagaagggaggaatcggtcacggtggcttgcggatcgagtgcatccgtattggtggtgttgagattccaaaccacaagagggtggagtactcgnnncagtacatacatggcattggacgctcacgctcacgccagatcctcctggacctcaatttcgataacaagatcaccaaggacctctccgaggannnngtcatcaccctccgtaaggaggttggcaagtacatgattgagggagaccttaaacgtttcaaccgtgtggcgattgagaggctnnnngagattaggtgctacaagggcatccggcacaagcttggactcccagttcgtggccagaggacaaagaacaactgccggacacttaagggannnnttgcttcagttgccaagaagaagt

SEQ ID NO: 41771 - protein, 163 aa, Zea mays
  misc_feature: Ceres CLONE 1438167-F
  misc_feature (47)..(151): Pfam Name: Ribosomal_S13 Pfam Description: Ribosomal protein S13/S18
  misc_feature (63)..(63): Xaa is any aa, unknown, or other
  misc_feature (94)..(94): Xaa is any aa, unknown, or other
  misc_feature (95)..(95): Xaa is any aa, unknown, or other
  misc_feature (124)..(124): Xaa is any aa, unknown, or other
  misc_feature (155)..(155): Xaa is any aa, unknown, or other
  misc_feature (156)..(156): Xaa is any aa, unknown, or other
MATLSMVSVPIAPSSLSLSTRGRSSSASFPAKKGGIGHGGLRIECIRIGGVEIPNHKRVEYSXQYIHGIGRSRSRQILLDLNFDNKITKDLSEXXVITLRKEVGKYMIEGDLKRFNRVAIERLXEIRCYKGIRHKLGLPVRGQRTKNNCRTLKGXXASVAKKK

SEQ ID NO: 41772 - DNA, 653 bp, Zea mays
  misc_feature: Ceres CLONE 1438169-F
  misc_feature: Encodes the peptide sequence at SEQ ID NO. 41773
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
aagctggagctcaccgcggtggcggccgctctagaactagtggatcccccgggctgcaggaattcgcannnaaccattacctagaacatcctaatcgaaaaaatcgagcatcgcagagataggcgtcttcgtactcgcctacctccgcggctcaaacctttcccccttctcccaattccctnnntcggccgccgctccatcccgtacgacgacaccatgagggagtgcatttcgatccacatcggccaggccggtatccaggtcggaaacgcgtgctgggagctgtacnnncttgagcatggcattcaggctgacggtcagatgcccggtgacaagaccattgggggaggtgatgatgctttcaacaccttcttcagtgagactggtgctgggaagcacgtgccccnnnctgtttttgttgaccttgaacccactgtcatcgatgaggtgaggactggcacctaccgccagctcttccaccctgagcagctcatcagtgggaaggaggatgcagccaacaactttgcccggnnncactacaccattggcaaggagattgttgacctatgccttgatcgcatcaggaagcttgccgacaactgcactggtctccagggcttcctcgtcttcaacgctgttggtggaggaacggg

SEQ ID NO: 41773 - protein, 145 aa, Zea mays
  misc_feature: Ceres CLONE 1438169-F
  misc_feature (49)..(145): Pfam Name: Tubulin Pfam Description: Tubulin/FtsZ family, GTPase domain
  misc_feature (25)..(25): Xaa is any aa, unknown, or other
  misc_feature (64)..(64): Xaa is any aa, unknown, or other
  misc_feature (65)..(65): Xaa is any aa, unknown, or other
  misc_feature (106)..(106): Xaa is any aa, unknown, or other
MRECISIHIGQAGIQVGNACWELYXLEHGIQADGQMPGDKTIGGGDDAFNTFFSETGAGKHVPXXVFVDLEPTVIDEVRTGTYRQLFHPEQLISGKEDAANNFARXHYTIGKEIVDLCLDRIRKLADNCTGLQGFLVFNAVGGGT

SEQ ID NO: 41774 - DNA, 660 bp, Zea mays
  misc_feature: Ceres CLONE 1438177-F
  misc_feature: Encodes the peptide sequence at SEQ ID NO. 41775
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
ctccccgcggtggcggccgctctagaactagtggatcccccgggctgcaggaattcgcacgagaccattacctagaacatcctaatcgaaaaattgagtctaagacgtcgtctgcgtttggaaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttnnnaagaagaaatatttagtgccgtctgacttgactgttggtcagttctacttcttgatccgcaagcgtatccatcttcgacctgaggatgcccttttcttcctcgtaaacagtgtagttccacccagcagtgccaccagnnnttcactctatcaggagcaccatgaagaggactttttcttgtacattgcttacagtgatgagaatgtttatggaaaattataacttaaacacctaaactacagccaggaatttcgaagcagnnnnaacaaaatgaaaaaatcaacaaaaagcttaaaacctacttagaaaccttacaaaaaaaaattaaaaaccctctgaggcatctgctttttagaatgt

SEQ ID NO: 41775 - protein, 118 aa, Zea mays
  misc_feature: Ceres CLONE 1438177-F
  misc_feature (13)..(116): Pfam Name: MAP1_LC3 Pfam Description: Microtubule associated protein 1A/1B, light chain 3
  misc_feature (45)..(45): Xaa is any aa, unknown, or other
  misc_feature (91)..(91): Xaa is any aa, unknown, or other
  misc_feature (92)..(92): Xaa is any aa, unknown, or other
MKFQYKEEHAFEKRKSEGEKIRRKYPDRVPVIVEKAPKARIGDLXKKKYLVPSDLTVGQFYFLIRKRIHLRPEDALFFLVNSVVPPSSATXXSLYQEHHEEDFFLYIAYSDENVYGKL

SEQ ID NO: 41776 - DNA, 688 bp, Zea mays
  misc_feature: Ceres CLONE 1438179-F
  misc_feature: Encodes the peptide sequence at SEQ ID NO. 41777
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
aaagcttgagctccccgcggtggcggccgctctagaactagtggatcccccgggctgcaggaattcgcacgagaccattacctagaacatcctaaaaaaaaaatttcggccacaccctccttgcctccacggctccacccctgcttcaggttacctgtgccagcgacgccggtagaagccatggacagctctctcgcgagcgcggcggcgatagccgatcagcgccagaagatcgagcagtaccgccacatcctcgcctccgtcctctcgtcttccccaccggacatctctcaggccaagcgcttcctcgacnnnntggtttcggacgaagttccgctcgtggtgtcgcgtcaattgctccagacgttcgcgcaggacctagggaagctggagtcggacgcgcagaaggaggttgcccactacgcgctcacgcagatccagccgcgtgtggtctcnnnngaggagcaggtggtagtgattagagagaagcttgcagagctatatgagtctgaacaacaatggtcaaaagcagcacaaatgcttagtgggattgacttggattcaggaatcaggatgcttgatgannnaacaaattatccaagtgtgttcaaattgcacgactctatttagaggatgatgatgcagtgaatgctgaggcttttataaacaaggcttcatttttggtcac

SEQ ID NO: 41777 - protein, 149 aa, Zea mays
  misc_feature: Ceres CLONE 1438179-F
  misc_feature (45)..(45): Xaa is any aa, unknown, or other
  misc_feature (46)..(46): Xaa is any aa, unknown, or other
  misc_feature (93)..(93): Xaa is any aa, unknown, or other
  misc_feature (135)..(135): Xaa is any aa, unknown, or other
  misc_feature (136)..(136): Xaa is any aa, unknown, or other
MDSSLASAAAIADQRQKIEQYRHILASVLSSSPPDISQAKRFLDXXVSDEVPLVVSRQLLQTFAQDLGKLESDAQKEVAHYALTQIQPRVVSXEEQVVVIREKLAELYESEQQWSKAAQMLSGIDLDSGIRMLDXXTNYPSVFKLHDSI

SEQ ID NO: 41778 - DNA, 666 bp, Zea mays
  misc_feature: Ceres CLONE 1438185-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (81)..(81): n is a, c, t, g, unknown, or other
  misc_feature (87)..(87): n is a, c, t, g, unknown, or other
  misc_feature (91)..(91): n is a, c, t, g, unknown, or other
  misc_feature (92)..(92): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (160)..(160): n is a, c, t, g, unknown, or other
  misc_feature (174)..(174): n is a, c, t, g, unknown, or other
  misc_feature (334)..(334): n is a, c, t, g, unknown, or other
  misc_feature (335)..(335): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (572)..(572): n is a, c, t, g, unknown, or other
  misc_feature (573)..(573): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnggggggngggggncccnncnnnnnnnnnnnnccccccnnnnnnnnnnnnnnnnnnnnnnnnnnnccaaaactggagactccaccgncggtgggcggccgnctctagaaactagtggatccccccgggctgcaggaaattcgcacgaagaccattacctagaacatcctaatcgataaacacactcgcttcccccagccgcacgaaaccctaacgccgccgccgcttcacaggtaaaccgccgacatggtctccggttccnncgtatgctctaagcgcatcgtggtggacgcgcgccaccacatgcatggaccgcctgtcgtcaattattctcaaggaaactgctcaaatgggcaaaagggtggccgtccatccgcctccgnnnaaaatttggaatattcccggggggcctcctaaccccccaaaaaaagaaaataccctcccccttttttcccaaaaaagggggaaaaaaaaacccaaagcccctccggggggggggnntggtcccatttttccccggcgcccggttcaaaaaaaaaccggtggggcagaacccccccccccgcggggaaaattattccccccacaaaaaaa

SEQ ID NO: 41779 - DNA, 650 bp, Zea mays
  misc_feature: Ceres CLONE 1438191-F
  misc_feature: Encodes the peptide sequence at SEQ ID NO. 41780
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcannnnctgacggtggcgacgctgttcccgctgggcgggctgctgctggtgctgtcggggctggcgctgacggcctccgtggtggggctggccgtggnnncgccggtgttcctgatcttcagccccgtgctggtccccgccgcgctgctcatcgggacggccgtcatggggttcctcacgtcgggnnnnctggggctcgggggcctgtcctcgctcacgtgcctcgccaacacggcgcggcaggcgttccagcgcaccccggactacgtggaggaggcgnnnnncangatggcggaggccgcggcgc

SEQ ID NO: 41780 - protein, 148 aa, Zea mays
  misc_feature: Ceres CLONE 1438191-F
  misc_feature (44)..(147): Pfam Name: Oleosin Pfam Description: Oleosin
  misc_feature (47)..(47): Xaa is any aa, unknown, or other
  misc_feature (48)..(48): Xaa is any aa, unknown, or other
  misc_feature (79)..(79): Xaa is any aa, unknown, or other
  misc_feature (80)..(80): Xaa is any aa, unknown, or other
  misc_feature (109)..(109): Xaa is any aa, unknown, or other
  misc_feature (140)..(140): Xaa is any aa, unknown, or other
  misc_feature (141)..(141): Xaa is any aa, unknown, or other
  misc_feature (142)..(142): Xaa is any aa, unknown, or other
MADRDRSGIYGGAHATYGQQQQQGGGGRPMGEQVKGMLHDKGPTASXXLTVATLFPLGGLLLVLSGLALTASVVGLAVXXPVFLIFSPVLVPAALLIGTAVMGFLTSGXLGLGGLSSLTCLANTARQAFQRTPDYVEEAXXXMAEAAA

SEQ ID NO: 41781 - DNA, 816 bp, Zea mays
  misc_feature: Ceres CLONE 1438193-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (216)..(216): n is a, c, t, g, unknown, or other
  misc_feature (217)..(217): n is a, c, t, g, unknown, or other
  misc_feature (219)..(219): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (316)..(316): n is a, c, t, g, unknown, or other
  misc_feature (318)..(318): n is a, c, t, g, unknown, or other
  misc_feature (320)..(320): n is a, c, t, g, unknown, or other
  misc_feature (332)..(332): n is a, c, t, g, unknown, or other
  misc_feature (333)..(333): n is a, c, t, g, unknown, or other
  misc_feature (354)..(354): n is a, c, t, g, unknown, or other
  misc_feature (355)..(355): n is a, c, t, g, unknown, or other
  misc_feature (370)..(370): n is a, c, t, g, unknown, or other
  misc_feature (371)..(371): n is a, c, t, g, unknown, or other
  misc_feature (384)..(384): n is a, c, t, g, unknown, or other
  misc_feature (485)..(485): n is a, c, t, g, unknown, or other
  misc_feature (486)..(486): n is a, c, t, g, unknown, or other
  misc_feature (522)..(522): n is a, c, t, g, unknown, or other
  misc_feature (607)..(607): n is a, c, t, g, unknown, or other
  misc_feature (608)..(608): n is a, c, t, g, unknown, or other
  misc_feature (725)..(725): n is a, c, t, g, unknown, or other
  misc_feature (726)..(726): n is a, c, t, g, unknown, or other
nnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnccccnnnnnncnnnnnnnnnnnnnnnnnnnnncccnncnccnnnnnnnnnnnnnnnnnnnnnnnnnnnnnnnnnnnnnnnnnnnnnnnnnnnnnnnnnnnnnnnnnnnnnnnccaaaaactgggaagctccaccgncngntggggcggccgnnctctagtaactagtggaatcnnccccgggctgcaggnnaattcgcacgaanaccattacctagaacatcctaatcgaaaaaccaactccaactgcaaccccaccccataccgccgccgcctccgctagggttttggagtgaggatcgccganntcgacggctcacaggcgccccctccgagggcgcggncgccccgccccctggcacccggctacgtcccgcgcgggccccggcccctggccccaggcccccgccggaccgggcgcccaagaanncggcggcaagccccgtccttcacccaacccgtcgaacaagcttgggcccccccaaaaacggaaggggcaaaaaccctttaaggggcccgggggtatttttcccgccccggacccggnnacctccaaaaaagccccctcccagggaaaaattggggcgcggcccccccccgggtttaaaaaaaaggcccccccccccgggaaaaaaaaa

SEQ ID NO: 41782 - DNA, 670 bp, Zea mays
  misc_feature: Ceres CLONE 1438201-F
  misc_feature: Encodes the peptide sequence at SEQ ID NO. 41783
  misc_feature (361)..(361): n is a, c, t, g, unknown, or other
  misc_feature (362)..(362): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (549)..(549): n is a, c, t, g, unknown, or other
  misc_feature (550)..(550): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
aagctggagctccccgcggtggcggccgctctagaactagtggatcccccgggctgcaggaattcgcacgagaccattacctagaacatcctaatcgaaaaatcaagcacgcatcccccacacacacagctagctagcatatcgtttcgagtgaagatccaaagaggtagagagatggaaaggatgagttcgtcgctgcagtactgggtggaggagcacaagctctcaaccatcggagccgtgtgggcgacggcggtgggcgcgtcggtggcgtacagccggcggcgggcgccggcgcgggcgacgggcatgctcctcatccacgccaggatgcacgcgcaggcgctcacgctcgccgtcnntttttgagccgcgctcgcgcaccactaccacggcaagagcaccaacgccgggaagacgcagcagcaggaggacctggactacggcttctactcgcnnnngccgccggccaccgacgccgacggcaacgagaacgagcgctggagctggtagagcatgctgcatcgggacaagaacaagacttttttnntaagaaagaaaaaacaataaattagtagcaataattggtgggtggtttggcatttggcaatgatgcgtgacgtggcgcctgcatgctttcttgnnnccctccctaatccgatcctaatcc

SEQ ID NO: 41783 - protein, 64 aa, Zea mays
  misc_feature: Ceres CLONE 1438201-F
  misc_feature (63)..(63): Xaa is any aa, unknown, or other
MERMSSSLQYWVEEHKLSTIGAVWATAVGASVAYSRRRAPARATGMLLIHARMHAQALTLAVXF

SEQ ID NO: 41784 - DNA, 673 bp, Zea mays
  misc_feature: Ceres CLONE 1438202-F
  misc_feature: Encodes the peptide sequence at SEQ ID NO. 41785
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (298)..(298): n is a, c, t, g, unknown, or other
  misc_feature (299)..(299): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
ggagctccccgcggtggcggccgctctagaactagtggatcccccgggctgcaggaattcgcacgagaccatnnnctagaacatcctaatcgaaaaatatagatccgcatcgtcgaccccatccgtggtgctcccggtgcgccaggctaccagagtccgacgcaggcgtagctcccggccacagcannncccacgccttgacgcgctccgtgtgagtggagcatacgggcgccggccggcggccagagaggaaacggatcgaggaggctcagctgagtggaggagatggaccgcaagnntgtcgggatcctcgccatggacatctacttcccgccctcctgcgtgcagcaggaggcacttgaggcccatgatggggcgagcaaagggaagtacaccattgggcttgggcaagattgcannnccttttgcagcgaggtggaggatgtcatctcaatgagtttgacggttgtcaattctctgctgaaaaaatacaagattgatcccaagttaatcggtcgcttggaggttggaagtgaaacagttatannnnaaagtaaatccatcaaaacttggctgatgcagatctttgaggaaagtggtaacagtgacattgaaggtgttgactccagcaatgcatgttatggcgggacagcagccctactgaattgtgtga

SEQ ID NO: 41785 - protein, 129 aa, Zea mays
  misc_feature: Ceres CLONE 1438202-F
  misc_feature (2)..(129): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
  misc_feature (5)..(5): Xaa is any aa, unknown, or other
  misc_feature (45)..(45): Xaa is any aa, unknown, or other
  misc_feature (46)..(46): Xaa is any aa, unknown, or other
  misc_feature (88)..(88): Xaa is any aa, unknown, or other
  misc_feature (89)..(89): Xaa is any aa, unknown, or other
MDRKXVGILAMDIYFPPSCVQQEALEAHDGASKGKYTIGLGQDCXXFCSEVEDVISMSLTVVNSLLKKYKIDPKLIGRLEVGSETVIXXSKSIKTWLMQIFEESGNSDIEGVDSSNACYGGTAALLNCV

SEQ ID NO: 41786 - DNA, 678 bp, Zea mays
  misc_feature: Ceres CLONE 1438203-F
  misc_feature: Encodes the peptide sequence at SEQ ID NO. 41787
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
aaagctggagctcaccgcggtggcggccgctctagaactagtggatcccccgggctgcaggaattcgcacgagacnnntacctagaacatcctaatcgaaaagctggccgctgcttaacaaaccgccgccacaggacaagacaaacttattacagctccacctcagtgctgcagagactgagggccagcnnnnccgctcaccgcacacgcggaattcaagcagcatgtacgccgacgccgggttcgccttcgccttcgccgccgcctactcccccaccctcacttcctcgcagccccagcnnncgccgccgccgttcgactacgccttctcctccgagccacccctcctctccatgcccgccatggaccacgacgcctacctggggaacttggtacagccatccatggtatcagaatatgannnngggaggagaaggggacctgttcaaagctccagaagccatcatcgaggaaccgctgctcagcctcgatcctgtcgcagctgccttttcaatgatggctggcaatggaagtgctgtcatggatcaaannnntaaggacgcaggcaccggcaccatccaaaatgaaccccctcctgagtgaggtgctgtacgagtgcgagaaggaactcatggagaagtccacaatcgaagagacaatttctgaacttatggatgt

SEQ ID NO: 41787 - protein, 61 aa, Zea mays
  misc_feature: Ceres CLONE 1438203-F
  misc_feature (2)..(2): Xaa is any aa, unknown, or other
  misc_feature (3)..(3): Xaa is any aa, unknown, or other
  misc_feature (45)..(45): Xaa is any aa, unknown, or other
  misc_feature (46)..(46): Xaa is any aa, unknown, or other
MXXGGEGDLFKAPEAIIEEPLLSLDPVAAAFSMMAGNGSAVMDQXXKDAGTGTIQNEPPPE

SEQ ID NO: 41788 - DNA, 679 bp, Zea mays
  misc_feature: Ceres CLONE 1438210-F
  misc_feature: Encodes the peptide sequence at SEQ ID NO. 41789
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
aaactggagctccccgcggtggcggccgctctagaactagtggatcccccgggctgcaggaattcgcacgagaccattacctagaacatcctaatcaaaaatcagatccctcccgcagtctcgcgcgctctcccccacccacccaccccctatccatccatccatcccacctcctgctccacatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccannnnctgcaacagccgcgcgccgatgtctctgcaggccgccgccgccgcacctgccgccggcgcggtcgacgaggagactcctgcctcctcccctccgnnnaatgctagcaagggggtggagaacctggtgatcatcggctctgaccagccggttacaccgctgccatctacgccgcccgggcgaacctgnnncctgtcgtgtttgaagggtgccagatggggggtgtccccggcgggcagctgatgaccaccaccgaggtggagaatttccctggcttcccggacggnnnnaccgggcctgatctcatggacagaa

SEQ ID NO: 41789 - protein, 33 aa, Zea mays
  misc_feature: Ceres CLONE 1438210-F
  misc_feature: SWISSPROT Homolog: EC 1.8.1.9 Thioredoxin-disulfide reductase
  misc_feature (25)..(25): Xaa is any aa, unknown, or other
MGGVPGGQLMTTTEVENFPGFPDGXTGPDLMDR

SEQ ID NO: 41790 - DNA, 636 bp, Zea mays
  misc_feature: Ceres CLONE 1438218-F
  misc_feature: Encodes the peptide sequence at SEQ ID NO. 41791
  misc_feature (331)..(331): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (434)..(434): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (522)..(522): n is a, c, t, g, unknown, or other
  misc_feature (524)..(524): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
gctctagaactagtggatcccccgggctgcaggaattcgcacgagaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgctgtgttnttaggtgcggaggggccgcgcccgagccgctacgagtcgcagaagcggcgggactggcacacgttcgggcagtacctgcgcaaccaccggccgcnnnagtacntggcgcggtgcagcggcgcgcacgtgctcgagttcctgcgctacctcgaccagttcggcaagaccaaggtccatttattgnnntaacncnttcttcggccacccgtcgccgcccgcgccgtgcccgtgcccgctgcggcaggcctggggcagcctcgacgcgctcatcggccgcgnnnnnnnnnnnnnnattttnnnnnnnn

SEQ ID NO: 41791 - protein, 77 aa, Zea mays
  misc_feature: Ceres CLONE 1438218-F
  misc_feature (8)..(79): Pfam Name: DUF640 Pfam Description: Protein of unknown function (DUF640)
  misc_feature (16)..(16): Xaa is any aa, unknown, or other
  misc_feature (48)..(48): Xaa is any aa, unknown, or other
  misc_feature (49)..(49): Xaa is any aa, unknown, or other
  misc_feature (51)..(51): Xaa is any aa, unknown, or other
MQVGGGAADSPGAAVXLGAEGPRPSRYESQKRRDWHTFGQYLRNHRPXXYXARCSGAHVLEFLRYLDQFGKTKVHLL

SEQ ID NO: 41792 - DNA, 675 bp, Zea mays
  misc_feature: Ceres CLONE 1438226-F
  misc_feature: Encodes the peptide sequence at SEQ ID NO. 41793
  misc_feature (366)..(366): n is a, c, t, g, unknown, or other
  misc_feature (443)..(443): n is a, c, t, g, unknown, or other
  misc_feature (449)..(449): n is a, c, t, g, unknown, or other
  misc_feature (454)..(454): n is a, c, t, g, unknown, or other
  misc_feature (491)..(491): n is a, c, t, g, unknown, or other
  misc_feature (607)..(607): n is a, c, t, g, unknown, or other
ctggagctcaccgcggtggcggccgctctagaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgaggcggctcttcctcgcggcggcggcgctgctgatggctgtgcttctgctcgtcgcggggccggtggcggcgcaggacgcggcggtggagggcgtgcccccgcccctgcgagagatcgcggcgaacgcgagggcaaggaggcggcngttctggccgccgagctagtgcagctcagggcgaagatctccgcgttagagtctcgcattgcagagcagaacctggnagtcangaccnagaatgatgcaatcgaaacactgaatatgattgtcanggaaaagtcacagaagattgctactatgcagaatgaagtaacttccctcgaggccaagggtctttagctgcagaggagcaggcaagcagggccaatgcactggctattgagctcangaaccagaccgagaagctcaggagggatattaagaaacaaaaatttaaaaagcagctctggaggctag

SEQ ID NO: 41793 - protein, 58 aa, Zea mays
  misc_feature: Ceres CLONE 1438226-F
  misc_feature (53)..(53): Xaa is any aa, unknown, or other
MWIARRLFLAAAALLMAVLLLVAGPVAAQDAAVEGVPPPLREIAANARARRRXFWPPS

SEQ ID NO: 41794 - DNA, 650 bp, Zea mays
  misc_feature: Ceres CLONE 1438227-F
  misc_feature: Encodes the peptide sequence at SEQ ID NO. 41795
ctggagctccccgcggtggcggccgctctagaactagtggatcccccgggctgcaggaattcgcacgagaccattacctagaacatcctaatcgaaaactcaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcgccgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcggacgccggggcgggggtgtcggagggcgaggctgaggaggacgacggcggcggcgtgaaggaggaacacgaggaggaggatgagggcgagctcgaggaaggggaatggatgcccagcatggaggggttcgtgcgatacctggtggacagcaggctcgtcttcggaacctcgagcgggtcgtggccgagtccaccgatgtcccctatgtttactc

SEQ ID NO: 41795 - protein, 96 aa, Zea mays
  misc_feature: Ceres CLONE 1438227-F
MRFVAMRLRNPKRTTIKDKSGTEDADAGAGVSEGEAEEDDGGGVKEEHEEEDEGELEEGEWMPSMEGFVRYLVDSRLVFGTSSGSWPSPPMSPMFT

SEQ ID NO: 41796 - DNA, 657 bp, Zea mays
  misc_feature: Ceres CLONE 1438231-F
  misc_feature: Encodes the peptide sequence at SEQ ID NO. 41797
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaaatttttcttttgattgaccggcggcgatggacgcattgagagcttcttacggtgactcttcatcggactcggatactgatgatctctctccggctgctgaaaatcacggcgaggtatcaacctctggaaaacacgggaaggagtcgatttctctgcctcctccgccgctttcgcttctcgaatccattggatccacaggttctttggatgtctactcaacgaagactgtgactagagtaaggaactttcctcatgtcgatggaaactaccccttgcatgtttacatccctgtttttataccactattggcgaagaaagagattgcctgtgtttttaagagggttgcatcacttgttccccatcttcatttggtcgaagctgatattccactcagcattctttgcaacgatgaaccaaaagcttgaccctgctttgggggaaaaggttccaattaagcctgggaaggaggcgtcccccctccgggttcacaaaaataaaccccccgggtttccaccccnnnnnnaaaaaatttcgtttacccagaaaattttgggg

SEQ ID NO: 41797 - protein, 132 aa, Zea mays
  misc_feature: Ceres CLONE 1438231-F
MDALRASYGDSSSDSDTDDLSPAAENHGEVSTSGKHGKESISLPPPPLSLLESIGSTGSLDVYSTKTVTRVRNFPHVDGNYPLHVYIPVFIPLLAKKEIACVFKRVASLVPHLHLVEADIPLSILCNDEPKA

SEQ ID NO: 41798 - DNA, 672 bp, Zea mays
  misc_feature: Ceres CLONE 1438235-F
  misc_feature: Encodes the peptide sequence at SEQ ID NO. 41799
  misc_feature (520)..(520): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaattttgcaggaatccaaatcattcgccctctagatcgtgctgccatgtctctgtccacccccaccaccttgtgttccgcgacgtctcctctctctctctctctctctagagttgctgatagtttttttactaactcactccaccaaatccgttccaattccggtgcaaactgcttgttcgtgcgagacaataaagccatggaactagctaacccttgctgaactgtggaatggtttctgagcagagcgtggcggagctgaagcagaccctgctggcgaccacgctggagctggaggcggcgagggaggagctgaggcggaaggagcaaagcatcgccaagctgtcggacctggtgcgcgaggtggccaaggagcgcgacgacgcgcgggacctagcgcagagcctccgcctcctcgcnntgccagccgcgcccgcgctcgtcacgtccagcgtcaccgactccgactgcagcctcgcgtcgtccccggtggaccgttcttcgaccccgtcacgtcgccaacaaggggggggcctgaagttaagccctggcaagccgccgggccggccaaa

SEQ ID NO: 41799 - protein, 113 aa, Zea mays
  misc_feature: Ceres CLONE 1438235-F
  misc_feature (64)..(64): Xaa is any aa, unknown, or other
MVSEQSVAELKQTLLATTLELEAAREELRRKEQSIAKLSDLVREVAKERDDARDLAQSLRLLAXPAAPALVTSSVTDSDCSLASSPVDRSSTPSRRQQGGGLKLSPGKPPGRP

SEQ ID NO: 41800 - DNA, 624 bp, Zea mays
  misc_feature: Ceres CLONE 1438237-F
  misc_feature: Pfam Name: Sterol_MT_C Pfam Description: Sterol methyltransferase C-terminal
  misc_feature: SWISSPROT Homolog: EC 2.1.1.41 Sterol 24-C-methyltransferase
  misc_feature (1)..(1): n is a, c, t, g, unknown, or other
  misc_feature (29)..(29): n is a, c, t, g, unknown, or other
ngggatttcggagaggggcgggggggcangaattacaccacaccgttagggagaacatcctaatcgaaaattttgatgctgtttatgccattgaggcaacatgtcatgcacctgatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcgcgcgtggcttggtacttgcccttggatccaagccgattctccctgagtagcttccgtttgacttctgtgggacgcatgattacccgcacaatggtcaaggccctggagtacgttggtcttgctccgcagggcagtgagagggtctctaatttcctggagaaggctgcaaaagggctggtagagggcggaaagaaggagatcttcccccccatggacttctttcttgttccggagccctcttcgggatgagctcttggagtcccttttca

SEQ ID NO: 41801 - DNA, 696 bp, Zea mays
  misc_feature: Ceres CLONE 1438244-F
  misc_feature: Encodes the peptide sequence at SEQ ID NO. 41802
gctctagaactagtggatcccccgggctgcaggaattcgcacgacaccattacctataacatcctaatcgaaaaattttgtacatactccacacaaccaccgccagtcttctactctacttcatcttcactgcacaccaacccatccatcccccagtactcctcattgctcacccgtttcccatccccacaccaccaccaccaccatcttccggtcttcccctccccacacccggtgggatccccaccatccccgccccccgatggagctgttcccgcacgccaaggtagtgcggctcaagagccaccattacaagttcctgttcccggacgatgactatgtgtatgtgacttacgagggggatgggttgtttgttaaataagggtgggccccccaaccggcgccccaaaacccgggggttatccacctgcgaagccggtacggtgaactacctcaccgcctccggggaaccctttcctgcttggggatgacagagccgaaaagagtaacgcaaaagtgggcctccccgcaaccccgccccggcaacacaagtccttagaaactgggaacccccctcccgaaaccgccttcgagggggcccccctacctttcaaagaggtgggcccaatttttcttctaaaacaaaagaggggggtttctccgccccttgtaaagaaacatgccggcattctcaag

SEQ ID NO: 41802 - protein, 39 aa, Zea mays
  misc_feature: Ceres CLONE 1438244-F
MELFPHAKVVRLKSHHYKFLFPDDDYVYVTYEGDGLFVK

SEQ ID NO: 41803 - DNA, 765 bp, Zea mays
  misc_feature: Ceres CLONE 1438251-F
  misc_feature: Encodes the peptide sequence at SEQ ID NO. 41804
  misc_feature (1)..(1): n is a, c, t, g, unknown, or other
  misc_feature (12)..(12): n is a, c, t, g, unknown, or other
  misc_feature (19)..(19): n is a, c, t, g, unknown, or other
  misc_feature (21)..(21): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (504)..(504): n is a, c, t, g, unknown, or other
  misc_feature (506)..(506): n is a, c, t, g, unknown, or other
ntttaaaccccnccccttncnctgcccggggatttttnnntttggggggtggggcagagtggaactccccgcggtggcggccgctctattctagtggatcccccgggctgcaggaattttcacgagaccatacctagaacatcctaatcgaaaaatgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcgggcagcgacttggacccgcctctgcttggaggctgcgccaagattgtccgaggcttacgacaacgggtccggaagacccgagagaaataggggacaagtacaaggacccgncngaggaagcgaaggacccccccggggacccccaaggagcaccccaaagagaatggccgggggagaccaaggagcagggcgcaaggaaaagggccggcctccgtggccgaaaccaggcgttccggggcatgggccagaaacggggcacaagggaccatcccaaaagggccgtggacagaaggaaaccccgccggaaaacagagaattccccgcgggggaaccggaagcggaggcggaaaccaacgcaaaaacatcccgtgg

SEQ ID NO: 41804 - protein, 168 aa, Zea mays
  misc_feature: Ceres CLONE 1438251-F
  misc_feature (82)..(82): Xaa is any aa, unknown, or other
  misc_feature (83)..(83): Xaa is any aa, unknown, or other
MSRLMAAMLLGGARVAGAAKLTGNGNAAGMQALPMPACFLPPRPRAATWTRLCLEAAPRLSEAYDNGSGRPERNRGQVQGPXXGSEGPPRGPPRSTPKRMAGGDQGAGRKEKGRPPWPKPGVPGHGPETGHKGPSQKGRGQKETPPENREFPAGEPEAEAETNAKTSR

SEQ ID NO: 41805 - DNA, 657 bp, Zea mays
  misc_feature: Ceres CLONE 1438255-F
  misc_feature: Encodes the peptide sequence at SEQ ID NO. 41806
  misc_feature (657)..(657): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgn

SEQ ID NO: 41806 - protein, 108 aa, Zea mays; identical to SEQ ID NO: 16131
  misc_feature: Ceres CLONE 1438255-F

SEQ ID NO: 41807 - DNA, 702 bp, Zea mays
  misc_feature: Ceres CLONE 1438259-F
  misc_feature: Encodes the peptide sequence at SEQ ID NO. 41808
  misc_feature (374)..(374): n is a, c, t, g, unknown, or other
  misc_feature (413)..(413): n is a, c, t, g, unknown, or other
aaagctggagctccccgcggtggcggccgctctagaactagtggatcccccgggctgcaggaattcgcacgagaccattacctagaacatcctaatcaaaaatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccggcgcgaggggcggcgacntcccgacggaggcgggacgagaagttcatgatgcacaanttcaagggtgcggcggtccccccccccccccgaacccccaactggacgggttggcccttacccgaacccggggggagggcggcccgggggcggggaccccgggccccggtggcctaaccggggggaccctgtgcccggaaattccggccccccccccgggcgggggggccccccggggccccccccgggggccccctttcccccctctccccaagggaactttttaaaggttggggttcccccccgttcccggttatcaaaaaaggccccctgtgggggggggggtggc

SEQ ID NO: 41808 - protein, 59 aa, Zea mays
  misc_feature: Ceres CLONE 1438259-F
  misc_feature (50)..(50): Xaa is any aa, unknown, or other
MVSRENLHLVLDPASLGAPWADPSAAEIPPQLLAALGEYLSSTRREGRRXPDGGGTRSS

SEQ ID NO: 41809 - DNA, 677 bp, Zea mays
  misc_feature: Ceres CLONE 1438262-F
  misc_feature: Encodes the peptide sequence at SEQ ID NO. 41810
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcgcgctcaccgcggtgggccgcaccctggtgccggggcccgcctcgggcgcgtcctacgccgactacgtgctgcagcaccaccaggacgcgctgggtggcggcgtggccccgcctgcacgaggccgtgcttgacgaggnnnnnnnnnnnnnnnnnnnnnnnnnnnnnnnnnnn

SEQ ID NO: 41810 - protein, 150 aa, Zea mays
  misc_feature: Ceres CLONE 1438262-F
  misc_feature: SWISSPROT Homolog: EC 2.1.1.146 (Iso)eugenol O-methyltransferase
MPPPSANGATAAAAAARDDMSPAEARLAMMELANMVSVPMALAAVIRLGVPAAVWAGGANAPMSAADLLPPGHPDPSVLERLLRLLASRGVFSESTESTPTTRRRLFALTAVGRTLVPGPASGASYADYVLQHHQDALGGGVAPPARGRA

SEQ ID NO: 41811 - DNA, 659 bp, Zea mays
  misc_feature: Ceres CLONE 1438270-F
  misc_feature: Translation starting site: 186
  misc_feature (448)..(448): n is a, c, t, g, unknown, or other
  misc_feature (577)..(577): n is a, c, t, g, unknown, or other
ggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgcacctgcttaccacttggatcctggctccggagcnggcagcagaagctggattgtgaacttagaggggaggtgcgtggtgcaacagcgccaagacatgccggctcaccaggagctcccggccgtggctcgtcggaccacatggacaaagagatccccctcaccngcatcatgagcagcagccgtaccgtgaatcctgggtctcgcccgattctaatttctacatctggaaccgggtcaaggttcgt

SEQ ID NO: 41812 - DNA, 673 bp, Zea mays
  misc_feature: Ceres CLONE 1438275-F
  misc_feature: Encodes the peptide sequence at SEQ ID NO. 41813
tggagctccccgcggtggcggccgctctagaactagtggatcccccgggctgcaggaattcgcacgagaccattacctagaacatcctaatcgaaaatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccttatctgaacacgtatgacggccgcaccatccgctaccctgaccccctcatcaaggccaacgacaccatcaagatcgatctggagaccaacaagattgtggacttcatcaagtttgatgttggcaacgtcgtcatggtgactggcggaaggacactggccgcgtgggtgttatcaagaacagggagaagcacaaaggcagcttttgaaacattcacgtggaggactcccctggccacagttccgccaccgtatgggcaacgtgtccaccatcggaagggtaataagcgtgggttaccctgcccaa

SEQ ID NO: 41813 - protein, 173 aa, Zea mays
  misc_feature: Ceres CLONE 1438275-F
  misc_feature (29)..(105): Pfam Name: Ribosomal_S4e Pfam Description: Ribosomal family S4e
MQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRTLAAWVLSRTGRSTKAAFETFTWRTPLATVPPPYGQRVHHRKGNKRGLPCP

SEQ ID NO: 41814 - DNA, 690 bp, Zea mays
  misc_feature: Ceres CLONE 1438279-F
  misc_feature: Translation starting site: 123
  misc_feature: SWISSPROT Homolog: EC 1.2.1.12 Glyceraldehyde-3-phosphate dehydrogenase (phosphorylating)
  misc_feature: SWISSPROT Homolog: EC 1.2.1.59 Glyceraldehyde-3-phosphate dehydrogenase (NAD(P)(+)) (phosphorylating)
ctgccggaattcgcacgagaccattacctagaacatcctaatcgaaaaatatatcgtcctctatctcttcagcatctcctttgttcaatgtggtgagggtggtcctcacctctgcgccagccatggtcaagatcgcgatcagaatcaacggtttcgaaaggatctggacgatcggtgccggggtccccctgcacactgaggatgtcgagctgcatcccgacaacgactccttcatcaccaaggatgacctcatctacgacttcaagtacaacaccgagcgcctccaatgtaagcacaccgacatcaccctcaacgagtccaagacgcttctcttctgtgagaagacggttactgtctttgccatcagggaatccttaggagatcgcttgaggagacgctggtgctgattatgtcgctaagtccaccggtgtcttcactgacaaggacatggctgactgacgtctgaatggtggtgccatcaaggttgttatctctgccacaaccaaagatgcacacatgtttgttgttggcgtccatgatcgacaagtccccttgcgatggtaacattggtttcgaatgttagtctgagcccccaaaatgccttgctccccctggggaaggtcagttcaggacaccttagggactttatcggaggacttgacgcaccacttggtctttgccaatcactgg

SEQ ID NO: 41815 - DNA, 703 bp, Zea mays
  misc_feature: Ceres CLONE 1438282-F
  misc_feature: Encodes the peptide sequence at SEQ ID NO. 41816
  misc_feature (479)..(479): n is a, c, t, g, unknown, or other
  misc_feature (525)..(525): n is a, c, t, g, unknown, or other
  misc_feature (532)..(532): n is a, c, t, g, unknown, or other
agctccccgcggtggcggccgctctagaactagtggatcccccgggctgcaggaattcgcacgagaccattacctagaacatcctaatcgaaaacacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttgggtgtccctgggtcattctggnacactctgaaaagagagctctgctgggagaatcaaatgaatttgtnggagacnaggttgcgtatgccctgtctcagggactaaaagtcattgcatgtgttggtgagacacttgaccagagggaggctgggtctacccatggaggttgttgctgccaaacaaaagcaattgctgaaaaaatcaggactgggcccacctaattttttgccaatgaccaatttgggc

SEQ ID NO: 41816 - protein, 160 aa, Zea mays
  misc_feature: Ceres CLONE 1438282-F
  misc_feature (5)..(157): Pfam Name: TIM Pfam Description: Triosephosphate isomerase
  misc_feature: SWISSPROT Homolog: EC 5.3.1.1 Triose-phosphate isomerase
  misc_feature (95)..(95): Xaa is any aa, unknown, or other
  misc_feature (113)..(113): Xaa is any aa, unknown, or other
MGRKFFVGGNWKCNGTTDQVEKIVKTLNEGQVPPSDVVEVVVSPPYVFLPVVKSQLRQEFHVAAQNCWVKKGGAFTGEVSAEMLVNLGCPWVILXHSEKRALLGESNEFVGDXVAYALSQGLKVIACVGETLDQREAGSTHGGCCCQTKAIAEKIRTGPT

SEQ ID NO: 41817 - DNA, 704 bp, Zea mays
  misc_feature: Ceres CLONE 1438283-F
  misc_feature: Encodes the peptide sequence at SEQ ID NO. 41818
  misc_feature (560)..(560): n is a, c, t, g, unknown, or other
agagctggagctccccgcggtggcggccgctctagaactagtggatcccccgggctgcaggaattcgcacgagaccattacctagaacatcctaatcgaaaaatatctttttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctgttatggaaagacaagaaaacttctgctgttgtaataggcggcgcaactgtcatctggggttctgtcgaaatgctttgatacacctcttgaccntgatattccatgcactgattggggtggctgccaccttattcctgggggccaaagcaaccaccttcatcaagaaaatcccccggaattccactaggggcagtatctgaggaccttgtttggattgtttccgggcattacggaaga

SEQ ID NO: 41818 - protein, 99 aa, Zea mays
  misc_feature: Ceres CLONE 1438283-F
MADPAEENVVSPPPTPAAPAVGASDPPLQPAADSASTEKVSAPAPEVRSRGFRLLGEDTSVHKSLGGGKTADVLLWKDKKTSAVVIGGATVIWGSVEML

SEQ ID NO: 41819 - DNA, 689 bp, Zea mays
  misc_feature: Ceres CLONE 1438284-F
  misc_feature: Encodes the peptide sequence at SEQ ID NO. 41820
  misc_feature (380)..(380): n is a, c, t, g, unknown, or other
  misc_feature (417)..(417): n is a, c, t, g, unknown, or other
ggcggccgctctagaactagtggatcccccgggctgcaggaattcgcacgagaccattacctagaacatcctaatcgaaaaaaccatttcttcttcctttttctatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccggcgtgtggaagacggtcaagcccttcgttaaacgcggggcctctgggatgctcgcgacctgcgtcatccancctatcgacatgggtcagggtgaaggatcagttgggntaaggcctctgcctggtcaagtcacaaggaaacttgcttgcaaaatgaaggggtgtccgttcttttcaaacaagggttttgtcccccccgatttgctaagaaaagcgaacttacccacgggccccccttggaacctttaaggggtctaaacaaaacaacccttttaaaaaaaagagggggacccccttgcccctctttttaaaaaaagttttttttggccccacccccggggggaattgtgggcttttgtgtgtggacccccccgccaaact

SEQ ID NO: 41820 - protein, 105 aa, Zea mays
  misc_feature: Ceres CLONE 1438284-F
  misc_feature (47)..(47): Xaa is any aa, unknown, or other
  misc_feature (60)..(60): Xaa is any aa, unknown, or other
MADAKQQQQQQQQQPQQAAAAATGVWKTVKPFVKRGASGMLATCVIXPIDMGQGEGSVGXRPLPGQVTRKLACKMKGCPFFSNKGFVPPDLLRKANLPTGPPWNL

SEQ ID NO: 41821 - DNA, 808 bp, Zea mays
  misc_feature: Ceres CLONE 1438286-R
  misc_feature (764)..(764): n is a, c, t, g, unknown, or other
  misc_feature (808)..(808): n is a, c, t, g, unknown, or other
ttttacgaattgggtaccgggccccccctcgaggtcgacggtatcgataagcttttttttttttttttttatatatatagtagtaaactactataatgtataaactaataacacatccaaaatcaaaatccatgtattttgcagatacagcaaaataacgttgcaatgacaaccagttcttgggcacaacaagagcataatgactagcacatccactctctgcaacatcttcttgcagttaataattgagttgagttgattattaaccgtctaatcttctcacatgacgctgcatgcgttggcgttctcctcgctgaacatgtagtacgatccgggcgccgccgggcgccgggcgccggcgcccgtcgaagtaaaaaagtaccccggcgggccggtttccttgggggggggtaacggggggcacccggggccaattcgggggggggggaaaattaaacccgccttttttttcccgggaaaaaaccaaaaaaaaactctcgggggggggggcgcccccccggcgccctttaaaaagccccccctctaagaaaaaaaataacccccccccccggggggggggggtgggggagtaaacccccccccggggggggggggggggaaaaaaaaaaaaccccccccgccggggggggggggggggggtttttatattttttcttccccccccccccccccacattattaaattatatatgtattttatgagggggggggggaggattataaaaaaatataattataaaatntctctctcttcccccccgccgggaaggaaaaaataaaaaataan

SEQ ID NO: 41822 - DNA, 681 bp, Zea mays
  misc_feature: Ceres CLONE 1438295-F
  misc_feature: Encodes the peptide sequence at SEQ ID NO. 41823
  misc_feature (422)..(422): n is a, c, t, g, unknown, or other
  misc_feature (423)..(423): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaagacgacgcggtggtgcagccgcaaaactttccgtccttcgnnacgctcggcggcggcgcgtcccccggcgttcggcggccctcccggcggcagcattcctgcagcagcatccccgggttcaacatgcccgggagcggcagcagcctacccggggtttagtttgcccgggaacgggagcattgcccctttttgggggggggtcccccggctttaaggggtttcgggggaatggcccgggtcccccacccccgggcccttccccaaaaccgcccaaaagcccttgaacccaaaaggggggga

SEQ ID NO: 41823 - protein, 88 aa, Zea mays
  misc_feature: Ceres CLONE 1438295-F
  misc_feature (50)..(50): Xaa is any aa, unknown, or other
MARSSKMMVAAALLALALAVSTAEARNIKTTTTEKKDDAVVQPQNFPSFXTLGGGASPGVRRPSRRQHSCSSIPGFNMPGSGSSLPGV

SEQ ID NO: 41824 - DNA, 774 bp, Zea mays
  misc_feature: Ceres CLONE 1438304-F
  misc_feature: Encodes the peptide sequence at SEQ ID NO. 41825
gtgtgtggggcccccccttctgcggttccgactcgggtggttggggctttttttaaaaataaatttaccgcggtggcggccgctctatactagtggatcccccgggctgcaggaattcgcacgagaccattacctagaacatcctaatcgaaaaagattcaattcagaattggcgagacatctggcatgtcaggtccgaagatcagcaaacctttagggtgcgacagtgcacaggtgagtctggtcgggggctgagggcccgggctgagcccgttcctggtccgcccccagatggccctcgccgtagatggtctgacctacgactacctcccggaggaccgggggtgcaagagcgacctcctcatcgcgtccaaccccgtgtacaagaaggtgcctgtcctcatccaccacggcaggcccgtctgcaagtcgctgctcaccctggagtaggggggattaggcatgtggggttccccccgatggggaggtccaatcctccccccaaacccctaaaagccgcccccgtcacctcctttttggccctcctatgtgaaccgggagggtgttggctgtcgtctttttgtttccgtcaccaacgcccacccagaaaaaaagggcccctttcggttggggggaaacgtggccggggcccccaacttttaaaaattgttccttgcggaagtttcccaaggggagaggaaaaggggaagagggccttctctcgcggggtgccccgggtccgggtgtgcgcgaggcccccgtgggggggaggat

SEQ ID NO: 41825 - protein, 52 aa, Zea mays
  misc_feature: Ceres CLONE 1438304-F
  misc_feature: SWISSPROT Homolog: EC 4.4.1.5 Lactoylglutathione lyase
MALAVDGLTYDYLPEDRGCKSDLLIASNPVYKKVPVLIHHGRPVCKSLLTLE

SEQ ID NO: 41826 - DNA, 737 bp, Zea mays
  misc_feature: Ceres CLONE 1438305-F
  misc_feature: Encodes the peptide sequence at SEQ ID NO. 41827
  misc_feature (415)..(415): n is a, c, t, g, unknown, or other
  misc_feature (481)..(481): n is a, c, t, g, unknown, or other
aagctggagctccccgcggtggcggccgctctagaactagtggatcccccgggctgcaggaattcgcacgagaccattacctagaacatcctaatccaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccnaccagttctttcacgtcgccttcgaggctggcagcaggctaaagggctccacgctccttaccaaanggagtgtgacggatggatccaatgaatgggcaatctacgggcggaacggaaaagtttgttttgccaaaggtgtccttcaaaaaaggtactttgcaaaaggggagggcccgggaaactttgcaagcccacagggggggtttctccccggggtttggtcttcccggcccccaaaaagggggagccccccctctttttcccccaaaatgttttttgggggggaaaaagaggtcccccaaaaattcccacccccgccccc

SEQ ID NO: 41827 - protein, 196 aa, Zea mays
  misc_feature: Ceres CLONE 1438305-F
  misc_feature (90)..(90): Xaa is any aa, unknown, or other
  misc_feature (112)..(112): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTTFGNSXQFFHVAFEAGSRLKGSTLLTKXSVTDGSNEWAIYGRNGKVCFAKGVLQKRYFAKGEGPGNFASPQGGFLPGVWSSRPPKRGSPPSFSPKMFFGGEKEVPQKFPPPP

SEQ ID NO: 41828 - DNA, 639 bp, Zea mays
  misc_feature: Ceres CLONE 1438322-F
  misc_feature: Encodes the peptide sequence at SEQ ID NO. 41829
  misc_feature (291)..(291): n is a, c, t, g, unknown, or other
gggggccgctctataactagtggatcccccgggctgcaggaattcgcacgagaccattacctagaacatcctaatcgaaaacccaatcgcgccgccgctcgagcccctctcgcccttcgcgccgccgccgctgcaggcaaccgtcgccgccgtcgccgccgtcgccggagctaaacccctcgcctgacgccatggggcgcattcacagccgcggaaagggtatctcgtcgtcggcgctgccgtacaagaagactcccccgagctgggtcaagaccgccgtccctgatgtcnaccaatttatcaccaaagctgccaaaaaggtcaaatgccctcccccatacgtggtcttggtcccggccagcacgggatccccctttgggaaagcgtttccggaaaacagatcttccccatcctccaaggtcatgggccggggccccaaatccccaaagaactttactttttttttaaaaaagcggtggggccttatgaaagacctctttgaggaacagggagggagaaaggccccccaattggggcgctttttttttggaaaaagggagcaccccccttgtccgcttattaacaagggcccaaaaaaatctccccccccccggagaaaacaatttcccccgcgcgccc

SEQ ID NO: 41829 - protein, 149 aa, Zea mays
  misc_feature: Ceres CLONE 1438322-F
  misc_feature (1)..(52): Pfam Name: Ribosomal_S13_N Pfam Description: Ribosomal S13/S15 N-terminal domain
  misc_feature (34)..(34): Xaa is any aa, unknown, or other
MGRIHSRGKGISSSALPYKKTPPSWVKTAVPDVXQFITKAAKKVKCPPPYVVLVPASTGSPFGKAFPENRSSPSSKVMGRGPKSPKNFTFFLKKRWGLMKDLFEEQGGRKAPQLGRFFFGKREHPPCPLINKGPKKSPPPRRKQFPPRA

SEQ ID NO: 41830 - DNA, 678 bp, Zea mays
  misc_feature: Ceres CLONE 1438334-F
  misc_feature (552)..(552): n is a, c, t, g, unknown, or other
  misc_feature (629)..(629): n is a, c, t, g, unknown, or other
cccgccggtggcggccgctctagaactagtggatcccccgggctgcaggaattcgcacgagaccattacctagaacatcctaatcgaaaagaacgcattcctcccatctcccaagacctcctcagacccgagaagcgcagctgcggccatggacgccaccggcactggagctggagggaaggcgaaaaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctaccctcgcggccgtcctggagtacctccccgctgaagtccctggagctcgccggcaacgctgccaaggacaacaagaaaacgcgcatcgtcccgcgccacgtgctgctggcgatccgcaacgacgaagagctcgggaagctgctgaccggcgtgaccatcgcccacggcggcgtgttgcccaacatcaacccggtcctgctgcccaagaagacngcggagaaggcgtccagcggcgggagcaaggaagccaagtcgcccaagaaggccgccaagtcccccagaaggcatanggtttggagccgatccaatttgtcatgtgtagttgtacccggcatgtga

SEQ ID NO: 41831 - DNA, 705 bp, Zea mays
  misc_feature: Ceres CLONE 1438351-F
  misc_feature: Encodes the peptide sequence at SEQ ID NO. 41832
tccccgcggtggcggccgctctagaactagtggatcccccgggctgcaggaattcgcacgagaccattacctagaacatcctaatcgaaaaactgccaaatcccccagaaagtcaactcctccccaattccacgctgccaccaactcgccgtcctccgcgccaagcaccaaagctccgatggcccgcacgaagcagacggcgcgcaagtcaacgggcggcaaggcgccccgcaagcagctggcgaccaaggcggcgcgcaagtctgcgccggccaccggcggcgtgaagaagccccaccgcttccgccccggcaccgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcaggaggccgccgaggcctacctcgtggggctctttgaggacactaacctgtgcgccatccacgccaagcgcgtcaccatcatgcccaaggacatccagctcgcgcgccgcatcaggggagagagggcctgagcgaggcgagctcctctcaccgcaggcggcgtcgttgttgcttcgggcctgcttgtaggacttgtgcttctcttggtttcctttctggtggcagtggcatcttcgtaccattgtgc

SEQ ID NO: 41832 - protein, 136 aa, Zea mays; identical to SEQ ID NO: 10882
  misc_feature: Ceres CLONE 1438351-F
  misc_feature (58)..(132): Pfam Name: Histone Pfam Description: Core histone H2A/H2B/H3/H4

SEQ ID NO: 41833 - DNA, 694 bp, Zea mays
  misc_feature: Ceres CLONE 1438355-F
  misc_feature (266)..(266): n is a, c, t, g, unknown, or other
  misc_feature (290)..(290): n is a, c, t, g, unknown, or other
  misc_feature (291)..(291): n is a, c, t, g, unknown, or other
  misc_feature (313)..(313): n is a, c, t, g, unknown, or other
  misc_feature (314)..(314): n is a, c, t, g, unknown, or other
  misc_feature (402)..(402): n is a, c, t, g, unknown, or other
  misc_feature (472)..(472): n is a, c, t, g, unknown, or other
  misc_feature (473)..(473): n is a, c, t, g, unknown, or other
  misc_feature (479)..(479): n is a, c, t, g, unknown, or other
  misc_feature (566)..(566): n is a, c, t, g, unknown, or other
  misc_feature (585)..(585): n is a, c, t, g, unknown, or other
  misc_feature (586)..(586): n is a, c, t, g, unknown, or other
  misc_feature (590)..(590): n is a, c, t, g, unknown, or other
  misc_feature (592)..(592): n is a, c, t, g, unknown, or other
  misc_feature (626)..(626): n is a, c, t, g, unknown, or other
  misc_feature (661)..(661): n is a, c, t, g, unknown, or other
ggcggccgctctagaactagtggatcccccgggctgcaggaattcgcacgagaccattacctagaacatcctaatcgaaaactaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccgggcgtgtnggagaacgtcaagccctttcgtannaacggggcggggggcccccttnnttttggggggggggaagggggcgccccccctccccccccctcccccgggagggacaaacaacaccccccctggggggggccgcccccngtctaccccaattctttccccccccgcaaggcgcgcccccctccgatttatatttcccggcggagaaacnncaaatntatttgtttgtgtgtgtgcggcgcgcgctttcctcccacccaacaaaaaaaaagggggcgcgggctggtgtggtgcttttgaggaancaagaacggagggagcaannattntnttttcttctcccccccccctcgaccagtgtgttnttttctttgttgtcgggcgcgggcgcccgcgtggntttccccagacacaaaaaaatagaggaggcgcg

SEQ ID NO: 41834 - DNA, 710 bp, Zea mays
  misc_feature: Ceres CLONE 1438361-F
  misc_feature: Encodes the peptide sequence at SEQ ID NO. 41835
  misc_feature (474)..(474): n is a, c, t, g, unknown, or other
  misc_feature (480)..(480): n is a, c, t, g, unknown, or other
  misc_feature (481)..(481): n is a, c, t, g, unknown, or other
  misc_feature (489)..(489): n is a, c, t, g, unknown, or other
  misc_feature (490)..(490): n is a, c, t, g, unknown, or other
aaagctggagctccccgcggtggcggccgctctagaactagtggatcccccgggctgcaggaattcgcacgagaccattacctagaacatcctaatcgaaaaaggcaactactccgtctcacgcctctcctgtcccctctcgccgctctcgccccgcctctgcctccgcctccgcctcctccatcgcacccagctttcctccccaccccaccgccactcctaccccgccacgtcgtgtagtcgcggcggcggatatgcaagccgccgccgccttcaaccaggcagccttcaccgtccgctcgctgcatcgccccccgaggcccctccatctagctgttgcggaggatgcttttgcggggataagaggcgcgccccttacacggccccggtgctgcgggagcctctctgtcggcgtcggcagctacgacagcgagcacactccagtatttccaagacaacaatcatgggatcccntacagnnctctggtnngtgatcagatgcatctgaagaagaggtcccggaagtgcacgaattttctttctaaaacatacgcccggatatgaggaaagtgaagaggcccattgaagtgcttatgacaagataataatgatagctacccagaccgtaggaaatccaaattccatctgaaaagcagctaaaagagcaggttgaggatccccatcatggctaaagcactttttgaaaattt

SEQ ID NO: 41835 - protein, 78 aa, Zea mays
  misc_feature: Ceres CLONE 1438361-F
  misc_feature (74)..(74): Xaa is any aa, unknown, or other
  misc_feature (76)..(76): Xaa is any aa, unknown, or other
MQAAAAFNQAAFTVRSLHRPPRPLHLAVAEDAFAGIRGAPLTRPRCCGSLSVGVGSYDSEHTPVFPRQQSWDPXQXSG

SEQ ID NO: 41836 - DNA, 674 bp, Zea mays
  misc_feature: Ceres CLONE 1438385-F
  misc_feature: Encodes the peptide sequence at SEQ ID NO. 41837
  misc_feature (674)..(674): n is a, c, t, g, unknown, or other
aagctggagctccccgcggtggcggccgctctataactagtggatcccccgggctgcaggaattcgcacgagaccattacctagaacatcctaatcgaaaaaactacaccacccggatcatacgcccaattctattcccttggtcattaagtgggcggggggggctccccctactccggcggcggagcacagcgtgttcgtctactgcagcctgatggcggacgaggtgttccgcgccgtcctcaagcgcgttccggccgccgccccggccctcctccagagactaccaccggatcaacgtcaagggccacgttttccccgcgatcctgccccttaagagcaacagagttgctagggagggttatcatggtctgttactgatgaacagctcctgcttcttgacgcgtttgaacacatggactacacgaggacgatagttgagatatcattggctgactctacctacaacatgctggttgacacttacgtgttgattgatgcaaaggatctcattctttatctagaatgggactttcaggtgatatgacttgtttcctgccttcctggggtgttaatgctatgtgattatcatgctacgtgcatcctatactaatgataaaatctatcacctactgtcgtccacggcatctaaaattctgttgccaccacccacn

SEQ ID NO: 41837 - protein, 43 aa, Zea mays
  misc_feature: Ceres CLONE 1438385-F
MDYTRTIVEISLADSTYNMLVDTYVLIDAKDLILYLEWDFQVI

SEQ ID NO: 41838 - DNA, 553 bp, Zea mays
  misc_feature: Ceres CLONE 1438386-F
  misc_feature (52)..(52): n is a, c, t, g, unknown, or other
aaagctggagctccccgcggtggcggccgctctataactagtggatcccccngggctgcaggaattcgcacgagaccattacctagaacatcctaatcgaaaaccatcgcacgcactcctcatcttatcccccgcctcctccggtcctcccgccgctgttgctcacttctgagtcccgacgcacgagctcccaagagctagccatgggcgtccaccaacccttctccctccggctttaaccctcttattccggccctccacttcccgtggcccgccgcctggtccgaggtctccaggccgggcccaaatcgcggggcccccggccttccccttcggggaccccccccaatcccccaaaacctgaactcgggaaccctccccggctccccctaaaagggcccaaccttttaaaaccctcaggaaggggtttgggtaacccccggggtttttgccggggcgccttttggggccccgggggggggggggggcccccccacaaaaaaaagacccccccccaaaaagaaaagttttctttttttttaaaaaaggggcc

SEQ ID NO: 41839 - DNA, 727 bp, Zea mays
  misc_feature: Ceres CLONE 1438387-F
  misc_feature: Encodes the peptide sequence at SEQ ID NO. 41840
aagctggagctccccgcggtggcggccgctctagtctagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgaccagcagtatgacaagaaaatgcaggagatattaactgaagacttcttcacttcatatgatgatgtttgtgaaagttttgactgcctgggactgcaagagaaccttctgacaggcatctatgcctatggttttgagaagccatcggctattcagcaaaggggaatagttcccttctgcaaggggcttgacgtgattcagcaagctcagtctggaactggagaaacagctaccttctgttctggactcttgcaccaacttgattatggattggttgaatgcccagcattggttcttgctccaccccggagcttgctctgcaaattgagaaggttatgcgcgctcttggggactatttggggggtcaaagtgcacgcctgtggttgaggaaacatctggtccgggaggaccaaaagaattcttgccagggggggggcatgtttgttggggggcaccccggg

SEQ ID NO: 41840 - protein, 140 aa, Zea mays
  misc_feature: Ceres CLONE 1438387-F
MAGLAPEGSQFDDQQYDKKMQEILTEDFFTSYDDVCESFDCLGLQENLLTGIYAYGFEKPSAIQQRGIVPFCKGLDVIQQAQSGTGETATFCSGLLHQLDYGLVECPALVLAPPRSLLCKLRRLCALLGTIWGVKVHACG

SEQ ID NO: 41841 - DNA, 730 bp, Zea mays
  misc_feature: Ceres CLONE 1438391-F
  misc_feature: Encodes the peptide sequence at SEQ ID NO. 41842
  misc_feature (445)..(445): n is a, c, t, g, unknown, or other
ctggagctccccgcggtggcggccgctctagaactagtggatcccccgggctgcaggaattcgcacgagaccattacctagaacatcctaatcgaaaattggccacctctgagcctcaagccctcaacctccctcttcggcgcgtaacgtcagtcctcaggtattggcagcataaagtgttagatttgtccttgattgaggtaccccttcaaaggtcaagatgttgtggcgcgcagtacgcagtatggatgtaataatgcattcttcgagtttccttcttccgaaactgtatcaacctgtcaacaaaccagtcaagaactatgctttagttgttctaaaccagcatcttccacgattcatgcctcgactctgggatcatgcaaacttgaggatctgcgctgatggaggagctaatcatatttttgatgagatgtatcagataccnaatgatgaagacaaaaaagcccccgaaatagtatgttccagaaataatgaaggggaaatggattcaatagaactgaagtaaactgttccacctagtcagggatccaaatttctgaaaagtcccataaccggaagaaaccgaactctccccatggtttttcccgaacccatccttggacccccggatagaaaaaaaccaattcctttggactttgtaacggggacctaggggggaaagtttaatccaaaggggaaaaaaacaaggtcccgaactttttttcgaaaa

SEQ ID NO: 41842 - protein, 101 aa, Zea mays
  misc_feature: Ceres CLONE 1438391-F
  misc_feature: SWISSPROT Homolog: EC 2.7.6.2 Thiamine diphosphokinase
MLWRAVRSMDVIMHSSSFLLPKLYQPVNKPVKNYALVVLNQHLPRFMPRLWDHANLRICADGGANHIFDEMYQIPNDEDKKAPEIVCSRNNEGEMDSIELK

SEQ ID NO: 41843 - DNA, 718 bp, Zea mays
  misc_feature: Ceres CLONE 1438393-F
  misc_feature: Encodes the peptide sequence at SEQ ID NO. 41844
aagctggagctccccgcggtggcggccgctctattctagtggatcccccgggctgcaggaattcgcacgagaccattacctagaacatcctaatcgaaaaagaaactgagatcccaagagaagatgtctccgacccccctcggatcaagaaagaaagaagaataagatgccttcgagcacattctctggaactgtgagctcaccgaagctgtcagtggcactggacatgggccacccttttctcaacctcaccgttgatggtttcctcaagatcggagctgttggagtcacaaaatctcttgtggaagacacttaccaagccatcgacgaagggagagtttccgagagcactcttgagcatgcgcttaagaagatgtgcaaagaacgttcttacagacgatctgtgcctggactttatgttcggaccgagtctgagatcggacgtatccgtgacactacacattgataaaccaatgctggcaggggaggcgacaggagcagcgatctctgcggctactaacaagggaaaagaaaacgccgggatccaagccgtgatggtgggggctcttgcacctgcctcttagttcctaaaccatcttatttctaaggggtggccaacccccctttgaagaaccacattggtcttgcaaaatccaaattccgccctaaagggggggggccccctggattgcttcccgagaaaaaaaaaaatttttct

SEQ ID NO: 41844 - protein, 99 aa, Zea mays
  misc_feature: Ceres CLONE 1438393-F
MPSSTFSGTVSSPKLSVALDMGHPFLNLTVDGFLKIGAVGVTKSLVEDTYQAIDEGRVSESTLEHALKKMCKERSYRRSVPGLYVRTESEIGRIRDTTH

SEQ ID NO: 41845 - DNA, 790 bp, Zea mays
  misc_feature: Ceres CLONE 1438394-F
  misc_feature: Encodes the peptide sequence at SEQ ID NO. 41846
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
gggggggggggggggggnnnttttgttatggnnnnnnnnnnnccaagctggagctccccgcggtggcggccgctctattactagtggatcccccgggctgacaggaattcgcacgagaccattacctagaacatcctaatcgaaaaaaatccatatttgtcccaacgaaggcacacagccgccggcatttcttcatcctcccatctcgtgatctccatctccatcgtcgtcgcagcgccggcgatccatcttccgctgcctcccttcctcgcgctcgggctctcagtgacggcatcagcggtttcccctcccgcctctcgccagtcgcatcacgcccccgcctccggtccatcgcacaccggccggtgaccctacattacttgctaatctttcttgacggcagatggccgtttctttagcaaatgtccaggccgacgcagggctgaaacagcttgatgaccaccctctcactcgcagctacatcactggctaccaagcttccaaggatgacctgcctgtccacgcatcatttctggctgatccctcatccaagtataccattgtagccagggggtttactcactttcacgcccccccggacggtgaatgggagttaccgccaaaaggccctacgtgttaagggttgagccctccgacgggttcctttctccttccaatctcttgaatggtggctcaagggcccagggccctccagctccgcgggacccaagaactccccgcaattgaagcggggtagagaacctttttcttggagaaaaacaaataaccc

SEQ ID NO: 41846 - protein, 78 aa, Zea mays
  misc_feature: Ceres CLONE 1438394-F
  misc_feature: SWISSPROT Homolog: EC 6.1.1.16 Cysteine--tRNA ligase
MAVSLANVQADAGLKQLDDHPLTRSYITGYQASKDDLPVHASFLADPSSKYTIVARGFTHFHAPPDGEWELPPKGPTC

SEQ ID NO: 41847 - DNA, 627 bp, Zea mays
  misc_feature: Ceres CLONE 1438398-F
  misc_feature: Encodes the peptide sequence at SEQ ID NO. 41848
  misc_feature (52)..(52): n is a, c, t, g, unknown, or other
  misc_feature (441)..(441): n is a, c, t, g, unknown, or other
aaagctggagctccccgcggtggcggccgctctataactagtggatcccccngggctgcaggaattcgcacgagaccattacctagaacatcctaatcgaaaagcattttcatggcagccttgtaaccatccatccatcatctatttgccgatttgctttagctgcagagagcaaggatcccgcaaaagttcctcggcctagtaaccgccttccactctcagaattcgtcggcgtggtcctcggcagctcacttcctcctgctggtggtgatggtgaggcgctcgaagctgcggaacgtcgtgttgtcccgcgaggcggagcctcccctcccggccgcgttccgggccacgggggagcgcggggacgacctgctgttctcggcgcctcccgagtggtggagcctctgcgcgggggacgggcgcccgctgccgccactgctngcgggaaacccaccgggcggttctggggcactgcagtcccccgaaaaggtcggcccggggggacggacctgccggcatttttcgacgaactcccttccccgggaaaaaaagggcgcgtttttccctgaaaaagccggcaaaccttgtgcgcggcccaaaataaccggaaaaaaatgggtccccttg

SEQ ID NO: 41848 - protein, 119 aa, Zea mays
  misc_feature: Ceres CLONE 1438398-F
MVRRSKLRNVVLSREAEPPLPAAFRATGERGDDLLFSAPPEWWSLCAGDGRPLPPLLAGNPPGGSGALQSPEKVGPGGRTCRHFSTNSLPREKKGAFFPEKAGKPCARPKITGKKWVPL

SEQ ID NO: 41849 - DNA, 667 bp, Zea mays
  misc_feature: Ceres CLONE 1438406-F
  misc_feature: Encodes the peptide sequence at SEQ ID NO. 41850
tggcggccgctctagaactagtggatcccccgggctgcaggaattcgcacgagaccattacctagaacatcctaatcgaaaatagcagaattctctcaacctcatcggcggcggctaagagcgtgcggatcggagatggccacaagcgggtggaggaggagagcggcggcgcgggcctcctggcgccccgccacggtgtacctgtggctcgcgctcgccgcagcagcactgacgctcgcccaggctaagaaggacctaacggaggttacccacaaggtctacttctatgtcgagattgacggcaagcccgcaggtcggattgtcatggggctttttgggaagactgttcctatgacagtagagaacttccgagctctttgcacaggagagaaaggaattggcaagagtggcaaagctctccactacaagggaagtacattccacagaatcattcccagcttcatgctccaaggaggtgacttcactcttggggatgggaggggtggtgaatctatctatggcatgaagtttgctgatgagaacttcaagatcaagcacactggaccaggccttctgtccatggccaaggctggtagaaatacaaacggatctcagtttttcaccaccacggtgacaacaactgggttggaccggaagcttggtgttt

SEQ ID NO: 41850 - protein, 177 aa, Zea mays
  misc_feature: Ceres CLONE 1438406-F
  misc_feature (47)..(177): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MATSGWRRRAAARASWRPATVYLWLALAAAALTLAQAKKDLTEVTHKVYFYVEIDGKPAGRIVMGLFGKTVPMTVENFRALCTGEKGIGKSGKALHYKGSTFHRIIPSFMLQGGDFTLGDGRGGESIYGMKFADENFKIKHTGPGLLSMAKAGRNTNGSQFFTTTVTTTGLDRKLGV

SEQ ID NO: 41851 - DNA, 720 bp, Zea mays
  misc_feature: Ceres CLONE 1438407-F
  misc_feature: Encodes the peptide sequence at SEQ ID NO. 41852
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaaatatccactattctctaggaagcaagggagtcacatcaccatggtagccaagatgtttgcattgtttgcgctcctagatctttgtgcaaccgccactagtgctacccatatcccagggcacttgtcaccactactgatgccattggctaccatgaacccctggatgcagtactgcatgaagcaacagggcgttgacaacttgctagcgtggccgaccctgatgctgcagcaactgttggcctctccgcttcagccgatgccgatgacaatgatgatgccaggtatgatgccatcgatgacaatgatgcctatgcctaatatgatgccatctatgatggtgccgactatgatgtcgccaataactatagctactatgatgccaccgatgatgatgcctaacatggtttcacctatgatgatgcccagtatgatgacttcaacgatgaccccgactatcatgcctcccgatatgataccaggtatcgatacactgatgatgatgcccagcatggtgtcatccatgataatgcaaacatgatgacagtgccaccatgttactctgatncatctcgcacatatagcacacgacatttccctttatgttcaccccaaagccgtg

SEQ ID NO: 41852 - protein, 165 aa, Zea mays
  misc_feature: Ceres CLONE 1438407-F
MVAKMFALFALLDLCATATSATHIPGHLSPLLMPLATMNPWMQYCMKQQGVDNLLAWPTLMLQQLLASPLQPMPMTMMMPGMMPSMTMMPMPNMMPSMMVPTMMSPITIATMMPPMMMPNMVSPMMMPSMMTSTMTPTIMPPDMIPGIDTLMMMPSMVSSMIMQT

SEQ ID NO: 41853 - DNA, 743 bp, Zea mays
  misc_feature: Ceres CLONE 1438414-F
  misc_feature: Encodes the peptide sequence at SEQ ID NO. 41854
aaactggagctccccgcggtggcggccgctctataactagtggatcccccgggctgcaggaattcgcacgagaccattacctagaacatcctaatcgaaaaagactttacatactcatcatcttctgaccaccaaaacccctacccatctggtggccatggttcgcctctctgcaatggggcaccaacttccatgcaggagcgtgaagattatccaccgtctccgtctgcaggagcacggctcagctccaggtcgactcaggagcgactgcaaatcattcaggggtacaaacttgctagtgcctcgactcacttgtctcgttcgaggcatgacttcaaggacttcttcggcaaatgcaccgacgctgtcaagatcgccagatttgcgctagcaacctatgctctcgtcgtctcgggagtaagtgcacaaggagctcagaggagattgacttaccatcacatacataccaagacatacatggtagtgaatggcactgcaaccgctaagcagagtccaatcatggacgggaggctatgagactttctcccttcaacctggaaaatacttgcggtaagaagttctagctttcgagcctacctgcatcacccgtcaaggaatgagcagtgttagggacgaactccactcactgacatgccacaagaccgaagacttcatgacccgttctcacctaaagctacatgacctagagtcaaaagccccctttacaaggctttcttcttgag

SEQ ID NO: 41854 - protein, 114 aa, Zea mays
  misc_feature: Ceres CLONE 1438414-F
MQEREDYPPSPSAGARLSSRSTQERLQIIQGYKLASASTHLSRSRHDFKDFFGKCTDAVKIARFALATYALVVSGVSAQGAQRRLTYHHIHTKTYMVVNGTATAKQSPIMDGRL

SEQ ID NO: 41855 - DNA, 655 bp, Zea mays
  misc_feature: Ceres CLONE 1438419-F
  misc_feature: Encodes the peptide sequence at SEQ ID NO. 41856
  misc_feature (655)..(655): n is a, c, t, g, unknown, or other
ccccgcggtggcggccgctctaatctagtggatcccccgggctgcaggaattcgcacgagaccattacctagaacatcctaatcgaaaactctatcatcatccaatccaaatcatcacagcgacaatgcttaaataggatcgtcaaacataacagcatgaagatggtcatcgttctcatcgtgtgcctggctctgtcaactgccaacgcctctgcaatgcatatgccctgcccctgcacggggactgcatggcttgtacggcgctggcgcctgcctgactacgatgatgggcgccggttgtttgtacccctactcttaatacctgacgcatccgcaatgcagcccgatggtggcggcgccctactacaccgagtgtgggcagacgacctccatgtaccatccgctccggcaacagtgctgccaccaccatatgacgatgatggacgtgcagtccgtcgcgcaacaactgcagatgatgatgcagcttgagcgtgccgctgccaccagcagcatcctgtacgagccacctctgatgcagcatcagcagcagctgctgacatcccaaggtctcaaccccatggccatgatgatggctcacaacatgccggccatgggaggactctaccattaccagtaccaactgcccagctaccgn

SEQ ID NO: 41856 - protein, 103 aa, Zea mays
  misc_feature: Ceres CLONE 1438419-F
MVAAPYYTECGQTTSMYHPLRQQCCHHHMTMMDVQSVAQQLQMMMQLERAAATSSILYEPPLMQHQQQLLTSQGLNPMAMMMAHNMPAMGGLYHYQYQLPSYR

SEQ ID NO: 41857 - DNA, 612 bp, Zea mays
  misc_feature: Ceres CLONE 1438430-F
  misc_feature: Encodes the peptide sequence at SEQ ID NO. 41858
aagctggagctccccgcggtggcggccgctctagaactagtggatcccccgggctgcaggattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagagcaggagggaagtcaccggccgtcggcggggaagagatgtcggacggcgcgggctcccggacgggcgtcgctggcgcgctgggcctctcggtcacctcgtcggtgggcatcgtcatctgcaacaagtacctcatcagcactctaggcttcttctttccgacaaccctgacgagctgggccccccaggtggacctcctccccctttaactttggccaaggggttggctttttttcaacccaagccaattagagggggcgcccgttttttccttttggctgggtcaaagggattctcctttgggccccctccac

SEQ ID NO: 41858 - protein, 56 aa, Zea mays
  misc_feature: Ceres CLONE 1438430-F
MSDGAGSRTGVAGALGLSVTSSVGIVICNKYLISTLGFFFPTTLTSWAPQVDLLPL

SEQ ID NO: 41859 - DNA, 722 bp, Zea mays
  misc_feature: Ceres CLONE 1438437-F
  misc_feature: Encodes the peptide sequence at SEQ ID NO. 41860
aagctggagctccccgcggtggcggccgctctagaactagtggatcccccgggctgcaggaattcgcacgagaccattacctagaacatcctaatcgaaaaattccccctcgatcggcctccctcccccaagatcctccactcgatcccaaacaaaccaacaaatccatccatcgcacatggacgcgttcttctcggcctcctccgcgtcggcgccctacggctacggcgccggcggatggagctacgactcgctcaagaacttccgccagatcacccccgccgtccagacccacctcaagctcgtctacctcaccctgtgcgcggcgctggcctcgtcggcggtgggcgcttacctgcacgtggtctggaacatcggcggtacgctgacaatgctcggttgcgtcggcagcatcgcctggctcttctcggtgcccgtctacgaggagaggaagaagtatgggctgctgatggcggctgccctcctggaaggcgcttcggtcggacccctcgtcaagctcgccgtggaatttgacccaagcatcctggtgacggcgttcgtggggactgacatcgcgttcgcgagcttcacgggcgcggccatggtgtccaggcgcagggagtacctctacctgggtgggcagctctcgtcggggctcccatcctgctctggatggagtagcccgcttcaatcttcggcaattcgcaaccaggctcatgttt

SEQ ID NO: 41860 - protein, 181 aa, Zea mays
  misc_feature: Ceres CLONE 1438437-F
MDAFFSASSASAPYGYGAGGWSYDSLKNFRQITPAVQTHLKLVYLTLCAALASSAVGAYLHVVWNIGGTLTMLGCVGSIAWLFSVPVYEERKKYGLLMAAALLEGASVGPLVKLAVEFDPSILVTAFVGTDIAFASFTGAAMVSRRREYLYLGGQLSSGLPSCSGWSSPLQSSAIRNQAHV

SEQ ID NO: 41861 - DNA, 670 bp, Zea mays
  misc_feature: Ceres CLONE 1438439-F
  misc_feature: Encodes the peptide sequence at SEQ ID NO. 41862
cgcggtggcggccgctctagaactagtggatcccccgggctgcaggaattcgcacgagaccattacctagaacatcctaatcgaaaaaaaagatcgcgaagcgagagggaatgatggaggcatatgcattagtacctcctcgcctccagcctccgtcctgcttcgatctcgtccaatcccccgtcggcccggcgcccctctccggaggtggttttgctgggtcccgcgctcctcctcctcctaggctgttctggttgggactgcggcggaggataactaggtaaggggaaggaaaggggaggtttgagggagagcgcagcggcagcggcagcagcgatgccatcgcacgagtatctggaccgccagatctcgcagctgcggaattgcaagttcctgcctgaggcgcacgtcatgacgctatgcgagcaggccaaggtgatcctcatggaggagtggaacgtgcagaccgtgcgctgccccgtcactgtctgcggcgatatccacggccagctctacgacctcatcgagctctttcgcatcggtggcgacgcgcccgacaccaactacctctttatgggcgactactgcgaccgtggctactactcaaaggagactgagaccttattgattgctctaagagtcgttatagagacagatctcgatattgagg

SEQ ID NO: 41862 - protein, 111 aa, Zea mays
  misc_feature: Ceres CLONE 1438439-F
  misc_feature: SWISSPROT Homolog: EC 3.1.3.16 Phosphoprotein phosphatase
MPSHEYLDRQISQLRNCKFLPEAHVMTLCEQAKVILMEEWNVQTVRCPVTVCGDIHGQLYDLIELFRIGGDAPDTNYLFMGDYCDRGYYSKETETLLIALRVVIETDLDIE

SEQ ID NO: 41863 - DNA, 807 bp, Zea mays
  misc_feature: Ceres CLONE 1438440-F
  misc_feature: Encodes the peptide sequence at SEQ ID NO. 41864
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
gggggtggccccccccccccnnnnncannnnnnnnaaaannanaggctccctttcccannnggccactcacgcggtggcggccgctctacaactagtggatcccccgggctgcaggaattcgcacgagaccattacctagaacatcctaatcgaaaatccaccaaattaaaccgccggcgcctccacttcgcgttctcgcctcatctcctcccgctcaggatccggcggtgaagccacggcaagatgcacaacgcgaggaagaagatccacaaggataagggccttgagccctccgagttcgaggactccgatgtccaggctttcttcgaactgaagaaaggcaaccaggagctcaagagcgacccccccaaccttcacctccagggcgcctatccacctgtatgccgcctggaagcaggaaggcctgttgagactcctggacccatacccggcaggcggacgggccttcccgtattatccccccgccccccgcccccccgggcaaagtgcaaacagacctctatgcgggcgaagtatgctggccaattgggcgcccccaccgggccaccacacaacggatgcacacaagaagggcgcgcacattgtcccgccccccgccccccacccggccactctagcacccgggtgccccagaacggatcgtcctcggaggcaacattgtcgcgcccccaaggttggcccccgcagctcgggattggggccaagcccaagtgcagcgcggccggcgacccccgtgtgggacccgccgacgcgcccccccccccccctccgcgtggggcgcgccc

SEQ ID NO: 41864 - protein, 187 aa, Zea mays
  misc_feature: Ceres CLONE 1438440-F
MHNARKKIHKDKGLEPSEFEDSDVQAFFELKKGNQELKSDPPNLHLQGAYPPVCRLEAGRPVETPGPIPGRRTGLPVLSPRPPPPRAKCKQTSMRAKYAGQLGAPTGPPHNGCTQEGRAHCPAPRPPPGHSSTRVPQNGSSSEATLSRPQGWPPQLGIGAKPKCSAAGDPRVGPADAPPPPPPRGAR

SEQ ID NO: 41865 - DNA, 680 bp, Zea mays
  misc_feature: Ceres CLONE 1438441-F
  misc_feature: Encodes the peptide sequence at SEQ ID NO. 41866
gcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcccgctcaccgcggtgggccgcaccctggtgccggggcccgcctcgggcgcgtcctacgccgactacgtgctgccacaccaccaaggactcccttgtgggcggcttgggcccccccttgcacgaaggccgtgcttgacccccgcgggggccccaaaccgtttcgcgcgccgcccaacgcccggggtccaccg

SEQ ID NO: 41866 - protein, 170 aa, Zea mays
  misc_feature: Ceres CLONE 1438441-F
  misc_feature: SWISSPROT Homolog: EC 2.1.1.68 Caffeate O-methyltransferase
MPPPSANGATAAAAAARDDMSPAEARLAMMELANMVSVPMALAAVIRLGVPAAVWAGGANAPMSAADLLPPGHPDPSVLERLLRLLASRGVFSESTESTPTTRRRLFPLTAVGRTLVPGPASGASYADYVLPHHQGLPCGRLGPPLARRPCLTPAGAPNRFARRPTPGVH

SEQ ID NO: 41867 - DNA, 711 bp, Zea mays
  misc_feature: Ceres CLONE 1438445-F
  misc_feature: Encodes the peptide sequence at SEQ ID NO. 41868
ggagctccccgcggtggcggccgctctagaactagtggatcccccgggctgcaggaattcgcacgagaccatacctagaacatcctaatccaaaaattgatccctgaaacccatcctcaattggtagctcgttgatcctaatccaagacctcgcgtcagcgcactgtctcgcctgttaattagtcgtctacgtcgtcttctatgtccaggctgatggctgccatgctgctcggaggcgcgcgcgtcacctgcgccttaaagcatctccggtaagggcgacgctgctggcttgcttgctcttcccatgccggcgtgcttccttccgccgctcccgcaggaagcgacctggacccgcctctgcttgcaagctgcaccaaaattgacccaggcttaagacaacgtcgccggatgaccggagagatataggggacattgtactaggatccccgcgaaggaggcgaaggactccaccgggcacgccaaggagcacgcccataggatggtctgtgagactaagagcagggcgcacgacaatgccggtcgcgtgacggaccaggcgtcgggcatggccgatcgggccaggtacacgcgaagggcgtggcggaggacgcctcgaacactgcgtccctggcgactgagcgagctagtaacgatactcttgactcggcacgagaggccgccaacatgtcgtgcacgtgaaggaccgggcag

SEQ ID NO: 41868 - protein, 70 aa, Zea mays
  misc_feature: Ceres CLONE 1438445-F
MVCETKSRAHDNAGRVTDQASGMADRARYTRRAWRRTPRTLRPWRLSELVTILLTRHERPPTCRAREGPG

SEQ ID NO: 41869 - DNA, 679 bp, Zea mays
  misc_feature: Ceres CLONE 1438446-F
  misc_feature: Encodes the peptide sequence at SEQ ID NO. 41870
ggagctccccgcggtggcggccgctctagaactagtggatcccccgggctgcaggaattcgcacgagaccattacctagaacatcataatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgggctaccaaaccttgctgcctactctcagcaacagcagttttcttccattcaaccaactagctgcattgaactcggcttcttatttgcaaaaaacaacaactaccattcagccagctacctggctgcctacccccaggaattttctttcccttcaccccactgggcgccattgaacttctcctgcttaatttacggcagcaacaactaccaccctttcg

SEQ ID NO: 41870 - protein, 175 aa, Zea mays
  misc_feature: Ceres CLONE 1438446-F
MAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLGLPNLAAYSQQQQFSSIQPTSCIELGFLFAKNNNYHSASYLAAYPQEFSFPSPHWAPLNFSCLIYGSNNYHPF

SEQ ID NO: 41871 - DNA, 651 bp, Zea mays
  misc_feature: Ceres CLONE 1438447-F
  misc_feature: Encodes the peptide sequence at SEQ ID NO. 41872
  misc_feature (501)..(501): n is a, c, t, g, unknown, or other
ctccccgcggtggcggccgctctagaattagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggaacctgcggtggtgcaagcaggcgtgcgagtggcagtacggaaaggacaccccgcggaagaggtaatgcgaaagcgagtgcctccaccggccccaccaacctgaagcggggcaaggacggcgaaagcgggcgtggagccctatcgtcttcccttcctcggaggggcaagtgccggnccccggggccttgccccccccagagggcccacccgggggaaaccccacgaagggcttgaaagggggtggcccccccccgcgaacggggccctcccccttggaacccagaaaatcggtctcctctccacataaaagccgccggccaatccc

SEQ ID NO: 41872 - protein, 74 aa, Zea mays
  misc_feature: Ceres CLONE 1438447-F
MGKGSVGASWWAFLLLAGVLLVVAATAGAEDGVVERDRKEEPAVVQAGVRVAVRKGHPAEEVMRKRVPPPAPPT

SEQ ID NO: 41873 - DNA, 791 bp, Zea mays
  misc_feature: Ceres CLONE 1438449-F
  misc_feature: Encodes the peptide sequence at SEQ ID NO. 41874
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
gtttttgcccnnnnnnannnncgggccgggggttgtactacgcggggagggaaaagggggcttccccgcggaggcggccgctcttttctagtggatcccccgggctgcaggatttcgcacgagaccattacctagaacatcctaatcgaaaaattgccgatcgcattccatcaaccagtccgaattcaaggagctgaggacaacctgtccgtccggagctgatcgatagacggaggggcggttccggttacagtccagctagcgagctagatagaagatcccgttcgctgacagatgggttcctacatccaaggggatgatgaggtccctgtgtacgagtcgggcgccgaggtgcttgcaaaggtgcaagagaaatgggcggcggcggcgggatcacggcctcctccctacccggccatgtactcaagggtgttcggcggcatcatcctggacccgggcatgatggccctccccatcaacaaccacatggtccaccgggggccccgggcgtggttccacacgcccatgatccctggaacgggcgccctgtaccgagcctgggaggcgcccccggaacccctttcctccggggccggccgcggcgggcccccggggggacccgggcccccgttcccccccccgaaggccttgtgcgggcgcactccttgagtccgagagggacccgccgcgccttcggggcttcgcccgcaagggggtctcccactccccgcgtactgtgggcttcaacccggccggggagccccgggggaaactttccctcgggcttagtc

SEQ ID NO: 41874 - protein, 124 aa, Zea mays
  misc_feature: Ceres CLONE 1438449-F
MGSYIQGDDEVPVYESGAEVLAKVQEKWAAAAGSRPPPYPAMYSRVFGGIILDPGMMALPINNHMVHRGPRAWFHTPMIPGTGALYRAWEAPPEPLSSGAGRGGPPGGPGPPFPPPKALCGRTP

SEQ ID NO: 41875 - DNA, 868 bp, Zea mays
  misc_feature: Ceres CLONE 1438452-F
  misc_feature: Translation starting site: 241
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (20)..(20): n is a, c, t, g, unknown, or other
  misc_feature (25)..(25): n is a, c, t, g, unknown, or other
  misc_feature (34)..(34): n is a, c, t, g, unknown, or other
  misc_feature (430)..(430): n is a, c, t, g, unknown, or other
gcccggggggnnnnnaananaaacnctccccctngggggttttttaaattggagctccccgcggtggcggccgctctagattagtggatcccccgggctgcaggaattctcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtgaggcggccttgcgctcgcgcttgggcttggggcccctaccagcgaccgcagcaagggggcattggtcgagcctaaagccttgcggcaagattgggggacagaagcttgttcttgtggncctcttcagttgggagtgctatgtaggtggttggttgtttgaggtggtgggcaccccgtgcccccatctaccattccggcaagctcgagtaggcttctccatccggttaatgggaatccgaaggaatttttctccttcgtagcgtttacattaatgaacttattagtgaggcggaccgcggagcgagcccgcgaggtgccgggcagtcgcgaagatatttgccacatcacctctccgttgtatcactgggggggtgcggttggtagtgtggagatgatgtgggctgcgtcgtgtcgccgtgtgtgggcgctcttttcgacgggggcgtataactatttattagcaaagggagcacccggcgcgtaggcgccgtcgtgtgcttcgttaggtagcgcggcgcccagcccgggagggtgtgataacataagcttcaaaacc

SEQ ID NO: 41876 - DNA, 683 bp, Zea mays
  misc_feature: Ceres CLONE 1438453-F
  misc_feature (275)..(275): n is a, c, t, g, unknown, or other
  misc_feature (276)..(276): n is a, c, t, g, unknown, or other
  misc_feature (617)..(617): n is a, c, t, g, unknown, or other
ggcggccgctctagaactagtggatcccccgggctgcaggaattctcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccnnggcatccaagtcggcaacgcggtggctggggaactttttacctgccctccgaggcaccgggcttcccagccctggatgggccaaagggcccggggaaaataaaaaaaccccccggggggccaccccccccgagggtggagggggccccttcttaggaggaacaactccttctttttttttgttcccccccccccccaccccctttttcggggttgttgggtgtgtaatatagtagaggagagggagtttggtttggcccccgccccgcggagaatatactctcctcggctctttcccataggaccacaaccaccccccggcctcgtgtgtggttggttttnttttgttggaattatataaaaatatacaggggggcgtcccccctctccacaccccccctgcctctt

SEQ ID NO: 41877 - DNA, 709 bp, Zea mays
  misc_feature: Ceres CLONE 1438454-F
  misc_feature: Encodes the peptide sequence at SEQ ID NO. 41878
  misc_feature (600)..(600): n is a, c, t, g, unknown, or other
  misc_feature (709)..(709): n is a, c, t, g, unknown, or other
tggcggccgctctagaactagtggatcccccgggctgcaggaattcgcacgagaccattacctagaacatcctaatcgaaaactctattcgttccccgcctcaccccgagccagccgtctcgctagggtttcgccgccgccgccgccatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccagaccattcagcatgagactggtacctcagaaactgctgctgcagcccctgccccgacaacgataaatgacgatgccatcaattgctttcctagagtttatccaaggtaagctctggtgatctaggcaaagccatggaaggaccaaacaagtggccagagaatcctcatgagttcaaagagttgatggaggagtatctaaggctctgtacagatctgtcaagaaacatcnttgaggggaattgcattagctcttggaggatcaccgtatgagttcgaaggaaaaattgctggagagcctttttgggtgatgcgtcttattggctatcctggtgctcccn

SEQ ID NO: 41878 - protein, 68 aa, Zea mays
  misc_feature: Ceres CLONE 1438454-F
MFGGIGSTIAQGMAFGTGSAMAHRAVDAVLGPQTIQHETGTSETAAAAPAPTTINDDAINCFPRVYPR

SEQ ID NO: 41879 - DNA, 776 bp, Zea mays
  misc_feature: Ceres CLONE 1438455-F
  misc_feature: Encodes the peptide sequence at SEQ ID NO. 41880
  misc_feature (311)..(311): n is a, c, t, g, unknown, or other
  misc_feature (500)..(500): n is a, c, t, g, unknown, or other
  misc_feature (503)..(503): n is a, c, t, g, unknown, or other
  misc_feature (518)..(518): n is a, c, t, g, unknown, or other
  misc_feature (586)..(586): n is a, c, t, g, unknown, or other
  misc_feature (603)..(603): n is a, c, t, g, unknown, or other
tggcggccgctctagtactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcgggctgcacggcgaggcgcagcagcagcagaagcagggcgccatgatgacggcgctcaaggccgcganaccgcccccacccttcggcggttcgatgctggtgctgtttggcccccaccctggccggcacccgtgatcccccctcaccgtgggccaccccccccggctgggtgatccttcaccccccgtggcctggtggcccggcccccccctcccccgcctgggggctctattgggggggggccggggtttaaaaanaancgctctgttactggnttcctcccgcggggggacccacccggtcttcctataacctttgtgccgggttttctctcgggggtgantaaaatccgcgaggggnaaaccccccccgccggggcccaacaaactttgggccacccccaaagggaaagggggggggggtccccagggccccgccaacaataagagaggggggggaaaaaaccgcgcgctttttctcaaccaacaaaagggtggggctttttaataataaacaaaccacccccctgcccg

SEQ ID NO: 41880 - protein, 66 aa, Zea mays
  misc_feature: Ceres CLONE 1438455-F
  misc_feature (45)..(45): Xaa is any aa, unknown, or other
MADHHRGATGGGGGYGDLQRGGGLHGEAQQQQKQGAMMTALKAAXPPPPFGGSMLVLFGPHPGRHP

SEQ ID NO: 41881 - DNA, 672 bp, Zea mays
  misc_feature: Ceres CLONE 1438457-F
  misc_feature: Encodes the peptide sequence at SEQ ID NO. 41882
  misc_feature (659)..(659): n is a, c, t, g, unknown, or other
ggagctccccgcggtggcggccgctctatactagtggatcccccgggctgcaggaattcgcacgagaccattacctagaacatcctaatcgagaaaaaatctcccaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgcatccgcggggagcgcgcttaggcgtttacggttgattgtcactactgtagatgtttaggctatgttctcgccatgtcctangtctgctttgttc

SEQ ID NO: 41882 - protein, 136 aa, Zea mays; identical to SEQ ID NO: 6923
  misc_feature: Ceres CLONE 1438457-F
  misc_feature (58)..(132): Pfam Name: Histone Pfam Description: Core histone H2A/H2B/H3/H4

SEQ ID NO: 41883 - DNA, 900 bp, Zea mays
  misc_feature: Ceres CLONE 1438458-F
  misc_feature (6)..(6): n is a, c, t, g, unknown, or other
  misc_feature (15)..(15): n is a, c, t, g, unknown, or other
  misc_feature (31)..(31): n is a, c, t, g, unknown, or other
  misc_feature (47)..(47): n is a, c, t, g, unknown, or other
  misc_feature (826)..(826): n is a, c, t, g, unknown, or other
ttgttntgggtgggnttttggtggtgttaanaaacttcccccccctnaaaccgggcctcaccgcggtgggggccgctctagaactagtggatcccccgggctgcaggaattctcacgagaccattacctagaacatcctaatcgaaaagtttccccgccgccgcctccaagcgcccccgcgagccagctccagcgaagtcgacggcaccaagcatggcgggacacaaaggcgtcacccacagaagacgctccgcacgcgcaagttcatgaccaaccggcgcctctcccggagggaattcggggtcgaggtttctccaccccgggggcgcagagggtttttaaggcggaacccccgggcaccagcctgggattgtaggtagcaaacaaaggaacgcgattgggttgaacagggttcaagagggggacgccgctttcgaaagaccaacaaagagaagccgggtttgggtgctcgggtctgaccacgcgggggccccccccaggcggggggggggtaaaaccagccaagaaaaaaagagggggaggggggggcggggcatagtggcggcgcggaaattaccctgcgctttcgccccgccctcaaatctccgcgcggggggaaaaaaaggggcggggggggggaggaaaagagccccccccgcagcttcgggggaacatcaaatgggtcgctggggcgcgcccctatactatccatacttgggcgctgcggttggcggtgcgttatactgtgtggggcgggcgggtgaaaattgggggcgaagacaacaaattcttaccaactcgcgaagactgcggggggccgcggaangggcgcgccgcaacaaaggcgggcgacgtaagggggcgggcgtctcttacgggggcggggggggcggtctgtcg

SEQ ID NO: 41884 - DNA, 751 bp, Zea mays
  misc_feature: Ceres CLONE 1438462-F
  misc_feature: Encodes the peptide sequence at SEQ ID NO. 41885
  misc_feature (751)..(751): n is a, c, t, g, unknown, or other
tctgaattcgtggatcccccgggctgcaggaattcttacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgcccaaccgaagtctaacttcggggaggccaaggggaaaaattcccgggggcccccccaaaccttgggcccccaagcccccccccccttctttaaaaagttgttggaaaacgtgttgattgaacttatctccgggccaaccatggccccttcttggggttccccgggcaagtgccaaggagatggccccccctggcaaatccgccaaaaacacaaccctggggggactcctggtagggagccccaccccccccccggggggtgtatcggtcccacaggccccctccccgggttttccgccgcggggggagcccccccctccccttgttcgggccactcccctctttcccacaagacaccccggccgccacgctcggggtgcgtcgacacacattatccctccggccccctttggaaagatcggcggcccctcgn

SEQ ID NO: 41885 - protein, 51 aa, Zea mays
  misc_feature: Ceres CLONE 1438462-F
  misc_feature: SWISSPROT Homolog: EC 1.1.1.1 Alcohol dehydrogenase
MATAGKVIKCKAAVAWEAGKPLSIEEVEVAPPQAMEVRVKILFTSLCPTEV

SEQ ID NO: 41886 - DNA, 723 bp, Zea mays
  misc_feature: Ceres CLONE 1438463-F
  misc_feature: Encodes the peptide sequence at SEQ ID NO. 41887
  misc_feature (385)..(385): n is a, c, t, g, unknown, or other
  misc_feature (555)..(555): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactancacatccagaagggagtcaccctccacttggtgctgcgccttaggggaggcatgcagatctttgtcaagaccttgactgggcagacatcacccttgaggtggagtcctcaaccccatggacaatgtcaggcaagaatccggaacagggaggggattcccactggacaagnacgttttatttttttccgnaaccatttggaggaggggaagacctttgctaattccaacttcaaaaggggaccccctccccttggggccgggcctaaaggggggaatccaaatttttggaaaacctttttggggaaaactttccctttgggggggggtccccaaaaccc

SEQ ID NO: 41887 - protein, 171 aa, Zea mays
  misc_feature: Ceres CLONE 1438463-F
  misc_feature (6)..(74): Pfam Name: ubiquitin Pfam Description: Ubiquitin family
  misc_feature (59)..(59): Xaa is any aa, unknown, or other
  misc_feature (116)..(116): Xaa is any aa, unknown, or other
MQIFVKTLTGKTITLEVESSDTIDNVKAKIQDKEGIPPDQQRLIFAGKQLEDGRTLADXHIQKGVTLHLVLRLRGGMQIFVKTLTGQTSPLRWSPQPHGQCQARIRNREGIPTGQXRFIFFRNHLEEGKTFANSNFKRGPPPLGAGPKGGNPNFWKTFLGKTFPLGGGPQN

SEQ ID NO: 41888 - DNA, 714 bp, Zea mays
  misc_feature: Ceres CLONE 1438465-F
  misc_feature: Encodes the peptide sequence at SEQ ID NO. 41889
caaagctggagctccccgcggtggcggccgctctagaactagtggatcccccgggctgcaggaattcgcacgagaccattacctagaacatcctaatcgaaaacccaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaaggaggagggtcgaggcaatgaggaccgtgtaacactcatcaaggactaccgtgggcagatgaaactgagctcaccagatctgtgatggcatcctcagcttctcgaattcacttggggcggtctccacggtccccgagccaagggctctattccaagatgaggggggactaccaccgaaactttgtaagtttcaaaatgggacttaaaaaaaggccctcttaaaaacccatgggggaataaagggtcccagaaaaatttttgggggaaacttccccccccccccattaagggtgggcggggccccc

SEQ ID NO: 41889 - protein, 81 aa, Zea mays
  misc_feature: Ceres CLONE 1438465-F
MASAELSREENVYMAKLAEQAERYEEMVEFMEKVAKTVDSEELTVEERNLLSVAYKNVIGARRASWRIISSIEQKGGGSRQ

SEQ ID NO: 41890 - DNA, 719 bp, Zea mays
  misc_feature: Ceres CLONE 1438467-F
  misc_feature: Encodes the peptide sequence at SEQ ID NO. 41891
acccgcggtggcggccgctctagaactagtggatcccccgggctgcaggaattcgcacgagaccattacctagaacatcctaatcgaaaaccacttccttccacaaccggaaaagagaaagcaggagcaccaattcggcgaggaaacacatagccaagccaaggaaatggcgcactaccaccccgtgtccgcggacacttaccaagacctcgaggccggcttctccggccactcctcctcccctctgaagcccgcggcctcgccgaggcggcccggccgcatgttctgcgacccctgcgacgacggcgacgagctccacggccgccaccactacctcgacatctgcttccgctgccgtaaactcctgtccggcaacagagacatcttcatgtacagaggtgacctgccgttctgcagcgaggagtgccggcaggagcagatcgagatcgacgaggcgcgagagcagcggctgaagcagacggggcgggccgagcagcagcggcagccgcagcagaagcagagcccccagaggatccccctctgggcgtggtaggatgagaaaaattttggggcgccgggaaaaccaacgaacgtagtagggatttagctgcacctcaaaaagacccccccaagcaagggcaactttgctgcctggtgaaaacaaaccggccgtgggatcaccccccggctcaacgcagggaagaaggccccccccccac

SEQ ID NO: 41891 - protein, 128 aa, Zea mays
  misc_feature: Ceres CLONE 1438467-F
  misc_feature (41)..(99): Pfam Name: DUF581 Pfam Description: Protein of unknown function (DUF581)
MAHYHPVSADTYQDLEAGFSGHSSSPLKPAASPRRPGRMFCDPCDDGDELHGRHHYLDICFRCRKLLSGNRDIFMYRGDLPFCSEECRQEQIEIDEAREQRLKQTGRAEQQRQPQQKQSPQRIPLWAW

SEQ ID NO: 41892 - DNA, 569 bp, Zea mays
  misc_feature: Ceres CLONE 1438469-F
  misc_feature: Encodes the peptide sequence at SEQ ID NO. 41893
  misc_feature (346)..(346): n is a, c, t, g, unknown, or other
aaagctggagctccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcaggaagaggcggggcccgatggtgagcagtgaaggcatgctcacgacaggggcgacgcgtccaagcgctaacngtgcgaccctgttcccgctggggggctgctgctgtgctttcggggctgcccttgacggctccgtggtggggctgccctgggcaccccggttttctgatctccagccggggcgggcccccgcggctttctcacgggagggcgcataggggtcccccatccgggccccctgggcttcgggggccttcccccctccatggccccccaaaaaggggggggggggggt

SEQ ID NO: 41893 - protein, 32 aa, Zea mays
  misc_feature: Ceres CLONE 1438469-F
MADRDRSGIYGGAHATYGQQQQQEEAGPDGEQ

SEQ ID NO: 41894 - DNA, 709 bp, Zea mays
  misc_feature: Ceres CLONE 1438471-F
  misc_feature: Encodes the peptide sequence at SEQ ID NO. 41895
  misc_feature (522)..(522): n is a, c, t, g, unknown, or other
  misc_feature (533)..(533): n is a, c, t, g, unknown, or other
  misc_feature (584)..(584): n is a, c, t, g, unknown, or other
  misc_feature (677)..(677): n is a, c, t, g, unknown, or other
gctctagaactagtggatcccccgggctgcaggaattcgcacgagaccattacctagaacatcctaatcgaaaaaagggccaaggcagggcactgcactgcacgcatgcactgacctgacgacgacgcgcgccacagtccacagctccacactcagacatggcgatgggcgccgcttccatcctactgatgatggtttcgctggaggccctgcttctcgccgccgccgccggcgccggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgcttcgatcgggttgagcgctgctccgacgcctgtaaggagtgcgtggaaacggaggactcgcgccacgtctgcgtcgacaggtaccgtggcgaccccgggcccaggtgccacnacaaggacggnaggagcggcggacccgctgacgacgacgctggtgggcaagcgacgccgacngcagtgatggcagatgacaagaaagcaggcggcggcgacgacaacaagaagaggaaggccgtgaaaatgctgcaacgtgcccatctgcaccangtccctggccttccggtgtgccgctgcgcgga

SEQ ID NO: 41895 - protein, 183 aa, Zea mays
  misc_feature: Ceres CLONE 1438471-F
  misc_feature (122)..(122): Xaa is any aa, unknown, or other
  misc_feature (173)..(173): Xaa is any aa, unknown, or other
MAMGAASILLMMVSLEALLLAAAAGAGGTIRLPSDVGGVAADLVTAMARARARAKHQLRDEERPWGECCDLAVCVKTYPLTCSCFDRVERCSDACKECVETEDSRHVCVDRYRGDPGPRCHXKDGRSGGPADDDAGGQATPTAVMADDKKAGGGDDNKKRKAVKMLQRAHLHXVPGLPVCRCA

SEQ ID NO: 41896 - DNA, 687 bp, Zea mays
  misc_feature: Ceres CLONE 1438476-F
  misc_feature: Encodes the peptide sequence at SEQ ID NO. 41897
  misc_feature (432)..(432): n is a, c, t, g, unknown, or other
aagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctgggcgggcacgtgatcgcgctcacggtggccacccccgtgctggtgatcttcanccccggtgcctgggtgccgggccgccatcccctggccctcatgcggccggttttcgtcacctccgggggccctcgggttcctggcctggccctggttcccctggatgtacaaatccctgaagggaaaaccccccccgggggcccaaaccgttggaccaccccagagggaggttgggttccaaaggcccccaaattcagggggtggggaaaaacccctttttcccaaaaggggggggtttttgaaaaaaaaaaccc

SEQ ID NO: 41897 - protein, 163 aa, Zea mays
  misc_feature: Ceres CLONE 1438476-F
  misc_feature (36)..(156): Pfam Name: Oleosin Pfam Description: Oleosin
  misc_feature (79)..(79): Xaa is any aa, unknown, or other
MADHHRGATGGGGGYGDLQRGGGMHGEAQQQQKQGAMMTALKAATAATFGGSMLVLSGLILGGHVIALTVATPVLVIFXPGAWVPGRHPLALMRPVFVTSGGPRVPGLALVPLDVQIPEGKTPPGGPNRWTTPEGGWVPKAPKFRGWGKTPFSQKGGVFEKKN

SEQ ID NO: 41898 - DNA, 716 bp, Zea mays
  misc_feature: Ceres CLONE 1438482-F
  misc_feature: Encodes the peptide sequence at SEQ ID NO. 41899
acccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtgtcgaggaagatcttcgactcgctgcccggcgaagagcagcgggctgtgcactcgcacgcgcacgagatcaagtcaggcctgtggaccagcccgcacgtggccgggctgctggaagaggcggaacctgaacacctgcgccccccgttccgcaagttctggtgcccctggcagggggaaccgcgcaaccgccttgcgttgtgcccccccccccctatggggtccccccaggccaacccccccgcaaacctggcgccc

SEQ ID NO: 41899 - protein, 191 aa, Zea mays
  misc_feature: Ceres CLONE 1438482-F
  misc_feature (26)..(191): Pfam Name: DUF1264 Pfam Description: Protein of unknown function (DUF1264)
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLIGVEYIVSRKIFDSLPGEEQRAVHSHAHEIKSGLWTSPHVAGLLEEAEPEHLRPPFRKFWCPWQGEPRNRLALCPPPPMGSPQANPPANLAP

SEQ ID NO: 41900 - DNA, 738 bp, Zea mays
  misc_feature: Ceres CLONE 1438486-F
  misc_feature: Encodes the peptide sequence at SEQ ID NO. 41901
  misc_feature (321)..(321): n is a, c, t, g, unknown, or other
  misc_feature (340)..(340): n is a, c, t, g, unknown, or other
tccccgcggtggcggccgctctagaactagtggatcccccgggctgcaggaattcgcacgagaccattaactagaacatcctaatcgaaaagtttcagggctcctcccatttcgtcggcttcgtttgtcgtcgtcgtaagctgcagctagtgtggactggagatccaccactccaccagtccggtccatctgctggacctcgattggtttcttcttacctaggaacatccggggatgtcaactcctgcgaggaagaggctgatgagggatttcaagcggttgatgcacgaccctccggccggcataagtggcgccccgcangaatacaacataatgctgntgaatgctgtcatatttagacctgatgatacccccgtggatggacgtacgttttaagctgactcttcagtttgatgaaaaatatcgaaacaaaccaccgactggtgcaattttttctaggatgttcccatcttactttttatgccgatggaaacattatctttaatattcctggcaaaaccaggggaatcccaaaatttgaaggaggtgccaaaacccccgtaaatccggtaattgtgtggcgaacccaaccccaaattcccccaaaaattggaaaccccccccctgtttccgggaaaaaaaaggagaaaacccccccccaaaattttggggggtgtggaaaaaaaaattgcccccgaaaaaaaaaactccctttggtggcccccccctatgaaaaac

SEQ ID NO: 41901 - protein, 53 aa, Zea mays
  misc_feature: Ceres CLONE 1438486-F
  misc_feature: SWISSPROT Homolog: EC 6.3.2.19 Ubiquitin--protein ligase
  misc_feature (29)..(29): Xaa is any aa, unknown, or other
  misc_feature (36)..(36): Xaa is any aa, unknown, or other
MSTPARKRLMRDFKRLMHDPPAGISGAPXEYNIMLXNAVIFRPDDTPVDGRTF

SEQ ID NO: 41902 - DNA, 890 bp, Zea mays
  misc_feature: Ceres CLONE 1438488-F
  misc_feature: Encodes the peptide sequence at SEQ ID NO. 41903
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (38)..(38): n is a, c, t, g, unknown, or other
nnnnnngggggtgggggggggtaatttttgtcttcccnccccctaaaaggagctccccgcggtggcggccgctctagaatagtggatcccccgggctgcaggaattcgcacgagaccattacctagaacatcctaatcgaaaacgcaaacccctctcgatcgacacacgcagccgcgacccatcgcgacctgacccgaccctcccgaaggccgccagccttatcctctccgcctccgcctcccgccgtcccctccggaccatcacaagcgcgagtagaagacatggcctcgacgttcggtgccacttctacagttggccttatggctgctcccacggggaagaaagggcgccttcggaggaggggtaacttcgtaagaaaagggggcaaagggtctgtctttaaggaagggatgggtccatttatcccaaaaggttcgggggggggggattcaaataagctttgccagaccgtggtttggaactcccccctctgaaccaaaggggaaaggaaattggccgtttgtgggaggagccaaaaacctggcttccccccgaagagtgggttaagcggatggcccgttccacctgttccgccaaggaaagaggtttgagacccgggaggggcaccctcggggggaaaacgcttgtgggagcgaaaatttggggctaggggccaggccttcaaaattacaaaacccacccgtatctctgtctagtgggcaagtgggactaatgcctcttcggtgggggttccgtgcggctctttcagcttagtgtgggggtgaggggggagcaaataacgtccacggcaaacccgggggggcgatctcgggggcggaatatgctctggtgccagctcggcagggcgagcaataaggagccggggggg

SEQ ID NO: 41903 - protein, 70 aa, Zea mays
  misc_feature: Ceres CLONE 1438488-F
MASTFGATSTVGLMAAPTGKKGRLRRRGNFVRKGGKGSVFKEGMGPFIPKGSGGGDSNKLCQTVVWNSPL

SEQ ID NO: 41904 - DNA, 771 bp, Zea mays
  misc_feature: Ceres CLONE 1438489-F
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (771)..(771): n is a, c, t, g, unknown, or other
gtggggggggccccccccccggggggnnnaaaccnnanaaaaggccccccaaaacacctggagctcaccgcggtggcgggcgctctataactagtggatcccccgggctgcaggaattcgcacgagaccattacctagaacatcctaatcgaaaactcggctcatctcatttttctagttcggcccctctactgttccaatgataataaaaagattctcgattcgatttactcgccaattttcagtgagcggcggcgatcggcttcggatcggcgcagcgcggcggagcgtagatggttgccgtgcttgtggatggcctgatccgcgacgcggaagccgtgcctacgacgtacagggaagcggtgagggcggcatttgcctgggcggtggccaacggcgatgagggctaatctttgaaggaggaggagaggaagtatgagaccgacatgaagaaggtggagaagatgcatcctaccctgaacccctctgtggagggattcgtgccacagtccctccgccgaggggaccgccgccctccccaacctttcggctgaccccccagattgcgggaacgacggatgaaggaatttgtatgggccgccggcggtgggctccccgccaaccgtaagttctcaggcgcctacctgttactgcaatgggcccgtcgttttatacaatttatgtggttggcgcggtcgggtcctttttttgggctggaggaggaggcgctggtcagcgtggacgaatgtgagtgggccgttctgtacggan

SEQ ID NO: 41905 - DNA, 739 bp, Zea mays
  misc_feature: Ceres CLONE 1438490-F
  misc_feature: Encodes the peptide sequence at SEQ ID NO. 41906
  misc_feature (51)..(51): n is a, c, t, g, unknown, or other
  misc_feature (349)..(349): n is a, c, t, g, unknown, or other
  misc_feature (389)..(389): n is a, c, t, g, unknown, or other
  misc_feature (395)..(395): n is a, c, t, g, unknown, or other
  misc_feature (456)..(456): n is a, c, t, g, unknown, or other
aagctggagctccccgcggtggcggccgctctagaactagtggatcccccngggctgcaggaattcgcacgagaccattacctagaacatcctaatcgaaaagaaacccgtctcgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaagacccccccacatcatgcagtgcaggtcctgctggtgaggacatgtttcattgggcagcnaacattatgggaccacctgacagtccctatgctggtggtngtttcntagtgaacattcatttttccgcagattaccccttcaaaccttcaaggtttctttccagganaagggtcttccatcctattatcaaccgcaattggaaggttttggccttgactttcccaaaaagcagggggacccctgctttggaaatttccaagaggccgggtctccaattggccccgggggagagcgacccccacccgggaaaaccctttttgtccccgaaaaattccccccatgtttaaaaaaaagagcccgcccaaaaattaatatttcacgcgccccccccttgggggcccaaaaaaaacccgcggtgggggtgtaaaaaaaatttttttttcttgtgt

SEQ ID NO: 41906 - protein, 130 aa, Zea mays
  misc_feature: Ceres CLONE 1438490-F
  misc_feature (5)..(129): Pfam Name: UQ_con Pfam Description: Ubiquitin-conjugating enzyme
  misc_feature: SWISSPROT Homolog: EC 6.3.2.19 Ubiquitin--protein ligase
  misc_feature (49)..(49): Xaa is any aa, unknown, or other
  misc_feature (51)..(51): Xaa is any aa, unknown, or other
  misc_feature (71)..(71): Xaa is any aa, unknown, or other
MASKRILKELKDLQKDPPTSCSAGPAGEDMFHWAANIMGPPDSPYAGGXFXVNIHFSADYPFKPSRFLSRXRVFHPIINRNWKVLALTFPKSRGTPALEISKRPGLQLAPGESDPHPGKPFLSPKNSPHV

SEQ ID NO: 41907 - DNA, 639 bp, Zea mays
  misc_feature: Ceres CLONE 1438491-F
  misc_feature: Encodes the peptide sequence at SEQ ID NO. 41908
  misc_feature (336)..(336): n is a, c, t, g, unknown, or other
  misc_feature (488)..(488): n is a, c, t, g, unknown, or other
  misc_feature (544)..(544): n is a, c, t, g, unknown, or other
aagctggagctccccgcggtggcggccgctctagaactagtggatcccccgggctgcaggaattcgcacgagaccattacctagaacatcctaatcgaaaaaaattccacaaccgaaacctgcagtcgggtcatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtgggccccgcccccgccccngctttatcacgcgccaccgccgcgccgtccgcctacggagggcacccctacatctactccccccgcggcggcgccgccacctccccgaagaatacgatggactccgtgaaggacgtgctccgcaagaatgggaaaaagtttgggcgaggcgncccgcaagaacgagaacatccccgggaatttctgggcaccctttgaaactggaccnaggcttactgatgcagcatgaccagggtctcccagggtcaccaagtcattgcgaaagggggaaatgaacaaattttcccctcaaactttttgggg

SEQ ID NO: 41908 - protein, 107 aa, Zea mays
  misc_feature: Ceres CLONE 1438491-F
  misc_feature (93)..(93): Xaa is any aa, unknown, or other
MNPPAAAASTGAGGHAAAPAAAREYVHYPRLSPEEVGPAPAPALSRATAAPSAYGGHPYIYSPRGGAATSPKNTMDSVKDVLRKNGKKFGRGXPQEREHPREFLGTL

SEQ ID NO: 41909 - DNA, 734 bp, Zea mays
  misc_feature: Ceres CLONE 1438492-F
  misc_feature: Translation starting site: 189
  misc_feature: SWISSPROT Homolog: EC 3.4.25.1 Proteasome endopeptidase complex
  misc_feature (526)..(526): n is a, c, t, g, unknown, or other
  misc_feature (651)..(651): n is a, c, t, g, unknown, or other
acccgcggtggcggccgctctagaactagtggatcccccgggctgcaggaattcgcacgagaccattacctagaacatcctaatcgaaaaaccaccaccgctctgcctcgcctcgcctcgcgtcgtctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccacaacacacaatccagcttggacaaccagctaccgttaaagttgcagccaacttgattaggttgctagcttatcagaancagaacatgttgcaagctggcatgattgttggaggatgggacaagtacgagggaggcccaattttctcagtccctcttggtggaacgatctgaagcaccatttgcaattggagggtcaggtccangtacctatatgctcttcctgatcatgaatggaaagagggaatgagtcaggaaaaggcaaaaaattgttggtggaagtagctcc

SEQ ID NO: 41910 - DNA, 789 bp, Zea mays
  misc_feature: Ceres CLONE 1438496-F
  misc_feature: Encodes the peptide sequence at SEQ ID NO. 41911
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
nnnccccnnnnnnnnnnnnnnnnnnnaaaaaaaccccacagcccgggggcnnnnaaaagggggagctccccgcggtggcggccgctctagaatagtggatcccccgggctgcaggaattcgcacgagaccattacctagaacatcctaatcgaaaaaaattgctcagctattgagattttagcatttcatcctaaaaatgttctttcagattattcagggggttttcaccggcgttgaggcattagctctattggcattcgctggtataacccttggcggctcagcagtgggactagctttaagcacgccgctttttatcctattcagtccgattctcgtgccagcaactatagccaccactttgttaactacgggtttcacgacctccgggggcttaggaatggtggctctccgcatcttctgggaaactcttcaagcgtcttaggaagaaggggaaaggaacgccaaaaattccgggattggcccccgggggctccggattctgatccagtgtctggaggataaacggagtaggccttcgtagtatgagataatccatggaggaatttaatgagaattgctgggggttccttaaataaaaacctaaattatccagggtctttaacggaatactgattccgccccggatgaaactaagtggtttcaaattacccatttttcaaatggaagaaccggggttccgaaaattatacataaaggggaccctcgatccatggttgggataatattaaaaggaatttagggtggataatcccctggaagaattc

SEQ ID NO: 41911 - protein, 82 aa, Zea mays
  misc_feature: Ceres CLONE 1438496-F
  misc_feature (1)..(82): Pfam Name: Oleosin Pfam Description: Oleosin
MFFQIIQGVFTGVEALALLAFAGITLGGSAVGLALSTPLFILFSPILVPATIATTLLTTGFTTSGGLGMVALRIFWETLQAS

SEQ ID NO: 41912 - DNA, 742 bp, Zea mays
  misc_feature: Ceres CLONE 1438497-F
  misc_feature: Encodes the peptide sequence at SEQ ID NO. 41913
  misc_feature (238)..(238): n is a, c, t, g, unknown, or other
aaagctggagctccaccgcggtggcggccgctctagaactagtggatcccccgggctgcaggaattcgcacgaagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctggnggtgaaaggtctggtggactccggcgtcaagtccatcccgtccatcttccacacccgccggaaagcctgagcgacataatttctcccggcgcctctgccgccgtcgccggcctccggcggccgcattccggtgggtggacctctcggtgacgcggcccgaggaccttatccagcaggtgaggcccccggccgggaccgggggcttcttctggtggggaaccccgaatgccgaagaactaatgggcggattctcccccgggggccccatttacaaggcccccggggagggaaacaagcccctccaccaaggaacccccctaaaactggggttccccccaaattttaacctttaaggggtgcgggggcaaggggcccaccctttttttggggggggcccccaccccccccccgggaggggtccccaccccccaaaaatttttttgtaaaccccccgggaaaaaaaaacggggggttttttttaaattttttaacacccccccggcc

SEQ ID NO: 41913 - protein, 52 aa, Zea mays
  misc_feature: Ceres CLONE 1438497-F
  misc_feature: SWISSPROT Homolog: EC 1.14.11.20 Desacetoxyvindoline 4-hydroxylase
  misc_feature (30)..(30): Xaa is any aa, unknown, or other
MAPTTATKDDSGYGDERRRELQAFDDTKLXVKGLVDSGVKSIPSIFHTRRKA

SEQ ID NO: 41914 - DNA, 700 bp, Zea mays
  misc_feature: Ceres CLONE 1438499-F
  misc_feature (474)..(474): n is a, c, t, g, unknown, or other
aaagctggagctccccgcggtggcggccgctctagaactagtggatcccccgggctgcaggaattcgcacgagaccattacctagaacatcctaatcgaaaaccgcagttcccacccaccaaaccaaactctcctccacaaccacaacctcccccgccgcccctcctcttctcggcttctcccctgccttgttcggccccaaaacggcaagagccgacgccagcaaaccctcgggttcgggagggaaggaaggcacgagcagtgcggctgcctacccgcagctaaccccaaacagcaacgtcgtagccgacgagagcctccgccacctacccaccaactcccgcccgtcgtcgcctccgcttgggttctcgtcgagcagttggtgggcacctaccgcatccagccacagagagagagtgagccactgagccagggcggcaagggggagatgaagaagctgtaccaggcggcaangggggcggcgggtgcacccggcgccggctgacgcatcggcagccgtggcgctgccggccgccgtgctggccctggcgtccgcgctgacggccgaggagcaggaggtgctggcctacctcctgtcctgcggcggcggccggcaccaccacggccacggccgccgccgcggggcccacccgccggagatgggctgcgcctgcttcggctgctacaagagcttctgggc

SEQ ID NO: 41915 - DNA, 689 bp, Zea mays
  misc_feature: Ceres CLONE 1438502-F
  misc_feature: Encodes the peptide sequence at SEQ ID NO. 41916
tgtggatcccccgggctgcaggaattcgtacgagaccattacctagaacatcctaatcgaaaatctctccgatcggatgaaaacttcaacagattggtatgagctcctgaacgttgtagtttatcttcgcttttcgttatcttcttcgattccgtctcgaattttgaattgatgattctccttatttcatcggaagcatcgaggatttggagattacgaatcttttgatccgatcaaacgttggagcctcttcagataaagtagaatgagtagaaaaagagcagaaaatgacactgagtcaggatcaggaacagccactccggtggatagattcgggttcctgaagcaagaacatgccagcaaggctagaacaacaacaacatcatcatccactgaccaggacagagaggagagaaaagtgaggaaatggaggaagatgattggggttggaggcagtgactggaagcattacgttagaaggaaacctaacgttgtcaagaggcgtatacgcaaagggatccctgattgtttaagaggtcttgtttggcagttgatctctggaagccgcgaccttttgcttatgaatcctggtgtttatgagcaactggtgatttatgagacatcggcatcagaacttgatatcattcgagacatatcacgtactttcccgtcccatgttttctttcaga

SEQ ID NO: 41916 - protein, 141 aa, Zea mays
  misc_feature: Ceres CLONE 1438502-F
  misc_feature: SWISSPROT Homolog: EC 3.1.2.15 Ubiquitin thiolesterase
MSRKRAENDTESGSGTATPVDRFGFLKQEHASKARTTTTSSSTDQDREERKVRKWRKMIGVGGSDWKHYVRRKPNVVKRRIRKGIPDCLRGLVWQLISGSRDLLLMNPGVYEQLVIYETSASELDIIRDISRTFPSHVFFQ

SEQ ID NO: 41917 - DNA, 709 bp, Zea mays
  misc_feature: Ceres CLONE 1438511-F
  misc_feature: SWISSPROT Homolog: EC 3.4.25.1 Proteasome endopeptidase complex
aaagctggagctccccgcggtggcggccgctctagaactagtggatcccccgggctgcaggaattcgcacgagaccattacctagaacatcctaatcgaaaaaaaaagggtaccggaagcggcgaaagcctcgccccccgccgctctcgcatcgtctccggagcgcacgtcagatcaggtgcgccgcgcccccctcgcctaagctgcgacgaccatccatcgaacaggaaggatgacgggctccatggatctcccggccaagggcgggttcagcttcgacctgtgccgccggaacacatgctggagaagacgggctcaggtcccggggatcggaagaccggacaccatcgtcggcctgtctttcaggatgggttggttcttgggcaaaccaagggcacttgaggcccctagttgcctgataaaacttggaaaatcccctttttggcccaaaatttcccggttggaagaagaacttttgcaacccgggggcctttacaaaatggggagcccccccataaattttcccctttttcaaggggccccaaaaaaaaggggaaaaccccttcaacccgagggaaccccccccctttaaaataaagggcggggggggggccccccctttttttttggggggggaatatttccgcccccccttttacccgttttttttccccgggcgcccgagttttctttttttttgcgcgggggc

SEQ ID NO: 41918 - DNA, 677 bp, Zea mays
  misc_feature: Ceres CLONE 1438516-F
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaaaaaaagcacgagccacgcacggcccccgctgcctcccttccgccgccgccgccgccgccggcgcgccaccgtcgctgctctcccgccttcaccgcgcccaactccaatccttgcctcccccgcgcgcttcagcctcttcactccccatcgttttcgcctggccagatccaggtttccttgaccgagacctcgcctgctttacgcctccggtcggattcttcgccgtccttgtccccactgggcaccgctggggtggagcggagatcggatccgccgggagctgattccttctctcgcagtctagtttgacgctgattcatttgctggtcggcatagcatgatcctgcggtgattgcggatagcttgtgcaagctggtggcttgggtgttgtctttttaatctggcctaagatatcctgagacggtagcgtcacatggatgctagtacagaggtactgatgctattggtgncgtggggcttgacaatgggccgcgggaaatttccgcccagtgatagtgtaaagggcacccaaagaacacgagtgctggctgatggtgccattcagcgaaagcgaga

SEQ ID NO: 41919 - DNA, 720 bp, Zea mays
  misc_feature: Ceres CLONE 1438532-F
tccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcactgcactaccctgccctgccatcatatcgtacgtgagcccggccgagctagagcgagggagaggcatggctgctccgaagctcgcgacgctggcgctggctgtgctcctggcagcgaccgtggtgcgctcctccggccgcggagcgcgcggcgatgtcctgctccaccgtgtacacacgctgatgacctgcctgccgtcgtctagatgggcggggccatgccgcccccagcgtgctggcgaggcatcgtagcctgcttcaggaggcaataatcccctcaaacgacgaacatatggaggtgcctcaagaacgtcccaaacggcccaatgggagcgttcttaatttccccggccccccccccttcccagaaagggcgggttccccttgcctacaaaaacccctccggggttaccggggcccccaataatttaccttaaaaaggcccccagaacctcccgcgcgaaaaaaacacttcttgggcttcgggaaaaaaaaaaaaaaaaccccccgggggatttataccctataaagggggccccccctccttttttttttttttgtggggatcacacccggcccc

SEQ ID NO: 41920 - DNA, 706 bp, Zea mays
  misc_feature: Ceres CLONE 1438536-F
  misc_feature: Encodes the peptide sequence at SEQ ID NO. 41921
  misc_feature (686)..(686): n is a, c, t, g, unknown, or other
  misc_feature (687)..(687): n is a, c, t, g, unknown, or other
  misc_feature (706)..(706): n is a, c, t, g, unknown, or other
acccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcggaaaacttcacgtcgagaactctnngtctgtcgctggtccgttn

SEQ ID NO: 41921 - protein, 159 aa, Zea mays
  misc_feature: Ceres CLONE 1438536-F
  misc_feature (58)..(158): Pfam Name: PAP_fibrillin Pfam Description: PAP_fibrillin
  misc_feature (154)..(154): Xaa is any aa, unknown, or other
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQTIDSENFTSRTLXLSLVR

SEQ ID NO: 41922 - DNA, 845 bp, Zea mays
  misc_feature: Ceres CLONE 1438539-F
  misc_feature: Encodes the peptide sequence at SEQ ID NO. 41923
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gggccccccccnnnnnnnnnnncnngncgagggggntttttnnnnnnnnnnngggggctccccgcggtggcggccgctctagaactagtggatcccccgggctgcaggaattcgcacgagaccattacctagaacatcctaatcaaaaaacaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactggtggcgcagctgcaagcagttcggtccagaaggagggggcccaagatgccctccgtcccgaggactggctggaaaaaccatcaaggggcttaagacggcgcacggcgtccctggcattctgggaactaacttcgggctcccccgggaagcccaggaaataaaccctagaaccctggaacaaaggggggttctttccgttaccaaaaacaggggggggggggtccaccggtccccccaagggggcctgcgcggatccaaaagcctgggaactgagaaaaggcgggcttgaaattcttgaattgggaaccaagttttgggttaaaaaataacgccccggggggggctttcaaaatatcttaaatagggaaataaaaaaaaaggttggggccaacctggtgtggggttccccgggggggttgggaaaaaaaacaaaaaacgtggaccggggtctctagtccccccacaaaaaaaaaag

SEQ ID NO: 41923 - protein, 73 aa, Zea mays
  misc_feature: Ceres CLONE 1438539-F
MSQLSPAGHMAATLLLILLASAAAAAVSADQQVSACQNDIDALVAQLQAVRSRRRGPKMPSVPRTGWKNHQGA

SEQ ID NO: 41924 - DNA, 699 bp, Zea mays
  misc_feature: Ceres CLONE 1438543-F
  misc_feature: Encodes the peptide sequence at SEQ ID NO. 41925
aagctggagctccccgcggtggcggccgctctagaactagtggatcccccgggctgcaggaattcgcacgagaccattacctagaacatcctaatcgaaaactgaggtatgctacctaccaaaaccctcacggatccctggcatttcgatcgcctcactctgtaccccggacgagttgcagttggatctcagatcggtgatcacataaacaatggtgaaggctgttgctgtgcttggtagcagcgatggtgtcaagggcaccatcttcttcacccaagagggagatggccctaccactgtcaccggaagtgtctctggcctcaagcctggcctccatgggttccatgtgcatgcacttggtgacaccaccaatggctgcatgtcaactggaccacactacaatcctgcgagcaaggaacatggagcaccagaagatgagaaccgccatgccggtgatcttggaaatgtgacagctggagcagatggtgttgcaaacattaatgttaccgacagccagatcccactgactgggccaaactcaatcattggcagagctgttgttgttcacgctgatcccgatgatcttggaaagggtggacacgagctcaggaagagcaccggaaacgctggcggccgtgttgcttgtgggatcatcggactccagggctgaactgaaaacaatggtcgttggacttcggg

SEQ ID NO: 41925 - protein, 152 aa, Zea mays
  misc_feature: Ceres CLONE 1438543-F
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSDGVKGTIFFTQEGDGPTTVTGSVSGLKPGLHGFHVHALGDTTNGCMSTGPHYNPASKEHGAPEDENRHAGDLGNVTAGADGVANINVTDSQIPLTGPNSIIGRAVVVHADPDDLGKGGHELRKSTGNAGGRVACGIIGLQG

SEQ ID NO: 41926 - DNA, 736 bp, Zea mays
  misc_feature: Ceres CLONE 1438545-F
  misc_feature: Encodes the peptide sequence at SEQ ID NO. 41927
tccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgcccagcatgatgtcgcaaatgatgatgccaccatgtcactgcaaacccgtctcccaaattaggcttgcacagcagtttccatccatggtccacccaatgggccataacaattcacccattgttctaaccaacccctttgttggggctgcattctaaaaaaaaaaatttggtgtgtaccaaaaaggagttgaaacgccctccgggggcacccctttttaaaaaaaaacattgttcccccttttttccctttaaaaaaaaaaaaaaaaagttttactataccccgccacc

SEQ ID NO: 41927 - protein, 150 aa, Zea mays
  misc_feature: Ceres CLONE 1438545-F
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPPCHCKPVSQIRLAQQFPSMVHPMGHNNSPIVLTNPFVGAAF

SEQ ID NO: 41928 - DNA, 706 bp, Zea mays
  misc_feature: Ceres CLONE 1438549-F
  misc_feature: Encodes the peptide sequence at SEQ ID NO. 41929
  misc_feature (569)..(569): n is a, c, t, g, unknown, or other
  misc_feature (683)..(683): n is a, c, t, g, unknown, or other
gctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgcctccaacttcgacctcttncaggctgctgcggccgactggcgcgacacgctcttctgcgaggtggctcccgaaccgcccgcgcgggaggagctgccggagccactcaggaacgtgatgctggagtacggcgcngcggtgacaaagctggcgcggtt

SEQ ID NO: 41929 - protein, 195 aa, Zea mays
  misc_feature: Ceres CLONE 1438549-F
  misc_feature: SWISSPROT Homolog: EC 1.14.11.20 Desacetoxyvindoline 4-hydroxylase
  misc_feature (150)..(150): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASNFDLXQAAAADWRDTLFCEVAPEPPAREELPEPLRNVMLEYGAAVTKLAR

SEQ ID NO: 41930 - DNA, 672 bp, Zea mays
  misc_feature: Ceres CLONE 1438551-F
  misc_feature: Encodes the peptide sequence at SEQ ID NO. 41931
tggagctccccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagctgaagatcctgccgtgggt

SEQ ID NO: 41931 - protein, 165 aa, Zea mays
  misc_feature: Ceres CLONE 1438551-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKGENQS

SEQ ID NO: 41932 - DNA, 646 bp, Zea mays
  misc_feature: Ceres CLONE 1438556-F
  misc_feature: Encodes the peptide sequence at SEQ ID NO. 41933
  misc_feature (520)..(520): n is a, c, t, g, unknown, or other
  misc_feature (532)..(532): n is a, c, t, g, unknown, or other
  misc_feature (612)..(612): n is a, c, t, g, unknown, or other
aagctggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaatagggggacaagtacaaggacgtcggcgaggaggcgaaggacgccacgggggacgccaaggagcacgccaagaggatggcccgggagacaaanaagcaggcgcangacaagtcctgccgcgtggccgaacaggcgtcgggcatggccgaaccgggcccaggacctagcaaggggcctggcggaangatcccccggaaaccgcgttcccgggcgaacgaa

SEQ ID NO: 41933 - protein, 48 aa, Zea mays
  misc_feature: Ceres CLONE 1438556-F
  misc_feature (6)..(6): Xaa is any aa, unknown, or other
  misc_feature (10)..(10): Xaa is any aa, unknown, or other
  misc_feature (37)..(37): Xaa is any aa, unknown, or other
MARETXKQAXDKSCRVAEQASGMAEPGPGPSKGPGGXIPRKPRSRANE

SEQ ID NO: 41934 - DNA, 701 bp, Zea mays
  misc_feature: Ceres CLONE 1438557-F
  misc_feature: Encodes the peptide sequence at SEQ ID NO. 41935
  misc_feature (515)..(515): n is a, c, t, g, unknown, or other
  misc_feature (517)..(517): n is a, c, t, g, unknown, or other
  misc_feature (553)..(553): n is a, c, t, g, unknown, or other
ctccccgcggtggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgacctaaacaagattgagccatgggacctccctagcaaggcgaagatgggcgagaaagagtggtacttcttctaccagaaggaccgcaagtacccgacggggctgagggcgaacccggccacccgagccngntactggaaggcgacggggcaggggacaggagtctancacgccgcgaagggggtggcgtactggtcagcatgaagaagacgctcgtcttctacaggggcagggcttccaggggtgaacagaacaactgggtcatgcccgagtacaggctccaaggcagcggaggctccccggcgggcttcggtcc

SEQ ID NO: 41935 - protein, 125 aa, Zea mays
  misc_feature: Ceres CLONE 1438557-F
  misc_feature (23)..(125): Pfam Name: NAM Pfam Description: No apical meristem (NAM) protein
  misc_feature (102)..(102): Xaa is any aa, unknown, or other
  misc_feature (114)..(114): Xaa is any aa, unknown, or other
MAADQQPQLQEEMNDAAGGGLRLPPGFRFHPSDFEIVSFYLTNKVLNTRFTCTAITEADLNKIEPWDLPSKAKMGEKEWYFFYQKDRKYPTGLRANPATRAXYWKATGQGTGVXHAAKGVAYWSA

SEQ ID NO: 41936 - DNA, 694 bp, Zea mays
  misc_feature: Ceres CLONE 1438572-F
  misc_feature: Encodes the peptide sequence at SEQ ID NO. 41937
  misc_feature (548)..(548): n is a, c, t, g, unknown, or other
  misc_feature (549)..(549): n is a, c, t, g, unknown, or other
  misc_feature (582)..(582): n is a, c, t, g, unknown, or other
  misc_feature (583)..(583): n is a, c, t, g, unknown, or other
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcgaaaaattctgtggtccgccgcgccctccatacccccgcccctgtggcgcactcatctctctcgccgcggcaaaatcgtttagccgtcccaatccgaccacttttctccgatcgagcatgagcatggcgttctcctgcgcgggcgcgcgcctccacggtcgcaccggcgtcggcggcgccaaatgccgtcccggcgcggctctgctcgggcggcggggcacctgcttccgtccgaccgcctggaggtggagcaccgccaggggaatccgcgctgacctcccgccaccgccgcgggcgagcgcggatggcgccgccacctccggcccggacgtcgtcgtccccgaagcgggggacgctactgaggaggtggccgcggttgttcaaccctgtgtgctcccggagaagcttgatgtcgatgatggtggaaatgggcagctccctcccgccgccnngcgcggtggggacggcaagaatggggcgcgtanncgcngcgggggtgacggtgaccaggaggaggagagttcggaccatactcagcttcgaccagtggtccaggaggccgagaaggaagggttagtcttgccagtttgcccacgg

SEQ ID NO: 41937 - protein, 160 aa, Zea mays
  misc_feature: Ceres CLONE 1438572-F
  misc_feature (112)..(112): Xaa is any aa, unknown, or other
  misc_feature (123)..(123): Xaa is any aa, unknown, or other
  misc_feature (125)..(125): Xaa is any aa, unknown, or other
MSMAFSCAGARLHGRTGVGGAKCRPGAALLGRRGTCFRPTAWRWSTARGIRADLPPPPRASADGAATSGPDVVVPEAGDATEEVAAVVQPCVLPEKLDVDDGGNGQLPPAAXRGGDGKNGARXRXGGDGDQEEESSDHTQLRPVVQEAEKEGLVLPVCPR

SEQ ID NO: 41938 - DNA, 674 bp, Zea mays
  misc_feature: Ceres CLONE 1438582-F
  misc_feature: Encodes the peptide sequence at SEQ ID NO. 41939
aaagctggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcg

SEQ ID NO: 41939 - protein, 145 aa, Zea mays; identical to SEQ ID NO: 39805
  misc_feature: Ceres CLONE 1438582-F
  misc_feature (58)..(145): Pfam Name: PAP_fibrillin Pfam Description: PAP_fibrillin

SEQ ID NO: 41940 - DNA, 712 bp, Zea mays
  misc_feature: Ceres CLONE 1438583-F
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaacttacctggagagaaatttgctattttgccactctcaattttggctgcctgttattataccatcccgtgtctatgactagtgggaccgtctgtgtctatgatttatgggttcgatggtatattggcgaagcccacaaatgataatggcaaaattgtcaatggcctaggccagtgactctcattgcacttggacggtaggccagtgactctcattgcacttggagggtacgctgacttaccatctccccaagggtacgctgacttaccatctccccaagtgggagagtggacgtcataatttgtgttagaggggtcataatttgtccagtgactctcattgcacttggagggtacgctgacttaccatctccccaagtgggagagtggacgtcataatttgttaccatctccccaagtgggagagtggacgtcataatttgtgttagacttaccatctctccaagtgggagagtggacgtcataatttgtgttagaggggtcataatttgtgttagaggccgtgcggcctctgccaatcgatatattaatttttttgtctggttatataaagtactttatactgaacttttagtccttacatcgntaggt

SEQ ID NO: 41941 - DNA, 754 bp, Zea mays
  misc_feature: Ceres CLONE 1438584-F
  misc_feature: Encodes the peptide sequence at SEQ ID NO. 41942
  misc_feature (364)..(364): n is a, c, t, g, unknown, or other
  misc_feature (387)..(387): n is a, c, t, g, unknown, or other
  misc_feature (403)..(403): n is a, c, t, g, unknown, or other
  misc_feature (429)..(429): n is a, c, t, g, unknown, or other
  misc_feature (528)..(528): n is a, c, t, g, unknown, or other
aagctggagctccccgcggtggcggccgctctagaactagtggatcccccgggctgcaggaattcgcacgagaccattacctagaacatcctaatcgaaaaccaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctgggcagcagctcgaggacgggcgcacacttgccgactancacatccagaaggagagcacccntcaccctttgtctccngcctcaggggaggcatgcagatcttncggtcaggcccttcactggaaaaactattacccctcgaggtggagtctttctgaccccatcgacaaacgtaaaggccaaaatcccggaaaaggaggggnttcccctcggaccagaaaggtgttattttttgtggggaaacctccgagggaaggggcccccttgccccaattaaattttaaagagggagcccccccccctgtggttttgcccccggggggggggtgggaaatttttgtgaaagaccttgggggggaaaatatcccccctggggggaggcgcttcccccccctgggaaagggggggggcaaaccccccaaggagggg

SEQ ID NO: 41942 - protein, 189 aa, Zea mays
  misc_feature: Ceres CLONE 1438584-F
  misc_feature (6)..(74): Pfam Name: ubiquitin Pfam Description: Ubiquitin family
  misc_feature (59)..(59): Xaa is any aa, unknown, or other
  misc_feature (67)..(67): Xaa is any aa, unknown, or other
  misc_feature (81)..(81): Xaa is any aa, unknown, or other
  misc_feature (114)..(114): Xaa is any aa, unknown, or other
MQIFVKTLTGKTITLEVESSDTIDNVKAKIQDKEGIPPDQQRLIFAGQQLEDGRTLADXHIQKESTXHPLSPASGEACRSXGQALHWKNYYPSRWSLSDPIDKRKGQNPGKGGXSPRTRKVLFFVGKPPREGAPLPQLNFKEGAPPPVVLPPGGGWEIFVKDLGGENIPPGGRRFPPLGKGGGKPPKEG

SEQ ID NO: 41943 - DNA, 610 bp, Zea mays
  misc_feature: Ceres CLONE 1438599-F
  misc_feature: Encodes the peptide sequence at SEQ ID NO. 41944
  misc_feature (447)..(447): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaacatcacctcagtcctcacactgacatttcactctcggctgctggagtgtcggccgctgccatctgcctgccgctcactcccacgcgccgcaatgtgccactccccactcggcgccgccaccaccaccgcgggggcgctagcgctcctcttcctcctgccgctagcctcggccgccgccgccggcggcggcaccgcggcgaaggcgacgcccaacatcacggcgctcatgtccaagggcgggtgcaaggcgttcgcgtcgctgctggacaagtcccccgacgctctgtcggcgttcgagtcggcggtgagcggcggcgtgacggcgttctgcccgacggacgaagnncgtgcgcgggtttcatggcccagctacccggaaccttgaacgccggaagggaaaagggctcccctttcccttgtttttccccccccggggggcgcgcccgggagaaaacacaccacggggggggggggggggtatatttataaaaaaaacacgcggggcgca

SEQ ID NO: 41944 - protein, 97 aa, Zea mays
  misc_feature: Ceres CLONE 1438599-F
  misc_feature (85)..(85): Xaa is any aa, unknown, or other
MCHSPLGAATTTAGALALLFLLPLASAAAAGGGTAAKATPNITALMSKGGCKAFASLLDKSPDALSAFESAVSGGVTAFCPTDEXRARVSWPSYPEP

SEQ ID NO: 41945 - DNA, 851 bp, Zea mays
  misc_feature: Ceres CLONE 1438600-F
  misc_feature: Encodes the peptide sequence at SEQ ID NO. 41946
  misc_feature (50)..(50): n is a, c, t, g, unknown, or other
  misc_feature (372)..(372): n is a, c, t, g, unknown, or other
  misc_feature (396)..(396): n is a, c, t, g, unknown, or other
  misc_feature (505)..(505): n is a, c, t, g, unknown, or other
  misc_feature (506)..(506): n is a, c, t, g, unknown, or other
  misc_feature (564)..(564): n is a, c, t, g, unknown, or other
  misc_feature (603)..(603): n is a, c, t, g, unknown, or other
  misc_feature (743)..(743): n is a, c, t, g, unknown, or other
  misc_feature (747)..(747): n is a, c, t, g, unknown, or other
  misc_feature (776)..(776): n is a, c, t, g, unknown, or other
  misc_feature (825)..(825): n is a, c, t, g, unknown, or other
  misc_feature (826)..(826): n is a, c, t, g, unknown, or other
  misc_feature (837)..(837): n is a, c, t, g, unknown, or other
tttttttctttcccccccccgtggggtggggttggggtgcactctttaantgaagggggaaaagaggatactccctcgcggggcgcgggccgcgtcgagaactaggtgtaccccccagggctgcgcgaattctcaagagagcattacctagagctccctaatcgaaaaacatctcggaagtgggtgtgcgaccgtctctcccctcatggcatcatcggcggagcgatccctcgcgctcctcggggctgcctcggcatggctcggcgtcggggagcggtcgtgggctcgcttggctggctcttcctcttcgggtgggtcggccctccccaagctccggggggtccgctcgttcgccgcctccttatggggtgntgtgaggtagaagccaggtccttngaatctttaacgccgacgcctgtatggaggctcatccagggggggggttttggtttgaggatgagtagtgtttttaatggattaacaaagatggtggtcttctggttanngagtccgaagtatgaactgctggtcccccccccaccaacattagcatgctgggtaggntgctcttggagcagcacgctccacaaggggtgatttccntttttctaactccccaacagagcaggtttcgcctacttggcagcaaagaagggcttgctacactgaaaagtggggcattgtgctagggtttggcgcggggacgcgggcgatctagacaggggcgggccgttcgcttgttnaaancggacccggcctcaggatgtcctgagttntacgccgacaaacgcggcgctagggggccatcagacagaattatttttnntccacccccgnattaccgctgcttg

SEQ ID NO: 41946 - protein, 113 aa, Zea mays
  misc_feature: Ceres CLONE 1438600-F
  misc_feature (39)..(39): Xaa is any aa, unknown, or other
  misc_feature (47)..(47): Xaa is any aa, unknown, or other
  misc_feature (84)..(84): Xaa is any aa, unknown, or other
MARRRGAVVGSLGWLFLFGWVGPPQAPGGPLVRRLLMGXCEVEARSXESLTPTPVWRLIQGGGFGLRMSSVFNGLTKMVVFWLXSPKYELLVPPPPTLACWVGCSWSSTLHKG

SEQ ID NO: 41947 - DNA, 673 bp, Zea mays
  misc_feature: Ceres CLONE 1438603-F
  misc_feature: Encodes the peptide sequence at SEQ ID NO. 41948
aaagctggagctccccgcggtggcggccgctctagaactagtggatcccccgggctgcaggaattcgcacgagaccattacctagaacatcctaatcgaaaaaatacatgaccaccgcacctgggaatcgctgacgcttcgagcttcgacggccacctcggccctgcagcgaggtcggctgctccccggatggcagcgctcgacatacatcggcgccatggcctccgccatcgagccggacctctccgtgcgcggggacggtttccagatccccaacgcgttcgtgatcgaggcggagccaccgggtaccaactacaccgtcatgatgcgcgccttcgacgagggctggggcgccgacatcaccaagacagctgcattggatgcagacacagttatctacctcacacctcgagatccacagcttcgagcaggagccaatggggctgccatggggcgccgtcgttagctggcagatcattgaactcatgcgtgacaggagctttggagaccggtgctgactcacatcaggcagttgaacaaagacaatcttgagcgcgatacttggtcgattcgattgtaggaggagtgcaaacaaagctggcctgggatgcaggtcaaagaacggtgttgaacagtctggcaccggatgcttattgaaagttaatatgctcct

SEQ ID NO: 41948 - protein, 82 aa, Zea mays
  misc_feature: Ceres CLONE 1438603-F
  misc_feature: SWISSPROT Homolog: EC 1.3.1.2 Dihydropyrimidine dehydrogenase (NADP(+))
MASAIEPDLSVRGDGFQIPNAFVIEAEPPGTNYTVMMRAFDEGWGADITKTAALDADTVIYLTPRDPQLRAGANGAAMGRRR

SEQ ID NO: 41949 - DNA, 647 bp, Zea mays
  misc_feature: Ceres CLONE 1438611-F
  misc_feature: Encodes the peptide sequence at SEQ ID NO. 41950
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccacccatgccactacccctattcaaccggccccggggctttaaggctcttattccccaaaacccaaacctgggccggggcaaaaagccgaattcaaaacccgtgccaattgaaaggaaacccgggggtttggggaaccccccaatcttggggccggggggcaaaatttttaaggaattttgggggcccccaggggggaccccctttggggcccccatagggaaaaattttgggc

SEQ ID NO: 41950 - protein, 76 aa, Zea mays
  misc_feature: Ceres CLONE 1438611-F
MPLPLFNRPRGFKALIPQNPNLGRGKKPNSKPVPIERKPGGLGNPPILGPGGKIFKEFWGPPGGTPFGAPIGKNFG

SEQ ID NO: 41951 - DNA, 673 bp, Zea mays
  misc_feature: Ceres CLONE 1438630-F
  misc_feature: Encodes the peptide sequence at SEQ ID NO. 41952
agagctggagctccccgcggtggcggccgctctagaactagtggatcccccgggctgcaggaattcgcacgagaccattacctagaacatcctaatcgaaaaatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacgtactatccgtcagaggctctcaagcataatggctctttgtatgctcatgtttacttcgcccgttcgggttatcctgtggaccctacagatccagaatatgagcagaaatcttcgtttgggaggacccatcctgtt

SEQ ID NO: 41952 - protein, 159 aa, Zea mays; identical to SEQ ID NO: 36748
  misc_feature: Ceres CLONE 1438630-F

SEQ ID NO: 41953 - DNA, 596 bp, Zea mays
  misc_feature: Ceres CLONE 1438635-F
  misc_feature: Translation starting site: 213
  misc_feature: SWISSPROT Homolog: EC 5.5.1.4 Inositol-3-phosphate synthase
  misc_feature (446)..(446): n is a, c, t, g, unknown, or other
  misc_feature (480)..(480): n is a, c, t, g, unknown, or other
  misc_feature (491)..(491): n is a, c, t, g, unknown, or other
ctccccgcggtggcggccgctctagaactagtggatcccccgggctgcaggaattcgcacgagaccattacctagaacatcctaatcgaaaaacacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtgatgcttgtggggtggggaggcaacaacggggtcacgctgacngctggggtcattgccaacagggaggggatctcantgggcgaccanggacagggtgcagcaagccaactactacgggctccctcccccaggcctcccacatcagaatcggcagctacacgggggaggaaatctattgcccccgtccaagac

SEQ ID NO: 41954 - DNA, 629 bp, Zea mays
  misc_feature: Ceres CLONE 1438643-F
  misc_feature: Encodes the peptide sequence at SEQ ID NO. 41955
  misc_feature (82)..(82): n is a, c, t, g, unknown, or other
  misc_feature (387)..(387): n is a, c, t, g, unknown, or other
  misc_feature (457)..(457): n is a, c, t, g, unknown, or other
aagctggagtccccgcggtggcggccgctctagaactagtggatcccccgggctgcaggaattcgcacgagaccattacctnagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtggggagaacggaaangcaagcaggaggagggagggagggagcccgtgaaccaggctaggcgcagcagcatgggcgccgggatcanggtcctggcagcgctcttggcggcgctcgcggcaggcaccgccggcgtgacggcgcagctgccgcaggactactacgcggcggtgtgcccagaactggagagcatcgtgcgcgccgcggttccaagaaagtgcaggcgcaacccgtccgcctgggcggcaccatccggctct

SEQ ID NO: 41955 - protein, 63 aa, Zea mays
  misc_feature: Ceres CLONE 1438643-F
  misc_feature (6)..(6): Xaa is any aa, unknown, or other
MGAGIXVLAALLAALAAGTAGVTAQLPQDYYAAVCPELESIVRAAVPRKCRRNPSAWAAPSGS

SEQ ID NO: 41956 - DNA, 682 bp, Zea mays
  misc_feature: Ceres CLONE 1438648-F
  misc_feature: Encodes the peptide sequence at SEQ ID NO. 41957
  misc_feature (377)..(377): n is a, c, t, g, unknown, or other
  misc_feature (471)..(471): n is a, c, t, g, unknown, or other
  misc_feature (572)..(572): n is a, c, t, g, unknown, or other
  misc_feature (576)..(576): n is a, c, t, g, unknown, or other
  misc_feature (582)..(582): n is a, c, t, g, unknown, or other
  misc_feature (583)..(583): n is a, c, t, g, unknown, or other
  misc_feature (607)..(607): n is a, c, t, g, unknown, or other
  misc_feature (609)..(609): n is a, c, t, g, unknown, or other
ggagctccccgcggtggcggccgctctagatactagtggatcccccgggctgcaggaattcgcacgagaccattacctagaacatcctaatcaaaaaagcttgttgctgctgctgaaggaaaagacaattttctccttacctcctgggctcaggcctcaggcgcacagccttctgcttctcttcctctcctcgcgtccccccaccaaaccctaacccgagcacccagcccctcctcgcgtctgctcgacgccggcctttggggctctcactctgagcggcatggacccgcagggctccggttgtgtccaggaaacatcccagttgttggcgagagacccagaaatgccgcacaaagagggagcaaaggttggaaccnaagagatggaagagcgggagcaagaaggggagccaaaagaggtgaagggaaatttcgtctcttcgatggctttaacttccgtcccctgcgctgnaaaggccgccccactacctttacccccctcaaagaatcagtcgtccccccaatgggcccaaagaaaaattatttttcccaaagatctcctttgtatgcggnaaanttatannccccacgcaaaatttttaaaaaangncccccaaaggggcccaacaacggagaaccccccttttttgtgagactttccccaaaaaggtgtaaatccccaa

SEQ ID NO: 41957 - protein, 123 aa, Zea mays
  misc_feature: Ceres CLONE 1438648-F
  misc_feature (33)..(33): Xaa is any aa, unknown, or other
  misc_feature (64)..(64): Xaa is any aa, unknown, or other
  misc_feature (98)..(98): Xaa is any aa, unknown, or other
  misc_feature (99)..(99): Xaa is any aa, unknown, or other
  misc_feature (101)..(101): Xaa is any aa, unknown, or other
  misc_feature (109)..(109): Xaa is any aa, unknown, or other
  misc_feature (110)..(110): Xaa is any aa, unknown, or other
MDPQGSGCVQETSQLLARDPEMPHKEGAKVGTXEMEEREQEGEPKEVKGNFVSSMALTSVPCAXKAAPLPLPPSKNQSSPQWAQRKIIFPKDLLCMRXXYXPHAKFLKXXPQRGPTTENPPFL

SEQ ID NO: 41958 - DNA, 649 bp, Zea mays
  misc_feature: Ceres CLONE 1438658-F
  misc_feature: Encodes the peptide sequence at SEQ ID NO. 41959
  misc_feature (612)..(612): n is a, c, t, g, unknown, or other
  misc_feature (649)..(649): n is a, c, t, g, unknown, or other
ggagctccccgcggtggcggccgctctataactagtggatcccccgggctgcaggaattcgcacgagaccattacctagaacatcctaatcgaaaaagcaaatctcgtgggcgtgtagcgtccgccacctgcgtccgcgcctttccatttccaccccgatcgcgttttccggccccgccgcctgtccctgcgctagtcgacactcgacaggctcggtttccgccctcccctcccaccgccgcgcaccgagaagatggggaagcggtggatcccgctggaggccaacccggacgtcctgaaccagttcatatgggggctgggagtccacgaggaggatgtgcagttctgcgacgtctacggccttgacgatgagctgctcgctatggtgccccagcccgttctcgccgtcctcttcctctacccgctcacctccctggacgaggagaaagaagaatcaagtgtttctgctgccacatcgacctcagcgggcaagggattgagcaagaaagtatactttacgaagcagactgttggtaatgcttgtggaacagttggtgttattcatgcaatttgaaaatgcacatctcaaatcaagctagttgaggggtcctnatttggagaagtctataagcaaacggctgatatggan

SEQ ID NO: 41959 - protein, 106 aa, Zea mays
  misc_feature: Ceres CLONE 1438658-F
  misc_feature (4)..(106): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
MGKRWIPLEANPDVLNQFIWGLGVHEEDVQFCDVYGLDDELLAMVPQPVLAVLFLYPLTSLDEEKEESSVSAATSTSAGKGLSKKVYFTKQTVGNACGTVGVIHAI

SEQ ID NO: 41960 - DNA, 679 bp, Zea mays
  misc_feature: Ceres CLONE 1438685-F
  misc_feature: Translation starting site: 210
  misc_feature: SWISSPROT Homolog: EC 1.1.1.1 Alcohol dehydrogenase
  misc_feature (437)..(437): n is a, c, t, g, unknown, or other
  misc_feature (438)..(438): n is a, c, t, g, unknown, or other
aaagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctctttcactcgctctgccacaccgacgtctacttctggggagccaagggggcaggacgtccgtgttccctcggatctttgggcacgaggctggaggtatcatannagagtgtggagaaggtgtgactgacgtaactcccggccgacattgttcttcctgtggtccatgggggagtgccaggaatgtgggccacttcaagtccgccgagaaccacattgtgtatctggtcaggatacacacccaaccggtgtgaataattcccattgccaatctcgggtttcactccatgggaaagctatctaccccttttgttgggacctttcccttttaaggagtacacccgtct

SEQ ID NO: 41961 - DNA, 689 bp, Zea mays
  misc_feature: Ceres CLONE 1438687-F
  misc_feature: Translation starting site: 475
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (60)..(60): n is a, c, t, g, unknown, or other
  misc_feature (62)..(62): n is a, c, t, g, unknown, or other
  misc_feature (380)..(380): n is a, c, t, g, unknown, or other
  misc_feature (381)..(381): n is a, c, t, g, unknown, or other
  misc_feature (384)..(384): n is a, c, t, g, unknown, or other
caaagctggagctccccgtaggnggnnggggggcgggtttacgtttatcttttggggagnangagttccaacaacccccttagcgagaacatcctaatcgaaaaatcaccaccactgggtcttcagaccattagctttatctactccagagcgcagaagaacccgatcgacaggggggagggggttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccatctgccaccgnnggnccatgggggggcgccagttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtccagtttctgaggcatcattgcaacccgaccgccacaccctactgctcccctcagtgcccgtccttgccgcaccacttttgccagcaactcaagcaggtggagccccagcaccggtaccaggggatct

SEQ ID NO: 41962 - DNA, 707 bp, Zea mays
  misc_feature: Ceres CLONE 1438688-F
  misc_feature: Encodes the peptide sequence at SEQ ID NO. 41963
  misc_feature (443)..(443): n is a, c, t, g, unknown, or other
  misc_feature (599)..(599): n is a, c, t, g, unknown, or other
agagctggagctccccgcggtggcggccgctctagatctagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacatcgccagccctatctttggtgcagtcattggtaccaaccatcaggncacagcagctgcagcaactcgtgctacctgtgatcaacaagtagctctggcaaacttttctcctactctcagcaacaacaatttctttccatcaaccaactgtctacactggaccctgctgcttatttgccgcaacaactattacattcggccggntagttacggcctactcttagaaacaacaatttttcaattaaacaattggccccctgaaccccgctgcttattgcgcccccaaattctctcccttttgcccgctgctgc

SEQ ID NO: 41963 - protein, 101 aa, Zea mays
  misc_feature: Ceres CLONE 1438688-F
MATKIFSLLMLLALSACVANATIFPQCSQAPIASLLPPYLPSMIASVCENPALQPYRLQQAIAASNIPLSPLLFQHRQPYLWCSHWYQPSGHSSCSNSCYL

SEQ ID NO: 41964 - DNA, 657 bp, Zea mays
  misc_feature: Ceres CLONE 1438704-F
  misc_feature: Encodes the peptide sequence at SEQ ID NO. 41965
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcgaaaaaaaaaccaaatcagcaaatcccccatccctatccagcggcttctggctcctccgccaggtcttgccgtccagcggcctcaccgccctcgagatttgctcggcacggtcgccttgtttgccgcctgcagcgttctcccactcggctacggactacgcctgacgccaccgttaacggcgacatccgaacgggccccgacacccatctcgcgctcagaaaagggataagcagttgtgatcctgtcctcttggtcggatgcggggttactatgacatcgatgacatcctcatggaggatgagcctatttcagttgttttccaagtaactgcaaatggtgttggcctgctagatcctggtgctgaaaataactgtgtagagaaggntgccaaggtggaccttccattttggcttgcgcatgggctgctgtctctggaaacagctgtctcaataaacccgcctccatgcttcacacaaaaaactccgaaggggaaaacaactgatgcgtcttgggtggatttgagggctccttgcccaaacttctatgagctaggaggcaa

SEQ ID NO: 41965 - protein, 100 aa, Zea mays
  misc_feature: Ceres CLONE 1438704-F
  misc_feature (43)..(43): Xaa is any aa, unknown, or other
MRGYYDIDDILMEDEPISVVFQVTANGVGLLDPGAENNCVEKXAKVDLPFWLAHGLLSLETAVSINPPPCFTQKTPKGKTTDASWVDLRAPCPNFYELGG

SEQ ID NO: 41966 - DNA, 645 bp, Zea mays
  misc_feature: Ceres CLONE 1438718-F
  misc_feature: Encodes the peptide sequence at SEQ ID NO. 41967
  misc_feature (30)..(30): n is a, c, t, g, unknown, or other
  misc_feature (381)..(381): n is a, c, t, g, unknown, or other
ggggggttacggttgctcgggggggtgcangatcacacaccacacctgggctagaacatcctaatcaaaaaaaaacacacagcaattttccacgagaaccgtcaatgggttctataggaggacacacaaccacagctgcgggcgaccggcgccgccgcgtgctgttcttcccgctcccgtaccagggccacatcaaccccatgttccaactcgccggcctcctccacttgcgcggtttctccgtcaccgtcttccacaccgacttcaacgctcccgacaagtcccgccaccctgcctacgacttcgtccccgttcccgtccgcggctgcttttctaagggcagctcggagaccgtacgggggaccgtggagcgcatcctcntcgtgaaccgcgcctgcgaggctccgttccgggagcgcctggccgctctgctggcgcgggaggacgtcgcgtgcctggtcgctgacgcccacctgctgacgctgctggacgtggcgcgggggctcggcgtgccgacgctggtgctgcgcaccggcagcgcggcgtgcctccgcatgttcgcggcgttccccgcgctctgcgacaaggggtatcagccggcgcaagagtcgcagctggaggcgctggtgactgagctgccgccgg

SEQ ID NO: 41967 - protein, 180 aa, Zea mays
  misc_feature: Ceres CLONE 1438718-F
  misc_feature: SWISSPROT Homolog: EC 2.4.1.121 Indole-3-acetate beta-glucosyltransferase
  misc_feature (93)..(93): Xaa is any aa, unknown, or other
MGSIGGHTTTAAGDRRRRVLFFPLPYQGHINPMFQLAGLLHLRGFSVTVFHTDFNAPDKSRHPAYDFVPVPVRGCFSKGSSETVRGTVERILXVNRACEAPFRERLAALLAREDVACLVADAHLLTLLDVARGLGVPTLVLRTGSAACLRMFAAFPALCDKGYQPAQESQLEALVTELPP

SEQ ID NO: 41968 - DNA, 708 bp, Zea mays
  misc_feature: Ceres CLONE 1438725-F
aaagctggagctccccgcggtggcggccgctctagaactagtggatcccccgggctgcaggaattcgcacgagaccattacctagaacatcctaatcgaaaaatcaaccatattattgagaccaacaagcaacatagaatgtggaatccaatagcaacaatagaacaacaatgacgaccaagatattttccctccttatgctccatgctctttctgcatgtgttgctaatgcgaccattttccctcaacgctcacaagctcctatagctgcccttcttcacccatacctcccatcaatgatagattcagtatgtgaaaacccagctcttcaaccctataggctccaacaagcaaatgcagcaagcaacttacctttatcaccctcgttgtttcaacaatcgccatccctatctttggtgcagtcattggtacaaacaatcggggcacaacagctgcaacaacttctggctactggtgatcaaccaagaagttttgggaaaactttcctccttatttccagaaaaacagtttttttcatttaaacaaaggctaatatggaaccctttgtttttttttgcccattaaaaatttttccttttacccgggggggttggggccccttcgaaaaaaaaatttttttcttttaaaaaatggcccccaaaacccctctttttttttgcgccaaaaaaccccttttttcgcgagggg

SEQ ID NO: 41969 - DNA, 710 bp, Zea mays
  misc_feature: Ceres CLONE 1438736-F
  misc_feature: Encodes the peptide sequence at SEQ ID NO. 41970
  misc_feature (328)..(328): n is a, c, t, g, unknown, or other
  misc_feature (359)..(359): n is a, c, t, g, unknown, or other
  misc_feature (619)..(619): n is a, c, t, g, unknown, or other
  misc_feature (622)..(622): n is a, c, t, g, unknown, or other
  misc_feature (623)..(623): n is a, c, t, g, unknown, or other
  misc_feature (657)..(657): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
tccccgcggtggcggccgctctattactagtggatcccccgggctgcaggatttcgcacgagaccattacctagaacatcctaatcgaaaaatctctatcattcgtctgttctgtccttgatgtgctaaacgcgtgcatgcaggcgcgatctgcgggccggcgagcctggtgaacgcgatgatggacctgcaggagggggcgctgatgctgctgggccccacgatgaacgccaaggtggcgttcgagctgtcggagcggctgccacacctgccgctgcggatgcaggagcactcgcgccccgcgctggcgttcgccgagcggatgcangggctggggcctgcgcgtgctgtacccccgnctttccggggcaccccgaacaagggggggctggggcgcccttgggcaaacccgggcttacggcttggcggggggatttttttttgcccccccccagggggccccccaggagagggccccccacccccccccttttgggccccccccccccaaaaaaaacaccccccccgtttttgggggcccctcttgtgggggcgggacacccccccctgcccgtttatcttcaaaaaaaaattcttttttttttttttcccctccggngtnnccccccacacaggggaaaaaataccccccacaanaagagcgcggnnnnnnnnnntntttttccccccgcgcggggtcttctctaggt

SEQ ID NO: 41970 - protein, 177 aa, Zea mays
  misc_feature: Ceres CLONE 1438736-F
  misc_feature (50)..(50): Xaa is any aa, unknown, or other
  misc_feature (61)..(61): Xaa is any aa, unknown, or other
  misc_feature (149)..(149): Xaa is any aa, unknown, or other
  misc_feature (160)..(160): Xaa is any aa, unknown, or other
  misc_feature (164)..(164): Xaa is any aa, unknown, or other
  misc_feature (165)..(165): Xaa is any aa, unknown, or other
  misc_feature (166)..(166): Xaa is any aa, unknown, or other
  misc_feature (167)..(167): Xaa is any aa, unknown, or other
MMDLQEGALMLLGPTMNAKVAFELSERLPHLPLRMQEHSRPALAFAERMXGLGPARAVPPXFRGTPNKGGLGRPWANPGLRLGGGIFFCPPPGGPPGEGPPPPPFWAPPPQKKHPPRFWGPLLWGRDTPPCPFIFKKKFFFFFFPSGVXPHTGEKIPPTXRARXXXXFFPPRGVFSR

SEQ ID NO: 41971 - DNA, 665 bp, Zea mays
  misc_feature: Ceres CLONE 1438743-F
  misc_feature: Encodes the peptide sequence at SEQ ID NO. 41972
  misc_feature (665)..(665): n is a, c, t, g, unknown, or other
agagctggagctccccgcggtggcggccgctctagaactagtggatcccccgggctgcaggaattcgcacgagaccattacctagaacatcctaatcgaaaaaacaacaacaacaacccgcacaacggcacgattctcctcctccgtccgcgtagctctcggtttcggcgatgtcggggcgcggcaagggcggcaaggggctgggcaagggcggcgccaagcgccaccgcaaggtgttgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcacgctctacggcttcggcggctaggccgccttccccttctgatgctttgaagtgaccggccgtggcccggtggggtggccaaagtgggcccggccccccgcaagttgggtcctgaaccccccctttgccggggggtccccacctttttttcaccccattccggggggggaagaaattctcttccccccccctattatttcaagtggn

SEQ ID NO: 41972 - protein, 103 aa, Zea mays; identical to SEQ ID NO: 6459
  misc_feature: Ceres CLONE 1438743-F
  misc_feature (25)..(94): Pfam Name: Histone Pfam Description: Core histone H2A/H2B/H3/H4

SEQ ID NO: 41973 - DNA, 710 bp, Zea mays
  misc_feature: Ceres CLONE 1438745-F
  misc_feature: Encodes the peptide sequence at SEQ ID NO. 41974
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (553)..(553): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaggaggaggtgagggagtatgagagcgacatgaggaagctgggagagctgctttctaagctgaaccccctcgcgnnnagagtcgtgccgcagtcccgccgccgcgtggacggcggcgctccccgcctttcggccgacgcgccccgtgtcgtgtcgccggcgatcgactactacgcgcgcccaccacagntcccgccggcgcagcttctgcaacagcagcagccgatgcacgtgctgcattttgtgggttgccttcgccgggtttgccttgtttgcgcccggggaaatgaatctanaacgaaggaatccccaatggtcacccaattcacgggaaaagaaaggtttcc

SEQ ID NO: 41974 - protein, 156 aa, Zea mays
  misc_feature: Ceres CLONE 1438745-F
  misc_feature (67)..(67): Xaa is any aa, unknown, or other
  misc_feature (105)..(105): Xaa is any aa, unknown, or other
  misc_feature (140)..(140): Xaa is any aa, unknown, or other
MVAVAVDGLIRGADAVPAAEREAVRAAAAEAAAKGGEGESGKEEVREYESDMRKLGELLSKLNPLAXRVVPQSRRRVDGGAPRLSADAPRVVSPAIDYYARPPQXPPAQLLQQQQPMHVLHFVGCLRRVCLVCARGNESXTKESPMVTQFTGKERF

SEQ ID NO: 41975 - DNA, 711 bp, Zea mays
  misc_feature: Ceres CLONE 1438747-F
  misc_feature (711)..(711): n is a, c, t, g, unknown, or other
agagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaaacactaccattcagccagctacctggtgcctacccccagcaatttcctccattcaaccaaatggcaggattgcaactctcctggctattttacagcagccaacaactacctcccatttcaagccagttaggctggggttgagcccctgcn

SEQ ID NO: 41976 - DNA, 698 bp, Zea mays
  misc_feature: Ceres CLONE 1438748-F
  misc_feature: Encodes the peptide sequence at SEQ ID NO. 41977
aaagctggagctccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctcagcaacaacaatttcttccattcaaccaactgtctacactgaaccctgctgcttatttgcagcaacaactattaccatttagccagctagctactgcctactctcaacaacaacaactttcttcatttaaccaattggccgcactgaaccccgctgcttatttgcagcagcaaataagccgcggc

SEQ ID NO: 41977 - protein, 177 aa, Zea mays
  misc_feature: Ceres CLONE 1438748-F
  misc_feature (1)..(177): Pfam Name: Zein Pfam Description: Zein seed storage protein
METKIFSLLMLLALSTCVANATIFPQCSQAPIASLFPPYLPSIIASVCENPALQPYRLQQAIAASNIPLSPLLCQQSPALSLVQSLVQTIRAQQLQQLVLPVINQVALANLSPYSQQQQFLPFNQLSTLNPAAYLQQQLLPFSQLATAYSQQQQLSSFNQLAALNPAAYLQQQISRG

SEQ ID NO: 41978 - DNA, 738 bp, Zea mays
  misc_feature: Ceres CLONE 1438750-F
  misc_feature: Encodes the peptide sequence at SEQ ID NO. 41979
  misc_feature (436)..(436): n is a, c, t, g, unknown, or other
  misc_feature (491)..(491): n is a, c, t, g, unknown, or other
  misc_feature (548)..(548): n is a, c, t, g, unknown, or other
aagctggagctccccgcggtggcggccgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcggaggcccgggtgtgcatgggcaagagccagcaccactcgttcccctgcatctccgaccgcctctgcagcaacgagtgcgtcaaggaggacggcgggtggaccgccggctactgccacctccgctactgcaggtgccagaaggcgtgctaagcaaagctcttcnaacaccccttgctttgcagaactgaactctagtagtactaagtaacacccttggnctagctgtgcacaacctacgtaccgtgcatgcatgtaatggtggtgtcatgttaccntgaccccaataaataggtattaattataaataccccgggcatgttgcccaagccacaaaaaaaaaaaaaaaaaaaagctttatcgaatcccgcccaaccctcaaggggggggcccgggaacccaatttccgcccttaaagggaaggcgaattacgccgcgccctcatgggcccgccttttttaaaccccc

SEQ ID NO: 41979 - protein, 82 aa, Zea mays; identical to SEQ ID NO: 41020
  misc_feature: Ceres CLONE 1438750-F
  misc_feature (36)..(82): Pfam Name: Gamma-thionin Pfam Description: Gamma-thionin family

SEQ ID NO: 41980 - DNA, 600 bp, Zea mays
  misc_feature: Ceres CLONE 1438753-F
  misc_feature: Encodes the peptide sequence at SEQ ID NO. 41981
  misc_feature (77)..(77): n is a, c, t, g, unknown, or other
  misc_feature (258)..(258): n is a, c, t, g, unknown, or other
  misc_feature (273)..(273): n is a, c, t, g, unknown, or other
  misc_feature (280)..(280): n is a, c, t, g, unknown, or other
  misc_feature (335)..(335): n is a, c, t, g, unknown, or other
  misc_feature (363)..(363): n is a, c, t, g, unknown, or other
  misc_feature (382)..(382): n is a, c, t, g, unknown, or other
  misc_feature (395)..(395): n is a, c, t, g, unknown, or other
tccccgcggtggcggccgctctagaactagtggatcccccgggctgcaggaattcgcacgagaccattacctagaancatcctaatcgaaaaggggtcgcgtccaacaagaggctggccagccatcccgcgcgagccacttcctctctcctccccatcggatccagcgccacgcggatccgcaaggcaatccatggcctctacccaggcggaagcggaggcggtggcaccggccccgcccgaggcggcggaggcgaangagaagggacagcanggcgggntgcttgggatgctgtgggcggcgctcttcggtggccgcgaggacttcgagaagcngctgcagtacctgtccaagggagagcanccgtgcacgcgctgatgcnccgagcgacgcanttctcgcgccgcgccgtgcggacctcatcgaactcttcgtcctcgccgagggggtaactgttggttatgccctcctggccaccagaatgagggactaactgggcgaatgaaggaaaaccaaggggaaccaagggccttccctccggggggatcccccgggcaaaattgcaaaactgtgtacttttccaaggggttttaaacaaaa

SEQ ID NO: 41981 - protein, 61 aa, Zea mays
  misc_feature: Ceres CLONE 1438753-F
  misc_feature (22)..(22): Xaa is any aa, unknown, or other
  misc_feature (27)..(27): Xaa is any aa, unknown, or other
  misc_feature (30)..(30): Xaa is any aa, unknown, or other
  misc_feature (48)..(48): Xaa is any aa, unknown, or other
  misc_feature (57)..(57): Xaa is any aa, unknown, or other
MASTQAEAEAVAPAPPEAAEAXEKGQXGGXLGMLWAALFGGREDFEKXLQYLSKGEXPCTR

SEQ ID NO: 41982 - DNA, 729 bp, Zea mays
  misc_feature: Ceres CLONE 1438759-F
  misc_feature: Encodes the peptide sequence at SEQ ID NO. 41983
tggagctccccgcggtggcggccgctctagaactagtggatcccccgggctgcaggaattcgcacgagaccattacctagaacatcctaatcgaaaaaattcacacaaccaatcactttataccatatagcaaatactctcatggctactaaattcgtcaccctcggtcaagtccaccgccccaaaatctcaatttcgaccagaaaacctcgtagatgcaaccaaaacaagccccaaccatccaaatccataagcgagaacatgttcaacaatgtttttcctgagaaaacgcttacggaaatctatcacaatggcctaaacaattcagaccctcttactaactcactactctttatggaacatcagccagttaaagaagaggagtcggcaaaacaagaacacgggaagctgtccatatgcaaccacaaagactacggtaagtcgatcatcccaacgaaagacagagatttgagacgtgaagttgctcaattgagcttggtgtggtacatgaaatgttccataagctttatattaaggaaggcaagagcgttttacaatgagttttcttgcgatacttctgttgggagtagcactatggttgtggtcgatccatatttttctgttccagttttaccctacagtaattagttttatattcaagcatacgtgattaaaagttgtatcgacgtcaaaaaaaaaaagataaaaagtgtatttagcatttcgttt

SEQ ID NO: 41983 - protein, 128 aa, Zea mays
  misc_feature: Ceres CLONE 1438759-F
MFNNVFPEKTLTEIYHNGLNNSDPLTNSLLFMEHQPVKEEESAKQEHGKLSICNHKDYGKSIIPTKDRDLRREVAQLSLVWYMKCSISFILRKARAFYNEFSCDTSVGSSTMVVVDPYFSVPVLPYSN

SEQ ID NO: 41984 - DNA, 668 bp, Zea mays
  misc_feature: Ceres CLONE 1438760-F
  misc_feature: Encodes the peptide sequence at SEQ ID NO. 41985
ggagctccccgcggtggcggccgctctagaactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaaatgttggcgctgaactggctcatcaagtccctgggagagtttcgacggaaatagatgctcggttagcttatgacacccagggcataatccacagggtacatgaactgttgaa

SEQ ID NO: 41985 - protein, 175 aa, Zea mays; identical to SEQ ID NO: 38037
  misc_feature: Ceres CLONE 1438760-F
  misc_feature: SWISSPROT Homolog: EC 2.2.1.2 Transaldolase

SEQ ID NO: 41986 - DNA, 713 bp, Zea mays
  misc_feature: Ceres CLONE 1438767-F
  misc_feature: Encodes the peptide sequence at SEQ ID NO. 41987
  misc_feature (563)..(563): n is a, c, t, g, unknown, or other
  misc_feature (608)..(608): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaactcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaagaagttatcaaatcaggtgtagttccnagatttgtgcagttgctcacaagagaggatttgccccagctgcangtcgaagcagcatgggctctcacaatattgcttctggcacttcaaaaaatcaanggggtgtatgatcatgggggctgtcctaaaattgggagcttcttgggtcgg

SEQ ID NO: 41987 - protein, 165 aa, Zea mays
  misc_feature: Ceres CLONE 1438767-F
  misc_feature (4)..(92): Pfam Name: IBB Pfam Description: Importin beta binding domain
  misc_feature (101)..(142): Pfam Name: Arm Pfam Description: Armadillo/beta-catenin-like repeat
  misc_feature (130)..(130): Xaa is any aa, unknown, or other
  misc_feature (148)..(148): Xaa is any aa, unknown, or other
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKSGVVPRFVQLLTREDLPQLXVEAAWALTILLLALQKIXGVYDHGGCPKIGSFLGR

SEQ ID NO: 41988 - DNA, 693 bp, Zea mays
  misc_feature: Ceres CLONE 1438768-F
  misc_feature: Encodes the peptide sequence at SEQ ID NO. 41989
  misc_feature (354)..(354): n is a, c, t, g, unknown, or other
  misc_feature (378)..(378): n is a, c, t, g, unknown, or other
  misc_feature (410)..(410): n is a, c, t, g, unknown, or other
  misc_feature (467)..(467): n is a, c, t, g, unknown, or other
  misc_feature (513)..(513): n is a, c, t, g, unknown, or other
  misc_feature (523)..(523): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcangaaacatgtggcgccgctcctggntgctcacctcatcatgtacatcatcgtcatcngcttcgcgagctggaacctgaaccacttcatcaacggcagaccaactaccccgggcntggccggaaacggcgcgaactttctacttcctggtggtcccccatntggcccggcntggtgggccccggcttccaaactgggggggggtgccccaggtgggcgccctgggcccccaaaaagcttggccccaaagcccgggttttttctttaatcccgggggcaacccgggggcttccccttgggggtgggccgagaggggaataccatttgggggaaacccggggc

SEQ ID NO: 41989 - protein, 93 aa, Zea mays
  misc_feature: Ceres CLONE 1438768-F
  misc_feature (6)..(6): Xaa is any aa, unknown, or other
  misc_feature (14)..(14): Xaa is any aa, unknown, or other
  misc_feature (25)..(25): Xaa is any aa, unknown, or other
  misc_feature (44)..(44): Xaa is any aa, unknown, or other
  misc_feature (59)..(59): Xaa is any aa, unknown, or other
MAGIGXKHVAPLLXAHLIMYIIVIXFASWNLNHFINGRPTTPGXAGNGANFLLPGGPPXGPAWWAPASKLGGGAPGGRPGPPKSLAPKPGFFL

SEQ ID NO: 41990 - DNA, 689 bp, Zea mays
  misc_feature: Ceres CLONE 1438773-F
  misc_feature: Encodes the peptide sequence at SEQ ID NO. 41991
aaagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagtacggctcccaagtcgtaagcaacgggcagccctgcactgcgcaggaggtcgacaa

SEQ ID NO: 41991 - protein, 50 aa, Zea mays
  misc_feature: Ceres CLONE 1438773-F
MSSLHATRAELGLVVLYLNKAEARDKICRAIQYGSQVVSNGQPCTAQEVD

SEQ ID NO: 41992 - DNA, 604 bp, Zea mays
  misc_feature: Ceres CLONE 1438787-F
  misc_feature: Encodes the peptide sequence at SEQ ID NO. 41993
  misc_feature (78)..(78): n is a, c, t, g, unknown, or other
gtcataactagtggatcccccgggctgcaggtttcgcacgagaccattacctagaacatcctaatcgaaaagcgtcgncctgcgcaatcatacttcctaccctccccacctcttccacggttccaccccgtccctctcctctcgagaagcacccgcaccatacatcttccggcgcccgacgcggacggcgagccgctgctgctgctgccgccggaggaggaagggcaccagggccagcgggtgcaggaggaggaggagcagcagcaggccgccggccgcttggggctgtgccacatgccgctctggggggccgccgcgtccgcggcgcctggagccgatggtgatcccccccgcgcggcggtcgggatccggcgggcggcctcaaggtggatcgggtcggtgctccccaaccgggggccgcttccgcctaaatccgccccgccaaagctcaactttccccttttagccccggcaagcaaatcccggaacccgcggtccgggatcaagaaacttccgccgaaggcccccatggggggcctctaaagtttccaaaaagagggggtcccccaaaaagaatttttcttctctgaggggccccccccgg

SEQ ID NO: 41993 - protein, 82 aa, Zea mays
  misc_feature: Ceres CLONE 1438787-F
MPLWGAAASAAPGADGDPPRAAVGIRRAASRWIGSVLPNRGPLPPKSAPPKLNFPLLAPASKSRNPRSGIKKLPPKAPMGGL

SEQ ID NO: 41994 - DNA, 718 bp, Zea mays
  misc_feature: Ceres CLONE 1438800-F
  misc_feature: Translation starting site: 254
  misc_feature: SWISSPROT Homolog: EC 3.2.1.21 Beta-glucosidase
aaagctggagctccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcaaagctcaagtaagtgaggtagtcacgaatggctcagttgatgaattccctgaatcacatttcccatatggctcggaacaacggttgggtggaaatgccccactggagtatgcaagctttacaataagatttggctcattgaatgtgacccaatgctttactcggtcaccaaacatcttgaagcaaagctcagcgaagta

SEQ ID NO: 41995 - DNA, 701 bp, Zea mays
  misc_feature: Ceres CLONE 1438803-F
  misc_feature: Encodes the peptide sequence at SEQ ID NO. 41996
ggagctccccgcggtggcggccgctctagaactagtggatcccccgggctgcaggaattcgcacgagaccattacctagaacatcctaatcgaaaaatcgcgtggtgggagccccgctctgttcctccgtcccctcctccttccggctctcgctgtcagatgtggtgtggtatgggggcagcatctgatcctgatggtgcgacgcctctcgatcgcccaatgtcatgattgatcgctaacgagcagagaagatgaatgttaatcatgaagcacccctctggcgcctctggctcaaatatgtctcaatatcactctccaaatcagatatgtggggttgaacggtttcctgacaatatgcaagcctgaatgatattgtcgctgcaaaataaatatcggaggtgactccaagacctagtcttatcatgcaccatcatccaacgagaattttatgcctggcacatatatttcttcagattatcaaatcgtgcgtaaaccactaccttatgagttgtgaccaccaattatctcagataaattgtgaccactctttccctaatgagaacatgctgcaatatcttccattcaagatgctccctatctgccacccccatgatgcccaacttctcgaagttcacctgattgtgaatattgactttgaagcgtcctgggtacaggagaactatccgtttcgctagatcaca

SEQ ID NO: 41996 - protein, 90 aa, Zea mays
  misc_feature: Ceres CLONE 1438803-F
MHHHPTRILCLAHIFLQIIKSCVNHYLMSCDHQLSQINCDHSFPNENMLQYLPFKMLPICHPHDAQLLEVHLIVNIDFEASWVQENYPFR

SEQ ID NO: 41997 - DNA, 572 bp, Zea mays
  misc_feature: Ceres CLONE 1438810-F
  misc_feature: SWISSPROT Homolog: EC 2.4.1.16 Chitin synthase
  misc_feature (150)..(150): n is a, c, t, g, unknown, or other
tggagctccccgcggtggcggccgctctagaactagtggatcccccgggctgcaggaattcgcacgagaccattacctagaacatcctaatcgaaaatacactgagaaccgcagagacaggcgtcttcgtactcgcctatctccgcgacnaaagctttccccaattcccccccttctcccatttctcaccaccgggccgccgctcccccccgtttcaacaacaaccatggaggggaaggggattctcgaatccaaattcgggcaaggggtggggttttccagggtgggaaaaaaacgtggtgggggggttttccccccaaaaggggtttcggggagggaaaagcccgggaaaaaacttgggggggggaaattttcaccccttttgggggaggggggggggaaaccccccccggcgttttttttccccccccccccccccccccaagaggggggggggggggtccccccccctttttttttttttagggaaattctttggggggggggggggggggccaaacaaaaactcgggggggggggccccctccggggggggagggggggtggggggg

SEQ ID NO: 41998 - DNA, 668 bp, Zea mays
  misc_feature: Ceres CLONE 1438811-F
  misc_feature: Encodes the peptide sequence at SEQ ID NO. 41999
  misc_feature (360)..(360): n is a, c, t, g, unknown, or other
tatagctggagctccccgcggtggcggccgctctataactagtggatcccccgggctgcaggatttcgcacgagaccattacctagaacatcctaatcgaaaaatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgncgaggaggcggcgcggctccgaaggcccggccccaggtttctctgcgtggtacaagcccctccccgccggcccccgggggccacccgaaagaaggcctacctccctggaacaaagttctcttacccctcccagcttgggggggccctctccaaccgtggcccacaaactgggaaggccctggccccccctaccccggggggccccactgggggggaaacctttttaaatcccccgggtggggccccccaccgcccgggccccataagggttgggggcgtttgggggcaaaaaaaaggggattccctcg

SEQ ID NO: 41999 - protein, 167 aa, Zea mays
  misc_feature: Ceres CLONE 1438811-F
MATFTAASSLSLLFSHPHSHSRQPSAQGPTASSHLHLHPRASRARCASSDTTATKHRRPAEENIRRGGGAAPKARPQVSLRGTSPSPPAPGGHPKEGLPPWNKVLLPLPAWGGPLQPWPTNWEGPGPPYPGGPHWGGNLFKSPGWGPPPPGPHKGWGRLGAKKRGFP

SEQ ID NO: 42000 - DNA, 663 bp, Zea mays
  misc_feature: Ceres CLONE 1438816-F
  misc_feature: Translation starting site: 269
  misc_feature: SWISSPROT Homolog: EC 1.6.5.3 NADH dehydrogenase (ubiquinone)
ctagaactagtggatcccccgggctgcaggaattcgcacgagaccattacctagaacatcctaatcgaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacagatggctccagcccctccgcagggttatgaccaaatgcctgagcctaggtgggttatttcaatgggcagctgtgccaacggggtggatactaccaatacctctactctggtggacgtggatgggaccgaaaagtcccggggaaatctacgtccctgggggccaccaatgctggag

SEQ ID NO: 42001 - DNA, 613 bp, Zea mays
  misc_feature: Ceres CLONE 1438820-F
  misc_feature: Encodes the peptide sequence at SEQ ID NO. 42002
  misc_feature (9)..(9): n is a, c, t, g, unknown, or other
gcggggtgncctaccccgatttgcgggaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagaggccgctcgccgtggccgcgcccgccgccggcgacgccaagagcccgctcttctgccccaagccgcggcgccccgcggcgcccctgcggtgccaccagggcggcgacgccagcatggatctgctcgacctcctcctgtcaaagcacagtgtttagggtgatgaacagtgacacactgacacgctatatctgggggagagagaagggggacgactcttagggggaggcgtatgggcaaccctggcatccataagactgggtgcagcggctcaatctaggcctgctatcccctattccca

SEQ ID NO: 42002 - protein, 61 aa, Zea mays
  misc_feature: Ceres CLONE 1438820-F
MSHFAAAAVKRPLAVAAPAAGDAKSPLFCPKPRRPAAPLRCHQGGDASMDLLDLLLSKHSV

SEQ ID NO: 42003 - DNA, 638 bp, Zea mays
  misc_feature: Ceres CLONE 1438823-F
  misc_feature: Encodes the peptide sequence at SEQ ID NO. 42004
aagctggagctccccgcggtggcggccgctctagaactagtggatcccccgggctgcaggaattcgcacgagaccattacctagaacatcctatccaaaagttgcgtacccaagttgagatctccgtctcccccgtgacgaatcccacgcgcacctctccccgacccggctggccgcagaaacagctcatcgcaccgggaggcgagagccgaataactcaatcaggagatggcgtcggcgctgtcctccctgcgctacggcgacagcctctcggtggtgggcatctcagccgcaactgccgcgctctgcgaggccatctcatgggttcttatctagagcaccgccacctacgactccctccgctgctccatcgaacgccactcaggacagctggacaccatgaagtcggggtcctacttctgcgggagctacctccatcatcgctacaggcccgcgtcgtccgcggaataataagatggcaccacggaaaagaccttcctcaaggaacccctcgccaggagctcccctcttgcccaagatccagttcagggcgcccatctttcaccataccggggcctttttgttcttttttgggcgggccccaaccccccatcaagggacccaaccctcccccaacc

SEQ ID NO: 42004 - protein, 35 aa, Zea mays
  misc_feature: Ceres CLONE 1438823-F
MASALSSLRYGDSLSVVGISAATAALCEAISWVLI

SEQ ID NO: 42005 - DNA, 647 bp, Zea mays
  misc_feature: Ceres CLONE 1438834-F
  misc_feature: Encodes the peptide sequence at SEQ ID NO. 42006
  misc_feature (401)..(401): n is a, c, t, g, unknown, or other
  misc_feature (455)..(455): n is a, c, t, g, unknown, or other
aaagctggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcagcggcgcgccggagggcagccggttggcggcagcgatggagctgcatcatcaggcgcagaaggaggctatggcgccgcagcaggctcgggctccgcccctcttncttgacttctcgcatggagattacggcggcgggaggaagcggcagcgcgaggcngagcccatgtcgtcgcagttcttctctctgcagcagcaaccgcaggcggcagggccccaaaggtgatcacctggcgcaacttccgaggcggacggcgatggggctccggcctcgacttccacaaggggttcggaccacttgtgtggaacttcccccggcctcgggcctgggcctttattttcccccccaaaa

SEQ ID NO: 42006 - protein, 93 aa, Zea mays
  misc_feature: Ceres CLONE 1438834-F
  misc_feature (54)..(54): Xaa is any aa, unknown, or other
MAVQAHYHHHYHRESPFLVSGAPEGSRLAAAMELHHQAQKEAMAPQQARAPPLXLDFSHGDYGGGRKRQREAEPMSSQFFSLQQQPQAAGPQR

SEQ ID NO: 42007 - DNA, 681 bp, Zea mays
  misc_feature: Ceres CLONE 1438838-F
  misc_feature (246)..(246): n is a, c, t, g, unknown, or other
  misc_feature (438)..(438): n is a, c, t, g, unknown, or other
  misc_feature (501)..(501): n is a, c, t, g, unknown, or other
  misc_feature (513)..(513): n is a, c, t, g, unknown, or other
aaagctggagctccccgcggtggcggccgctctagaactagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctngacgagcatggacagggaagtgcctcgtggacctcggccacccgctgctcaaccgcgtcgccgacagcttcatccgcgccgctggggtcggggcggccaggccgtctccagggaggcctacgtcgtcaccgtcgaaggctttcaggagactcgtcccggctagacgccacggcgcaagcgaagcattctccncatcagagtgacgacggcaaagtccctcgacgcttggtaaaacgggcggcaagaagccttcantgggggttgcanccgaatttaatctggttcccttaccccttcggggaggagggaatcccccacgggaaaaaaggcccttccagggcccttccgggggggggcgggggcccttccggggaacccgggggcccctccaaaaagtttgaattttctcctattcgggggccccttttttcaggg

SEQ ID NO: 42008 - DNA, 754 bp, Zea mays
  misc_feature: Ceres CLONE 1438839-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (48)..(48): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (104)..(104): n is a, c, t, g, unknown, or other
  misc_feature (105)..(105): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (312)..(312): n is a, c, t, g, unknown, or other
nnnntttttttgggggggccttataacatttgtggcccccccctcccntntnnaaaaagaggggtgtccggggggggggtccggggggggggaggggggccccnntnnnnnnnnnncnnnnnnnnccaagctgggactccccgcggtggcggccgctctagaactagtggatcccccgggctgcaggaattcgcacgagacattacctagaacatcctaatcgaaaattgtcacttgttgtcaggctaccggaacaaactgcgtgctccggcctccgggagaagagagagggtagaggagttgggcgcgcancaggatgagcggggaggaagccaacggctcaagccccaagggagggggggttaaacctaagggcacccttccagggggcccgcccaagtttaccccccccccgggcccgccggcaaaagcttttcccccccacccccccgggggaaaaataacagggccgtttcccggggtatattcccggggggaaacacccctggggggggccctttctcgggggcgcccccctctctggggggggggggggggcttttaaaaaaaaaaaaaaaattgtttggtggcctcccttgtaaaaaacccccccgggcaaaaaaaaaccggggaggggggggggggttccctccccaccaagaagagaggggggggtggttctctcccgcacaccaaaaaaaaaaaacaaggagatttttttgtctggtgccaaaagaaaacacacacacggggg

SEQ ID NO: 42009 - DNA, 663 bp, Zea mays
  misc_feature: Ceres CLONE 1438846-F
  misc_feature: Encodes the peptide sequence at SEQ ID NO. 42010
  misc_feature (568)..(568): n is a, c, t, g, unknown, or other
ggagctccccgcggtggcggccgctctagaactagtggatcccccgggctgcaggaattcgcacgagaccattacctagaacatcctaatcgaaaaagtcatttgtcattatctgtctctctccactgagattcaacacgttatcagcactttgctctccaccgagcggttaccgtcgacagcaatgtccatgcatccgtgcatccggcgtctgtcggacgaaaagcgattcaaagacaagttcatggagacgctgcttaggtatggctacagaggctagtacatgtctaatggctggacgctggacaacaacccgacaccactggaaggagatgatctcgctggagtctggcagtctggccacaaggagttgatctctactcagcaacagttgcaccacagcatctgtatcgtcggaggccgggactgcgtggccatggcgccgcccaacgactccgagccatgcacgcaccaccggctgcccgcggacgagctgcagccgcccgcgccggctacgtgctgcggcgccgctttggaccacggggcgcccgcggcggcatgggcctcntcgcgttccgagcctgaccaggtggcggcggcgccctgctgctcaggaaggggaaaaaaaacaaaaaacacccgaccaccacgggaggccgaaac

SEQ ID NO: 42010 - protein, 126 aa, Zea mays
  misc_feature: Ceres CLONE 1438846-F
MSNGWTLDNNPTPLEGDDLAGVWQSGHKELISTQQQLHHSICIVGGRDCVAMAPPNDSEPCTHHRLPADELQPPAPATCCGAALDHGAPAAAWASSRSEPDQVAAAPCCSGRGKKTKNTRPPREAE

SEQ ID NO: 42011 - DNA, 734 bp, Zea mays
  misc_feature: Ceres CLONE 1438852-F
  misc_feature: Translation starting site: 435
  misc_feature: Pfam Name: Fe-S_biosyn Pfam Description: Iron-sulphur cluster biosynthesis
  misc_feature (246)..(246): n is a, c, t, g, unknown, or other
  misc_feature (267)..(267): n is a, c, t, g, unknown, or other
  misc_feature (279)..(279): n is a, c, t, g, unknown, or other
  misc_feature (559)..(559): n is a, c, t, g, unknown, or other
  misc_feature (560)..(560): n is a, c, t, g, unknown, or other
  misc_feature (641)..(641): n is a, c, t, g, unknown, or other
  misc_feature (642)..(642): n is a, c, t, g, unknown, or other
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaaagtctggccgtcttccagacgtctccaatcggagctcccagcgtctcggagaagaggagcagcacggcacggcagctgtggcgaggaaggctcttgtcctgtcccatcccaacccagcagccgtccaaggaggaggagatccaantcggcgtgcaggcgtccaccngtccatccatcngatccaattccaatctgcaggtgagcagctcgttgagattcccaaatcacagctcgaatcgcctgctctcccatcctattgaatgaaactatggcctctgcgtcgcggcttgttcgtggaggagaggttgctgtggaacccgccgcccagtagccatgtcgtcctccgtgctgagggctgcggccgacagggctattcgcaggcaggccctcacgctgacggacgcccgcgcgtcccagatcccgcagctcctcagcctcaggcagcggccattcctgcnngctcgcgtcaaagcgcgtgggttgcacggcctctcgtacacgctcaactatgccgacgaaaaggggagttttgatgacttnngtgagaaaagggagtgaaagtgctgatcgacccccaggctctgatgcatgtcataggcaccangatggactacgtggacgacccgttaaggt

SEQ ID NO: 42012 - DNA, 670 bp, Zea mays
  misc_feature: Ceres CLONE 1438856-F
aaagctggagctccccgcggtggcggccgctctagaactagtggatcccccgggctgcaggaattcgcacgagaccattacctagaacatcctaatcgaaaaaaaatgttgtgggaggagttcaactcctccactgatcttatctcattcagattcagaaatgctgtggctccttgattctctacctcatgcgccctagaggaactactttgattcaatgatgagacgaatcagattgcttcatgttgcgcaggcctttgatatggatgcacgagattcttcatcttactgctgagatctagctgggaagccgtgaatcttaacacgggaggcaccaaggatctgggagtatgaagattccaatccactgctgttaacctctgcaccgtctgactttgtaggaatgattcactgatctaacacgattgttgttcttcagacctagagatgctcaaatctcacgaatataatgattctattcataacgctcctcacccgatgattgctgacatccattgagccattcggatcttctctgcactgatctcctgaggatgatgaatctgctgcaccctcatcaccggaacatcttctatgatgatacacttacatatatcaccgacttacataggcaatgtggcgtgcttcttgtgtaagacgtgacatactt

SEQ ID NO: 42013 - DNA, 648 bp, Zea mays
  misc_feature: Ceres CLONE 1438859-F
  misc_feature: Encodes the peptide sequence at SEQ ID NO. 42014
  misc_feature (417)..(417): n is a, c, t, g, unknown, or other
  misc_feature (425)..(425): n is a, c, t, g, unknown, or other
  misc_feature (458)..(458): n is a, c, t, g, unknown, or other
  misc_feature (488)..(488): n is a, c, t, g, unknown, or other
aaagctggagctccccgcggtggcggccgctctagaactagtggatcccccgggctgcaggaattcgcacgagaccattacctagaacatcctaatcgaaaagccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaaagggagtgctttcactggtgaagtcagtgctgagatgctcgtcaaccttggtgtcccntgggtcanttctggacactctgaaaggagagctctgctggnagaatcaaatgaatttgttggagacaggtngcgtatgccctggctcagggactaaaggccattgcaggggttggtgaaaacccttgaacaaaagggaggctgggcctacctgggaagtgggtttctccccaaaaaaaaaaacattttcttgaaaaaaacaagggacggggaacaaccttttttttttccc

SEQ ID NO: 42014 - protein, 121 aa, Zea mays
  misc_feature: Ceres CLONE 1438859-F
  misc_feature (5)..(121): Pfam Name: TIM Pfam Description: Triosephosphate isomerase
  misc_feature: SWISSPROT Homolog: EC 5.3.1.1 Triose-phosphate isomerase
  misc_feature (93)..(93): Xaa is any aa, unknown, or other
  misc_feature (104)..(104): Xaa is any aa, unknown, or other
  misc_feature (114)..(114): Xaa is any aa, unknown, or other
MGRKFFVGGNWKCNGTTDQVEKIVKTLNEGQVPPSDVVEVVVSPPYVFLPVVKSQLRQEFHVAAQNCWVKKGSAFTGEVSAEMLVNLGVPWVXSGHSERRALLXESNEFVGDRXRMPWLRD

SEQ ID NO: 42015 - DNA, 718 bp, Zea mays
  misc_feature: Ceres CLONE 1438860-F
  misc_feature: Translation starting site: 174
  misc_feature: Pfam Name: Complex1_LYR Pfam Description: Complex 1 protein (LYR family)
  misc_feature (424)..(424): n is a, c, t, g, unknown, or other
  misc_feature (472)..(472): n is a, c, t, g, unknown, or other
  misc_feature (495)..(495): n is a, c, t, g, unknown, or other
  misc_feature (504)..(504): n is a, c, t, g, unknown, or other
  misc_feature (517)..(517): n is a, c, t, g, unknown, or other
  misc_feature (518)..(518): n is a, c, t, g, unknown, or other
  misc_feature (561)..(561): n is a, c, t, g, unknown, or other
  misc_feature (599)..(599): n is a, c, t, g, unknown, or other
  misc_feature (629)..(629): n is a, c, t, g, unknown, or other
  misc_feature (651)..(651): n is a, c, t, g, unknown, or other
aagctggagctccccgcggtggcggccgctctagaactagtggatcccccgggctgcaggaattcgcacgagaccattacctagaacatcctaatcgaaaaaacccgactactactgcagcgagaggaaagagaaaaaggaaaggaaaggacaaaggagcggcggcgaggtctatggcgtcgacggctgggtacctggcgcggcgggcggcgcagaaggagcgggtgcgcctgctctaccgcagggcgctcaaggacacgctcaactggggccgtccaccgccacctcttctaccaggacacgtcggatctccgggacaagttcgaggccaaccgacacgtggataacctggacgtggtcgataggctcatcgacgatgcggaggctcagtacaggaacttccagcaccccgatccctacattngtccatgggcaccaggcggcactaaattcacaagaaaccccccctcancctcagggatcgagatcatctancattatggncaggaggaccagnntaacagagtccctgcagcggggggcagaacttcccacagtccnaatcacttccctgttaatcgagtttgtgtacgagaaantagaatggaaattactggactcatccatgnctctcatttttgctgtctgatnatcatgtgctcttcatctagtgcatattgaagtcatggttcctgtcataaaatggactgtactatct

SEQ ID NO: 42016 - DNA, 626 bp, Zea mays
  misc_feature: Ceres CLONE 1438862-F
  misc_feature: Encodes the peptide sequence at SEQ ID NO. 42017
  misc_feature (526)..(526): n is a, c, t, g, unknown, or other
agctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcacgggcatgctcatccagctgacctacgtggcgctcttcatcctctgctccgcgggggcggtgcgccgcaggntcgtgctcctgttccccgccgaggtcgccttcgtcgtcgccttggcccccgctgtgctcaccctggcgcacacccaccacgcaggttcatgctcttcgga

SEQ ID NO: 42017 - protein, 134 aa, Zea mays
  misc_feature: Ceres CLONE 1438862-F
  misc_feature (9)..(98): Pfam Name: MtN3_slv Pfam Description: MtN3/saliva family
  misc_feature (102)..(102): Xaa is any aa, unknown, or other
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRXVLLFPAEVAFVVALAPAVLTLAHTHHAGSCSS

SEQ ID NO: 42018 - DNA, 726 bp, Zea mays
  misc_feature: Ceres CLONE 1438869-F
  misc_feature: Encodes the peptide sequence at SEQ ID NO. 42019
  misc_feature (517)..(517): n is a, c, t, g, unknown, or other
  misc_feature (590)..(590): n is a, c, t, g, unknown, or other
  misc_feature (598)..(598): n is a, c, t, g, unknown, or other
  misc_feature (657)..(657): n is a, c, t, g, unknown, or other
  misc_feature (673)..(673): n is a, c, t, g, unknown, or other
  misc_feature (702)..(702): n is a, c, t, g, unknown, or other
  misc_feature (704)..(704): n is a, c, t, g, unknown, or other
  misc_feature (708)..(708): n is a, c, t, g, unknown, or other
  misc_feature (712)..(712): n is a, c, t, g, unknown, or other
  misc_feature (713)..(713): n is a, c, t, g, unknown, or other
aaactggagctccccgcggtggcggccgctctagaactagtggatcccccgggctgcaggaattcgcacgagaccattacctagaacatcctaatcgaaaaaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccaggggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaagaaacgttccttttgctgcacctcggctggtgcattgaatggcttcangctttctttttctgtgctgatgatatcatggatgactctcacactcgtcgcggccagccttgctggttcaggntgcctcangttggctaattgctgcgaatgacgggatcatccttcgcaacatatctcacggatccttncgcgccactttaaggncaaacctactatgctgatctccttgattngntcantganngtgaaagtcagac

SEQ ID NO: 42019 - protein, 118 aa, Zea mays
  misc_feature: Ceres CLONE 1438869-F
  misc_feature: SWISSPROT Homolog: EC 2.5.1.67 Chrysanthemyl diphosphate synthase
  misc_feature (89)..(89): Xaa is any aa, unknown, or other
  misc_feature (114)..(114): Xaa is any aa, unknown, or other
  misc_feature (116)..(116): Xaa is any aa, unknown, or other
MAPAGTPGAAFARIYKTLKEELLTDPAFEFTEESRQWIDRMVDYNVLGGKCNRGLSVVDSYKLLKGADALGEEETFLLLHLGWCIEWLXAFFFCADDIMDDSHTRRGQPCWFRXPXVG

SEQ ID NO: 42020 - DNA, 778 bp, Zea mays
  misc_feature: Ceres CLONE 1438871-F
  misc_feature (384)..(384): n is a, c, t, g, unknown, or other
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcaccctttgtccctccnacatcatcagccctattacatcagttacctttgggtgcattatgggcacaaaacatcagggcacaacaactaccaacaacttgggctagcaaacccttggctgctacttctagcaacagnaagtttcttccattcaaccaaaataactggcaatgaacccctgcttcctattttggcaaaaaaaaaaattacatttaggccgggtacctgggtgcctaacccccagaaaatttttttcttttcaaccaaagggggaaaattgaacccctcccggttttttttccccgggaaaaaaaatttcctcttttttcgccttttttgtggggggggcccccccctctttttttttaaaaacccacccgtgttgtgttcggttttcccaccccgcctcgcg

SEQ ID NO: 42021 - DNA, 745 bp, Zea mays
  misc_feature: Ceres CLONE 1438872-F
  misc_feature (296)..(296): n is a, c, t, g, unknown, or other
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcgaaaaatcgaaaacccaccgcaccctttcatcagcctgcctgtccactgttggcttggtgacttcctccgctccgctccgctcccctccgctcccgaacggtcgatctttgcatggcagcagcagctggctccaaggggcggggcgatcgctggaagcttcgtcgccgcgtcctcgccggcaggccgcctcgccgaganggcgtgcacgctcggcgtacgacaagaccctggagaccagtgcgccggcgttcgtgccgacgatgtgatcggcagcgccgggagccccgacnagtactggagccccacccccagacggggttcttcgggccggggggggtggaaccccaaactggccccctggttgggccccccggaaacccccgcccgaatgcttcaaggaagccacggtcctgaaaccaaaggggggggttcccccccctcaaagaactaaaaaacccccccccccccccgggaaccccccggggctttttaagccacccccacctgtgggtgtctcctaaaaaaaaagcggcggggaaaacccttgtatttgaaagaacccttttttttgtttcgcgcggggggggggcccccccctttttttccgcggaaaatatatattccgaagaaggggggccttgaaaaag

SEQ ID NO: 42022 - DNA, 740 bp, Zea mays
  misc_feature: Ceres CLONE 1438873-F
  misc_feature: Encodes the peptide sequence at SEQ ID NO. 42023
  misc_feature (599)..(599): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccccgtggaggcgaagcaggcgctctactcgagggacctcgctcgcaacctgcgcttcgcctccaacttcgacctcttncaggctgctgcggccgactggcgcgacacgcttcttctgcgaggtggctccgaacccgccgccgcgggaggagctgccggagccactcangaacgtgatgctggagtacagcgcggcggtgacgaagctggccgcgttcgt

SEQ ID NO: 42023 - protein, 197 aa, Zea mays
  misc_feature: Ceres CLONE 1438873-F
  misc_feature: SWISSPROT Homolog: EC 1.14.11.20 Desacetoxyvindoline 4-hydroxylase
  misc_feature (151)..(151): Xaa is any aa, unknown, or other
  misc_feature (181)..(181): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPPWRRSRRSTRGTSLATCASPPTSTSXRLLRPTGATRFFCEVAPNPPPREELPEPLXNVMLEYSAAVTKLAAF

SEQ ID NO: 42024 - DNA, 717 bp, Zea mays
  misc_feature: Ceres CLONE 1438875-F
  misc_feature: Translation starting site: 159
  misc_feature (266)..(266): n is a, c, t, g, unknown, or other
  misc_feature (278)..(278): n is a, c, t, g, unknown, or other
  misc_feature (408)..(408): n is a, c, t, g, unknown, or other
  misc_feature (446)..(446): n is a, c, t, g, unknown, or other
  misc_feature (525)..(525): n is a, c, t, g, unknown, or other
  misc_feature (568)..(568): n is a, c, t, g, unknown, or other
  misc_feature (673)..(673): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctngctgtacgatanccaagggccgcttccgccttcacccaatcagggatgaggatgctaagttcaagctttgcaaggttaggtctgttcagtttgggcagaagggcatcccttatctgaacacgtatgacggccgcaccatccngctacctgaccccctcatcaaggccaacgacaccatcnagatcgatctggagacccaacagatttgtgactttcatcagtttgatgttggcaacgtcgtcatggtgactggcgaaangaacactgccgcgtgggtgttatcagaacaggggagagcacanggcagctttgagaccatcacgtggaggactcccctggccacagttcgcccccgtatggcaacgtgttcaccatcgcaaggtaataagcgttggtgagctgccaanggcanggaatcagctgagcatctaaagagcaaaggagcggatgc

SEQ ID NO: 42025 - DNA, 646 bp, Zea mays
  misc_feature: Ceres CLONE 1438877-F
  misc_feature: Encodes the peptide sequence at SEQ ID NO. 42026
tggagctccccgcggtggcggccgctctataactagtggatcccccgggctgcaggaattcgcacgagaccattacctagaacatcctaatcgaaaactgttcgccagagccaagcccctagtagccacctcgctccagaagctttcctcccctagatctccctcccgtgcccggtcgcgctgccgacccggccatggcgaccaaggggaagctcggggagctagtgtgggagcaccgggtgcaggcggccgcagcggtggctttcgtggccgcggccgccgtctcgatctccgccgtcgggcccaggctcggcgccgtggtgtcattcttctggccgctgctcgtctccacgggcctcttcctggtggcggtcgccgtgctgctccggatctcgccgccgcccgcgggcgacgacgacgagtccggcaaggagctcatcgacttcgtcgccgggtgccgcccggagcacctcgtcccggatgcggcgccgccggcggccgtagcccccgtggaggctccgcccgagctgcagatctaacgggctgccggaggaggaggctgacagcagcctagctgtgctgtgtgctgctgcgtggcatggcgtgctccgtccccgggtgaacttcctccagtggcacgggtggg

SEQ ID NO: 42026 - protein, 114 aa, Zea mays
  misc_feature: Ceres CLONE 1438877-F
MATKGKLGELVWEHRVQAAAAVAFVAAAAVSISAVGPRLGAVVSFFWPLLVSTGLFLVAVAVLLRISPPPAGDDDESGKELIDFVAGCRPEHLVPDAAPPAAVAPVEAPPELQI

SEQ ID NO: 42027 - DNA, 660 bp, Zea mays
  misc_feature: Ceres CLONE 1438906-F
  misc_feature: Translation starting site: 142
  misc_feature: SWISSPROT Homolog: EC 3.1.1.79 Hormone-sensitive lipase
tggagctccccgcggtggcggccgctctagaactagtggatcccccgggctgcaggaattcgcacgagaccattacctagaacatcctaatcgaaaaatttctctttgaacatttcctccaatcttagtccaaaagcaataatggattcagaaatagatgtcgacaactctccagcttaccgagtctacaagagtggccgcatcgagcgtctctcaggagaaacattcaaaccaccttctcccctaacccccgaaaacggcgtcgtttccaaagacacactcttctccccggagcacaacctctccgtccgcatattcctcccggagaaagcctccgccgccaccggtgaaaagctgccactcctcgtctacttccacggcggaggcttcgtcatcgaaaccgcgttttccccgacttaccataccttcctcaccaccaccgtcgccgccgccggctgcttagccgtctccgtcgactaccgccgcgcgccggagtttccgattccggtcccgtacgaagactcctgggacgctctcaaatgggtgctctctcatatctccggagcagtggataaacaaacacgccgacttcgagaaactgttcctcgccggagacagcgccggcggaaacatctgtcatcatctcgcgacacgtgcgaa

SEQ ID NO: 42028 - DNA, 662 bp, Zea mays
  misc_feature: Ceres CLONE 1438924-F
  misc_feature: Encodes the peptide sequence at SEQ ID NO. 42029
ctggagctccccgcggtggcggccgctctagaactagtggatcccccgggctgcaggaattcgcacgagaccattacctagaacatcctaatcgaaaaaccgatttgcagacccatggtgctgacgaagaatgcactccgcattctctacaaatagcttggcaccttgacacctagcttcacctccctcctcctggcccagtcgtcctagccatcaaaattcagttgagggttcttcagttcagccatgaagcttgagatgacagcagcggccatggtcttgatcctgctgacctcgggcgccgaggccaaggtctgctactcgcggagcaggaccttcaaggggtggtgctaccacagcatcaactgcatcgccatctgcatcaccgagggcgacaccagcgggttctgccaggccggggcctgcatgtgcacttatgagtgtctcaatggtgtcgtcgccggtggcggcggtggcggcggacagcatccatcggttggctcatcgcgtggtggtggtgctgaggctaaagcagccgtcccatcagtgtagagcttctgattctggcggggtgatggcagatggtgcactactactcttccgtgcacatgctaactcaaggtttcgagttgatgaataacacaaatggttcttttacttaa

SEQ ID NO: 42029 - protein, 101 aa, Zea mays
  misc_feature: Ceres CLONE 1438924-F
  misc_feature (22)..(66): Pfam Name: Gamma-thionin Pfam Description: Gamma-thionin family
MKLEMTAAAMVLILLTSGAEAKVCYSRSRTFKGWCYHSINCIAICITEGDTSGFCQAGACMCTYECLNGVVAGGGGGGGQHPSVGSSRGGGAEAKAAVPSV

SEQ ID NO: 42030 - DNA, 668 bp, Zea mays
  misc_feature: Ceres CLONE 1438934-F
  misc_feature: Encodes the peptide sequence at SEQ ID NO. 42031
  misc_feature (353)..(353): n is a, c, t, g, unknown, or other
  misc_feature (452)..(452): n is a, c, t, g, unknown, or other
ctccccgcggtggcggccgctctagaactagtggatcccccgggctgcaggaattcgcacgagaccattacatagaacatcctaatcgaaaaccctggctctagctctccaagccgatgctgctcgctacccctctccaagctgacgccccaaccatggcactctctgctcctccaagccggcgacccctcctctctggttcagcgcaggggactccctccatggctggcgcccctgatggccggacctccacctcgccattgccggttgctcctgcactagattatcttcaagcccggtcgcggtatagcagcaacaaccatgaaaccccatcgtgtcgcgccctcgacgtngtcgacagaatatcgcagcaagcagtgccctcccctttctgcaggcagtggatgcccccagccccctcctttgttccatgggccgacccactgctgctncccatggggatttctaaatcccctttgttggtttacaagtccttaataaaacccggccgaggggaggttttaaagggggttgaaggggggccaattgaaaaaaatcccttggaaaaataggggggaaaaaaaagttaattccaccctcccttagggttcaaaggaagccccaaaggggggccccctctctttttggcgaaaacgggccaaaaaggg

SEQ ID NO: 42031 - protein, 38 aa, Zea mays
  misc_feature: Ceres CLONE 1438934-F
MGISKSPLLVYKSLIKPGRGEVLKGVEGGPIEKNPLEK

SEQ ID NO: 42032 - DNA, 663 bp, Zea mays
  misc_feature: Ceres CLONE 1438947-F
  misc_feature: Encodes the peptide sequence at SEQ ID NO. 42033
  misc_feature (412)..(412): n is a, c, t, g, unknown, or other
ggagctccccgcggtggcggccgctctatacactagtggatcccccgggctgcaggaattcgcacgagaccattacctagaacatcctaatcgaaaaatccacgctcacattctgctatcgtacaaacaccgtttctatacaggccaaggcgacaagcttcgtccagctctgcatcaaagaaggaaggaagttatggaccgcacctactacaagggcggcatcaaggcgtactggaagcgccggggctactaccgcatcgacgccaccgccgcgcagcgccgcccgccgttccccaccgcggagctcggaggtggcgtgggcgtcgcccaagcccagccgccgcaggcgccgccgccagagggtggctcgggccggcgccgttgccgcgggtggcgcgtgcgctgcggccanccgcggcggcggctgctccgcgcgctgtcaccgcgccggtggctcgtgcggctccgcgacgcgtacgtgtccgccatgctgcggctggcgtcctcccccgccgtcgggtacggcgccggtgcgccctactgcggcacggcggccttctcgcggccggcgcagctcaaggagtacgaacagaacgtgctggtggagatctacaggtccatactcgcgggcgtgggggctggccccatcgccgtcactaccgg

SEQ ID NO: 42033 - protein, 156 aa, Zea mays
  misc_feature: Ceres CLONE 1438947-F
  misc_feature (73)..(73): Xaa is any aa, unknown, or other
MDRTYYKGGIKAYWKRRGYYRIDATAAQRRPPFPTAELGGGVGVAQAQPPQAPPPEGGSGRRRCRGWRVRCGXPRRRLLRALSPRRWLVRLRDAYVSAMLRLASSPAVGYGAGAPYCGTAAFSRPAQLKEYEQNVLVEIYRSILAGVGAGPIAVTT

SEQ ID NO: 42034 - DNA, 608 bp, Zea mays
  misc_feature: Ceres CLONE 1438948-F
  misc_feature (330)..(330): n is a, c, t, g, unknown, or other
  misc_feature (331)..(331): n is a, c, t, g, unknown, or other
  misc_feature (551)..(551): n is a, c, t, g, unknown, or other
aaagctggagctccccgcggtggcggccgctctagatctagtggatcccccgggctgcaggaattcgcacgagaccattacctagaacatcctaatcgaaaaagaactacagaagaggcggccaagcattagcaaagcataccccaaaatccccaaaccctagcgaactcggcacggcggcgatggcagcggcgggcctgcggaaggggaacgcgcgcctcccaccctgaagtgaaccgggtgctgtacgtgcggaatctgccgttcaacatctcgagcgaggagatgtacgacatcttcggcaagtacggggcgcgattcggggcaagnnaaattccccccgggggccctttggggggggggcccaaaaaaaacccggggcccccccccaaaaaaaggggggggggagaaaacacaaaacccccctgtgggtccctaaggggatcccccccggagggggggggtgggcattactccacatataacaactagaactccccgccccccgtttcctcccgttgcgctgtagccccggggccgccacccccccnccccctctttttataatttcaaccccccgctggtttattcgtgtttttttttccttc

SEQ ID NO: 42035 - DNA, 671 bp, Zea mays
  misc_feature: Ceres CLONE 1438984-F
  misc_feature: Encodes the peptide sequence at SEQ ID NO. 42036
  misc_feature (671)..(671): n is a, c, t, g, unknown, or other
ctggagctccccgcggtggcggccgctctagaactagtggatcccccgggctgcaggaattcgcacgagaccattacctagaacatcctaatcgaaaaaactcctgtaactcgggtggtcggatttcctcccaatccatcccgcctggaaacccgaactccaagtccccccgcatcgatggctcccaatggcgacaagaaccccgcggcgaacaagccggcggaggaggagcccgctgacgacaacgcgccggccgggaataagcccaaggaggagaagcgtgtcccagcacgcaactccgccggcaaggagggcggccagggaaagaggggccggaacaacgacaagaagagcgtggagacctacaagatctacttcttaaatgtgctgaaccacgcgcacccggacatcggcatctcctctaaggccatgtccatcatgaactccttcatcaacgacatcttccagaagctcgccgccgaggccgccaagctcgcgcggtacaacaagaagcccaccatcacctcccgtgagatccagacctccgtgcgcctcgtcctccccggggagctcgcccagcacgccgtctccgagggcacctagggcgtcaccaagttcaccacgtcctatgctgcgtggcctcagcttgcacgcttccctcgaatgatcgn

SEQ ID NO: 42036 - protein, 141 aa, Zea mays
  misc_feature: Ceres CLONE 1438984-F
  misc_feature (57)..(127): Pfam Name: Histone Pfam Description: Core histone H2A/H2B/H3/H4
MAPNGDKNPAANKPAEEEPADDNAPAGNKPKEEKRVPARNSAGKEGGQGKRGRNNDKKSVETYKIYFLNVLNHAHPDIGISSKAMSIMNSFINDIFQKLAAEAAKLARYNKKPTITSREIQTSVRLVLPGELAQHAVSEGT

SEQ ID NO: 42037 - DNA, 694 bp, Zea mays
  misc_feature: Ceres CLONE 1439008-F
  misc_feature: Encodes the peptide sequence at SEQ ID NO. 42038
  misc_feature (418)..(418): n is a, c, t, g, unknown, or other
tggagctccccgcggtggcggccgctctagaactagtggatcccccgggctgcaggaattcgcacgagaccattacctagaacatcctaatcgaaaacatttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtccagtaacatcatggaagaatgacnatggggaagacttgcttttcctcagcagcagggcttttttcaaactccaaaagctattcggggggaaatacaatctgcttcccccattttggatccctggaaatcttgaaaaaaagggattccttggaacccggttttggaactttggaaaaaatcccccccttttaccattaaccccggttttaagtttttcaaaacccgccacccccggggggggggccgggcccccaatttcccaatagaggggacgaataaccccgcccctccgggggccct

SEQ ID NO: 42038 - protein, 125 aa, Zea mays
  misc_feature: Ceres CLONE 1439008-F
  misc_feature (46)..(46): Xaa is any aa, unknown, or other
MQLPSPFAELVKGPSGLEKVVLRGARNCCAEIYLYGGPVTSWKNDXGEDLLFLSSRAFFKLQKLFGGKYNLLPPFWIPGNLEKKGFLGTRFWNFGKNPPLLPLTPVLSFSKPATPGGGAGPPISQ

SEQ ID NO: 42039 - DNA, 653 bp, Zea mays
  misc_feature: Ceres CLONE 1439043-F
  misc_feature: Encodes the peptide sequence at SEQ ID NO. 42040
tggcggccgctctagaactagtggatcccccgggctgcaggaattcgcacgagaccattacctagaacatcctaatcaaaaaaaaaacttacggcgcgctgcgaagggagtcggacgcggtggggtgtagcatgagggagcagcagggttccggcgacgtggcggggcgccggggcggggtcatcaggtccctgctgggcgtcgagcgccggctcgcggagggcgacgccgagggggcggtcggggtctcctcaggcaagcagccggcgaccgagggcggtggcggtggcggtggcgaggaaaggaaggccgtggtgagggtggtggcggccgacatgccgcccgcgctgcagcgccgcgcgttccgctgcgcccgcgacgagctcgccgcgatgccgcacttcccgcgccggctcgagcccaagcgcctcgcgctcgcgctcaagaaggagttcgatgctgcttacgggccagcttggcactgcatcgtggggacgagtttcggttcatatgtcacgcacgcccggggtggattcttgtatttttccgtcgataaggtctacatcctgctcttcaggacagccgtggagccctagccgcattgacggccaccagcctaccagcaatggacaaatggttcataaaaatgccca

SEQ ID NO: 42040 - protein, 154 aa, Zea mays; identical to SEQ ID NO: 10705
  misc_feature: Ceres CLONE 1439043-F
  misc_feature (55)..(151): Pfam Name: Dynein_light Pfam Description: Dynein light chain type 1

SEQ ID NO: 42041 - DNA, 652 bp, Zea mays
  misc_feature: Ceres CLONE 1439067-F
  misc_feature: Encodes the peptide sequence at SEQ ID NO. 42042
  misc_feature (394)..(394): n is a, c, t, g, unknown, or other
  misc_feature (506)..(506): n is a, c, t, g, unknown, or other
  misc_feature (536)..(536): n is a, c, t, g, unknown, or other
  misc_feature (585)..(585): n is a, c, t, g, unknown, or other
gctctagaactagtggatcccccgggctgcaggaattcgcacgagaccattacctagaacatcctaatcgaaaaagaggtgggttggcttctcctccccctccggttcgggttcgggttcgtgaggttctccggggttcgagttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgncacatcaccgtcaacgaggcccagtcccgcggcggccgtggaggcggcggcggtgggtacggtggtggcccgtggagctgcggctacggcggtggcgggcgccgtgatggcngtggcggctacggcggtggcggcggctacngtggcggcggccgctacggtggcggcggccgctacgggtgtggtgttgngcgctactggggtggcaaccggggggcggctacggcaactccgacgggaactggagaactgagcggg

SEQ ID NO: 42042 - protein, 163 aa, Zea mays
  misc_feature: Ceres CLONE 1439067-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (115)..(115): Xaa is any aa, unknown, or other
  misc_feature (125)..(125): Xaa is any aa, unknown, or other
  misc_feature (141)..(141): Xaa is any aa, unknown, or other
MAASDVEYRCFVGGLAWATDDHSLHNAFSTYGEVLESKIILDRETQRSRGFGFVTFSTEEAMRNAIEGMNGKELDGRHITVNEAQSRGGRGGGGGGYGGGPWSCGYGGGGRRDGXGGYGGGGGYXGGGRYGGGGRYGCGVXRYWGGNRGAATATPTGTGELSG

SEQ ID NO: 42043 - DNA, 662 bp, Zea mays
  misc_feature: Ceres CLONE 1439095-F
  misc_feature: Encodes the peptide sequence at SEQ ID NO. 42044
  misc_feature (512)..(512): n is a, c, t, g, unknown, or other
  misc_feature (521)..(521): n is a, c, t, g, unknown, or other
ggagctccccgcggtggcggccgctctagaactagtggatcccccgggctgcaggaattcgcacgagaccattacctagaacatcctaatcgaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctctttcgagagaccctctaccagaagacgaggatgggcagccttttgtcgatgtcctcaaggagggaggcgtccctccctggcatcaaggtcgacaagggcaccattgaggttgttngcaccgacnaggagaccaccacccagggccacgatgacctcggcaagcgctgcgctaagtactacgaggccggtgccccgctttgccaagtggggtgcttgtctcagaatggccccaacgagccgtcccagctttgcattgacctgaatg

SEQ ID NO: 42044 - protein, 162 aa, Zea mays
  misc_feature: Ceres CLONE 1439095-F
  misc_feature (11)..(162): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (113)..(113): Xaa is any aa, unknown, or other
  misc_feature (116)..(116): Xaa is any aa, unknown, or other
MSAYCGKYADELIKNAAYIGTPGKGILAADESTGTIGKRLSSINVENVEENRRALRELLFCCPGALQYISGVILFRETLYQKTRMGSLLSMSSRREASLPGIKVDKGTIEVVXTDXETTTQGHDDLGKRCAKYYEAGAPLCQVGCLSQNGPNEPSQLCIDLN

SEQ ID NO: 42045 - DNA, 656 bp, Zea mays
  misc_feature: Ceres CLONE 1439100-F
  misc_feature: Encodes the peptide sequence at SEQ ID NO. 42046
ccgcggtggcggccgctctagaactagtggatcccccgggctgcaggaattcgcacgagaccattacctagaacatcctaatcgaaaaaaaatacagttttatatataaaataaaataaataaactcaaaaaccaggaactattacttttcgccgaagaagaagattccctctctaacctacgtcgataaatctacgagggagcttgaccttgagcaacagagagagagagagagagatgggtttcttctcgtttcttggaagagttcttttcgcttctctcttcatcctctccgcttggcaaatgttcaatgactttggagttgatggtggtcctgcagctacagagctggctccaaagcttcatctggccaagtcacatctatcttctagattaggtgtaactttgcctagcgtagaggtaaaacaagtcgttgctgctatagttgcgttgaaaggagttggaggcttactctttgttatcggaaacatcttcggtgcttatcttctggctttctaccttgtggttgtcagtcctattctgtatgatttctacaactacggacctgaggagcgtcatttctctccattgttgactgagttcttgcagagcgttgcactctttggagcattactcttctttattggaatgaagac

SEQ ID NO: 42046 - protein, 139 aa, Zea mays
  misc_feature: Ceres CLONE 1439100-F
  misc_feature (1)..(138): Pfam Name: HR_lesion Pfam Description: HR-like lesion-inducing
MGFFSFLGRVLFASLFILSAWQMFNDFGVDGGPAATELAPKLHLAKSHLSSRLGVTLPSVEVKQVVAAIVALKGVGGLLFVIGNIFGAYLLAFYLVVVSPILYDFYNYGPEERHFSPLLTEFLQSVALFGALLFFIGMK

SEQ ID NO: 42047 - DNA, 656 bp, Zea mays
  misc_feature: Ceres CLONE 1439108-F
ctccccgcggtggcggccgctctagaactagtggatcccccgggctgcaggaattcgcacgagaccattacctagaacatcctaatcgaaaaagtttcttcacctgtgatctctccctcatcccctgcgcataggaagtcagcttcttcacgtcgcctcctccctaggcgccgatcctacagagcctcgctggtcatccctgctctctcgacgtctctcccatggcgccctccccttcctgccatggccgcccctccctgctgcagctcgacgctcctccctggagctcgcccctgccctctgtccagcgccctccctgctgcccatggtatggacgccagccccctctcttgttgccatggatagcccctcttccatctccttccccaagcacaagtcccatggtcgcccaacctagctcgcccagccacctctgctgctcccatggtgatctctaaatttcttagttgttttactagttcttgttaatatcctgctgatgtgatgttttatgtgtgttgatgtgtgcgatatggagtaaaatccttggagaaataggtggagaagaaggttaagttcaacgctccttaggtgtttgatgatatgctcgaactggtggccgtcttcgttcttgctggaatcgggtcggagcatga

SEQ ID NO: 42048 - DNA, 711 bp, Zea mays
  misc_feature: Ceres CLONE 1439217-F
  misc_feature: Encodes the peptide sequence at SEQ ID NO. 42049
  misc_feature (428)..(428): n is a, c, t, g, unknown, or other
  misc_feature (431)..(431): n is a, c, t, g, unknown, or other
  misc_feature (527)..(527): n is a, c, t, g, unknown, or other
ctccccgcggtggcggccgctctagaactagtggatcccccgggctgcaggaattcgcacgagaccattacctagaacatcctaatcgaaaagacacccatcctctccaccgaagtcaccaccgcatggacgacgccgcgaatcccacccctccaccatccacctccgccgcatccgcggcggccgcggcggcgcaacaccagcagctccagcgccaactcttcctaatgcagcaggcgcagtcccatccgcagcagctgtcgcagcaggccatgtcccgcttcccctccaacatcgacgctcacctccgccctctagggccgcttcgcttccaacagccccagccccagccccagccgtcccactcccagggtccatctcagtcgccgtcgcaggccacgcagcaggcgtcaccccagcagcagcancancaggcggcggcggcggcggcagcggcgcaggcacaagcacaggccccagcccaggcggcacgggtacgaagccccgagatggagatggcgctgcangacgccatgcgggtctgcaatcgggacgtcaagacgccctttcagtccattcgaggacgctgtcacagggtattaccctacccatgtttgtgccaactataaggctgaaaaaaatacgggattctttgaaaggaacaaacggggcaaatcctttccgccggggggaagggggaccctaaaattt

SEQ ID NO: 42049 - protein, 167 aa, Zea mays
  misc_feature: Ceres CLONE 1439217-F
  misc_feature (101)..(101): Xaa is any aa, unknown, or other
  misc_feature (102)..(102): Xaa is any aa, unknown, or other
  misc_feature (134)..(134): Xaa is any aa, unknown, or other
MDDAANPTPPPSTSAASAAAAAAQHQQLQRQLFLMQQAQSHPQQLSQQAMSRFPSNIDAHLRPLGPLRFQQPQPQPQPSHSQGPSQSPSQATQQASPQQQXXQAAAAAAAAQAQAQAPAQAARVRSPEMEMALXDAMRVCNRDVKTPFQSIRGRCHRVLPYPCLCQL

SEQ ID NO: 42050 - DNA, 680 bp, Zea mays
  misc_feature: Ceres CLONE 1439218-F
  misc_feature: Encodes the peptide sequence at SEQ ID NO. 42051
  misc_feature (379)..(379): n is a, c, t, g, unknown, or other
  misc_feature (380)..(380): n is a, c, t, g, unknown, or other
  misc_feature (387)..(387): n is a, c, t, g, unknown, or other
  misc_feature (453)..(453): n is a, c, t, g, unknown, or other
  misc_feature (473)..(473): n is a, c, t, g, unknown, or other
  misc_feature (482)..(482): n is a, c, t, g, unknown, or other
cgctctagaactagtggatcccccgggctgcaggaattcgcacgagaccattacctagaacatcctaatcgaaaaaaaatggaggcgctcgtggtgcggcagctgggcgatcccaccctgccccctggcggtgaagcctccccgttcgccgcggtctctggggatcacccagtgccggagatctcatcgccgacggctgtccgagtgcgagtcgcggcgaccagcctcaacttcgccacgttcctccaggtgcagggcaagtaccaggagcggcccccgcttccgttcgtgcctggatccgactactctggcgtggtcgacgcagtcggtcccggcgtgcgtgggctccggcccggcgaccgcgtctgctcctttaccnngcctcgntccttcgctgacttcatcgtcgccgaggagagcagctattttttgtgccctgatgatgcgacctgntcacgctggggctttacagntgcattggnacatcacatttggcccttgtcaccgagccaattggaaggctggcagggccacttggtcttggtccttctggggtgcccggccttctctggcaaataaaaaatttggggggcttttttttttgcatttctggggggctgaaaaaccgatattccccacccctgggggcccatttttttttccccccccggggaaatttt

SEQ ID NO: 42051 - protein, 166 aa, Zea mays
  misc_feature: Ceres CLONE 1439218-F
  misc_feature (38)..(119): Pfam Name: ADH_N Pfam Description: Alcohol dehydrogenase GroES-like domain
  misc_feature: SWISSPROT Homolog: EC 1.6.5.5 NADPH:quinone reductase
  misc_feature (101)..(101): Xaa is any aa, unknown, or other
  misc_feature (125)..(125): Xaa is any aa, unknown, or other
  misc_feature (132)..(132): Xaa is any aa, unknown, or other
  misc_feature (135)..(135): Xaa is any aa, unknown, or other
MEALVVRQLGDPTLPPGGEASPFAAVSGDHPVPEISSPTAVRVRVAATSLNFATFLQVQGKYQERPPLPFVPGSDYSGVVDAVGPGVRGLRPGDRVCSFTXPRSFADFIVAEESSYFLCPDDATXSRWGFTXALXHHIWPLSPSQLEGWQGHLVLVLLGCPAFSGK

SEQ ID NO: 42052 - DNA, 795 bp, Zea mays
  misc_feature: Ceres CLONE 1439222-F
  misc_feature: Encodes the peptide sequence at SEQ ID NO. 42053
  misc_feature (46)..(46): n is a, c, t, g, unknown, or other
tttccccccccctttccacatcttccccccggccccgtttcgcccnccccctataactgggactccaccgcggtggcggccgctctatactagtggatcccccgggctgcaggatttcgcacgagaccattacctagaacatcctaatcgaaaaatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgctgaccccgagcaagtggaaggaagagcactttgttctagcaagcctctcaatgtggggggttattttttatggcggttacaagctttttagtggaaagaaggaattcaagactgaggtggcctcaccacaggcataggtggcggagatggagttatacctgtatctgtcccctgccaaccatgttaaatcaaacgaatgctttatgttgcgctcttcagttgataaagtgcggcaacaggagattctgctttacgcaggtccatatatggagaaggtacctcttactccccaaaaaaacccaaaacaatatgttatcttttccctccccaccctctagggggggccccggtacccaagttcctccctattttggcgcctgaattacgcccccgcccccatggtcttattctctttaaaacgcttccccgctgggggaaaaacccccgggcgttccccccaaacttatatccccctttggccccccatatcccccct

SEQ ID NO: 42053 - protein, 93 aa, Zea mays
  misc_feature: Ceres CLONE 1439222-F
MASRLVAAAASSSSLSSASPLARLISRRGLAGAADGHGSAKVPLWKDPLTPSKWKEEHFVLASLSMWGVIFYGGYKLFSGKKEFKTEVASPQA

SEQ ID NO: 42054 - DNA, 724 bp, Zea mays
  misc_feature: Ceres CLONE 1439223-F
  misc_feature: Encodes the peptide sequence at SEQ ID NO. 42055
tccccgcggtggcggccgctctagaactagtggatcccccgggctgcaggaattcgcacgagaccattacctagaacatcctaatcgaaaactcctctctagctacgcacccacacagacacagtccaccactgctactccatggagacagcaggtcagacgacactccaggaaagcgctgtgcacgcccggaggcaggcggcgtgttggtggcctttggacaccacggcatgcagcagcttggacttggacgacgcgagcaccttcagcagcagcagcctcctccttggatgggaatgagatccacagctttgctgctttggtagtccccatgcccgagactctgagctcttcggccccacatgcatggagtctccggtgtccgaagcgtcagcagcggcggccaccgggaagctggacgatgaactactactcatgagcctggtggggcgagtggcaacctcttcagttcctgcagcgcttctcagggaaaagagggccccttcttcccaaggtatcctaaaaatttacaaccgggtttaaattgcccccaactttccaagggctttctttggcccccccacccgtttaattaaaaggttggcccgcgcgttcccttccccccgggggttttttttcccgaccccggaggtttggaaacaaaaaaaaattgcgcgttgtgtataaaaaaaaaaaaaagttttttctccccccccccccggga

SEQ ID NO: 42055 - protein, 52 aa, Zea mays
  misc_feature: Ceres CLONE 1439223-F
METAGQTTLQESAVHARRQAACWWPLDTTACSSLDLDDASTFSSSSLLLGWE

SEQ ID NO: 42056 - DNA, 834 bp, Zea mays
  misc_feature: Ceres CLONE 1439225-F
  misc_feature: Encodes the peptide sequence at SEQ ID NO. 42057
tatccgcgagcccaacccattcttaccccaatgtcgtattccctatcagagtggagctcaccacggtggcggtcgctcttacctagtggatcccccgggctgcaggatttcccacgagaccattacctagaacatcctaatcgaaaaacacggcgcaaatccccacaaccccaagcgggtgggcggacttccacccaccttctcgcgcggcgacgtgctcggctcgcttacagccacctcgctcgccgcccgcctcggaatctccgccgcgagatcttgttctctgtctgatggaggccagaaccgtaaaagtcaccaatctttcattaaatgcttcgcaaaagagagatcacatatttcttcggtttctcaggagatatagaatatgttgaaatgcacagtgaatcttactgtccacacttcgcttatgtcacattttaagactcgtgaggagtatatacccgcccctcttttcttctgcggccacaatcgctgcatcgtgcctgccatcccccctcctcgctgagtaactatctcccgcctcctggaaggacaaccaaatacgttatcgcgacgtcgaaggacttcctcttggaatcagccaataaccccatgtcacaaccacgttgccgataaattatcgtttttcccagggccctcgttcattcaaaaccccccgtaccctccacctgtaacaaaatttatccggaggaacgatgaaccaccctccctatagttaaatgccccttgtataccatacgcccttcctgcgaaactgaccccatcattccccatgatccccataaacccacttattctcccgaaagcgcccat

SEQ ID NO: 42057 - protein, 36 aa, Zea mays
  misc_feature: Ceres CLONE 1439225-F
MLRKREITYFFGFSGDIEYVEMHSESYCPHFAYVTF

SEQ ID NO: 42058 - DNA, 708 bp, Zea mays
  misc_feature: Ceres CLONE 1439228-F
  misc_feature: Encodes the peptide sequence at SEQ ID NO. 42059
  misc_feature (469)..(469): n is a, c, t, g, unknown, or other
  misc_feature (522)..(522): n is a, c, t, g, unknown, or other
  misc_feature (674)..(674): n is a, c, t, g, unknown, or other
  misc_feature (675)..(675): n is a, c, t, g, unknown, or other
agctccccgcggtggcggccgctctagaactagtggatcccccgggctgcaggaattcgcacgagaccattacctagaacatcctaatcgaaaagcagattctctggttgctacgagttcttcgcctggtttttgggcaaggccaaaatttctgatttttttccaccgccgcaaacccctttgctgtgccataccgccattccattcctaagctgggcgtgggcgggtgaagaaaggaagcgaggccggctgtttcgctgaaaccccgccgcctttttttccttttcttttctggacctgattgaagaaccgtagcaaattaggggagggaggagcggcggcggccggtcggtcggtcagtatgattcacctgctgttcctcgtgctgttcgcggagggcgcggtagcgctgctcctcatggtgaaggtcgggccgctgctggagctggcgatgcgcgtcgtggaccangtgaagacgggcaagggccccgcaacctgtcagacgctggcatgcacgctctncgtcatcctcatgtccaacgtcgccagcatccctcagatccagaatcgtgggctcaagcttcgcaccgtcagccctatgaaccaggtgctctggagaacgcacctcctcgaagcatccctcatcggaaacccgctattccttgcatttgaanntcgacggctgcaccactacctccaaaggctgaa

SEQ ID NO: 42059 - protein, 115 aa, Zea mays
  misc_feature: Ceres CLONE 1439228-F
  misc_feature (36)..(36): Xaa is any aa, unknown, or other
  misc_feature (54)..(54): Xaa is any aa, unknown, or other
  misc_feature (105)..(105): Xaa is any aa, unknown, or other
MIHLLFLVLFAEGAVALLLMVKVGPLLELAMRVVDXVKTGKGPATCQTLACTLXVILMSNVASIPQIQNRGLKLRTVSPMNQVLWRTHLLEASLIGNPLFLAFEXRRLHHYLQRL

SEQ ID NO: 42060 - DNA, 646 bp, Zea mays
  misc_feature: Ceres CLONE 1439233-F
  misc_feature: Translation starting site: 139
gcgggaatttccacgagaccattacctagaacatcctaatcgaaaaagaggcgcctagtcgaaattaaggactatctcagcgatttccgaaccctccccacccccacacccacccgatccaaccgagtcccggcggcgatggcggcggcgacgaacgccgatgtggaggtggtcgacttcgacctcgatgacgacgacctcatggacgaggacgccgggccagatccagcaccgccccccgcctcccgcctccgctccaccatcgcgggcgacgacgcgccgcgtaggaccaagggccgcggcttccgcgaggaccctaactcctccgctacccgcgactcgcgctttggcgcggggggacgcccccacctcgactcgtttggcggcccaggacccatccagtcaattgaagcgatggattgtgttggtcacaggagttcacgaataagctcaagaagatgaccttcaaaatgctttccaagaatttgggcaggtcaaacacctgcatttgactttggaccgccgccccggatttgtccaagggtactctcttattgaatacgacacgcttgaagaagctcaggctgcaataaaagacctgaatggagctgaactctataaacaaagaatgagtgtcgattgggca

SEQ ID NO: 42061 - DNA, 705 bp, Zea mays
  misc_feature: Ceres CLONE 1439234-F
  misc_feature: Encodes the peptide sequence at SEQ ID NO. 42062
  misc_feature (272)..(272): n is a, c, t, g, unknown, or other
  misc_feature (705)..(705): n is a, c, t, g, unknown, or other
ggcggccgctctagaactagtggatcccccgggctgcaggaattcgcacgagaccattacctagaacatcctaatcgaaaagaattggattactcccctcccggacaaaacggggcgagagcgcatggagagcagagaggaggagaggaagggcagcggtggcgccgccgccggcggcggctcgacccctggggcgaatctaagggacctggtgtcgagggaatactacggccacaagaagaaggtgcactctgtagcatggaactgcctangcacaaagcttgcttcaggatcgatcgatcataccgcacttgtctggagcattgatccacatgtccattctaaggttaaagatattgaactgaaaggccccccagatagtgtagatcagctttgctgggatccaaatcatcctgatacatgtgctactggcgctgctgacaaatctattccgtctttgggaagctcgaaggggaaaatggtcagttgtggaccttagggaaaaaaaatcccacttccctataaacctggtgggccccaaatgcttgtggaaacaaggggggagaaccgaccaattttgggtgttaggaccctctaagggtgtctaaaaaccccggtcctcctttacaaaaaaaaagaaatttttttgggaaaaaactggggaaacttttctctcctataccccggggggtagggccacctttn

SEQ ID NO: 42062 - protein, 124 aa, Zea mays
  misc_feature: Ceres CLONE 1439234-F
  misc_feature (28)..(66): Pfam Name: WD40 Pfam Description: WD domain, G-beta repeat
  misc_feature (50)..(50): Xaa is any aa, unknown, or other
MESREEERKGSGGAAAGGGSTPGANLRDLVSREYYGHKKKVHSVAWNCLXTKLASGSIDHTALVWSIDPHVHSKVKDIELKGPPDSVDQLCWDPNHPDTCATGAADKSIPSLGSSKGKMVSCGP

SEQ ID NO: 42063 - DNA, 691 bp, Zea mays
  misc_feature: Ceres CLONE 1439238-F
  misc_feature: Encodes the peptide sequence at SEQ ID NO. 42064
tccccgcggtggcggccgctctataactagtggatcccccgggctgcaggaattcgcacgagaccattacctagaacatcctaatcgaaaaagacgagagcaggaggacggagagcgccggcgaggaggcatggagccagacaaggccggggaggcagcgaaggagccgacggaaacggaggctggagactccgtggatccccgcgaactagtgtccagcgacgacgagatcgactactccgtcgagcctgatttctacgaccccgacctagatgacgtcgatgagcggtgggtgagcagacagaggaaaggccgcacatctgacgccgtgcttagctgccccgcctgtttcactaccctgtgcttggattgccagaggcatgagaagtacgtaaaccagtaccgtgcgatgttcgttcgcaactgcaagatcaagactgaccaggtcctgcgagagggcaagagcaagaggaagaaacgcagaggaggaagggctggtgatccagctgccgcatctgaaggcgaaagcaaggggcagtcctaccaccccgtctgctgcgaggtctgctcaaccgaggttggagtgttggacgaggacgaggtgtaccacttctttaacgtgatccctagcaactcctgaatgccgtgaactgttgctctgtaggagtggtacgttcgtagtcgtagaccc

SEQ ID NO: 42064 - protein, 169 aa, Zea mays
  misc_feature: Ceres CLONE 1439238-F
MEPDKAGEAAKEPTETEAGDSVDPRELVSSDDEIDYSVEPDFYDPDLDDVDERWVSRQRKGRTSDAVLSCPACFTTLCLDCQRHEKYVNQYRAMFVRNCKIKTDQVLREGKSKRKKRRGGRAGDPAAASEGESKGQSYHPVCCEVCSTEVGVLDEDEVYHFFNVIPSNS

SEQ ID NO: 42065 - DNA, 704 bp, Zea mays
  misc_feature: Ceres CLONE 1439240-F
  misc_feature: Encodes the peptide sequence at SEQ ID NO. 42066
  misc_feature (447)..(447): n is a, c, t, g, unknown, or other
  misc_feature (561)..(561): n is a, c, t, g, unknown, or other
  misc_feature (562)..(562): n is a, c, t, g, unknown, or other
  misc_feature (605)..(605): n is a, c, t, g, unknown, or other
tccccgcggtggcggccgctctagaactagtggatcccccgggctgcaggaattcgcacgagaccattacctagaacatcctaatcgaaaacaaggaccaagttgcagaagctaagaagcaaaatgaagaggctgctgatgatatggatggttttgatgctgatgaagaagatgatgacgaagttgactctgataaggagatgggtcttgatgatgaagacggggatgaagtaagcagtcttcagctgcagaaattagccgcagaggctagaggcttccaaccagccgatgacgatgactcagatgatgatttcagcgacgatgagctacactcaccaatagacgaggtggatcctttcattttctttgtagaaactgtccaaggtttgcaggcatctgatcctgccaggttccagaaccttatgcatacattggatttttcttatncagcgcttgctagtggcattgcacaacatgccgagcaaagaaaaaatgaaattgagaaggagaaatctgagaaggcaaatgcacagtgacgtcataaagcatttctgggtcccnntcgatgtttttgcattttgccggtatagcattggtggacggtnaattttctgcgatttgcaggcccgcaggtagagtttttgcagccttagccaaggtggtaggacaaatcattcttgtgaaaaagcatccttggataactg

SEQ ID NO: 42066 - protein, 130 aa, Zea mays
  misc_feature: Ceres CLONE 1439240-F
  misc_feature (102)..(102): Xaa is any aa, unknown, or other
MDGFDADEEDDDEVDSDKEMGLDDEDGDEVSSLQLQKLAAEARGFQPADDDDSDDDFSDDELHSPIDEVDPFIFFVETVQGLQASDPARFQNLMHTLDFSYXALASGIAQHAEQRKNEIEKEKSEKANAQ

SEQ ID NO: 42067 - DNA, 941 bp, Zea mays
  misc_feature: Ceres CLONE 1439243-F
  misc_feature: Encodes the peptide sequence at SEQ ID NO. 42068
ggccctcttccccccccccgctttccccgacccgcctcatcccatacttataatagtggggctccccgcggtggcggccgctcatccctagtggatcccccgggctgcaggtatttcgcacgagaccatacctagcacatcctaatcgaaaaaacgcacccaggatatacagcgagcgagcgaccaaagccatggatctccgcaccctggcatcgaagaaggtcctatccttcccgttcggcggcgcgggccggccgttggcggcggcggcgtctgcaaggggggtgacgacggtcacactccccgacctctcctacgacttcatcgcgctggaaccggtcatctcgggagagatcatggcgcttgtaccacaagaaagcaccagttactactaccgtcgcccaaatacccacaaggcggcttggaacaagtttggaaactggccgttctaccggggggggaaggcctgacggctgtgcggcccccccctaagcgaaggctgcgcaatcacgggtgcgaccaggggggggggggtctaatggtcaaacactatttgaagtcctctctaggagaaaaaaacccccccaaaccccccatatatacggtaaacgcgggggtgggggggcacacccgctctttttctggggaaaaaaccttgccgccgggggcgcgccatacgacaggcgctggattctcttgctcggccggcctctgaaagacgccctcccctcaaaagaaaaacacacaaattgacataagacgggcgtgtatctcttacacaaagaggcgcttaggagatgggcggacgcggccacccctattatgcgccccaaaaagtcgcgaaaacaaagtgctctagtgtggtgaaaacccaagcacttttaccacaagaccccctccggcgcgcaaccaagcggctcaaaagtcaagtaactccgtcg

SEQ ID NO: 42068 - protein, 92 aa, Zea mays
  misc_feature: Ceres CLONE 1439243-F
  misc_feature: SWISSPROT Homolog: EC 1.15.1.1 Superoxide dismutase
MDLRTLASKKVLSFPFGGAGRPLAAAASARGVTTVTLPDLSYDFIALEPVISGEIMALVPQESTSYYYRRPNTHKAAWNKFGNWPFYRGGKA

SEQ ID NO: 42069 - DNA, 704 bp, Zea mays
  misc_feature: Ceres CLONE 1439250-F
  misc_feature: Encodes the peptide sequence at SEQ ID NO. 42070
  misc_feature (496)..(496): n is a, c, t, g, unknown, or other
ggagctccccgcggtggcggccgctctagaactagtggatcccccgggctgcaggaattcgcacgagaccattacctagaacatcctaatcgaaaaaaaacccccctctttgtgctgtttcttctcgccgccgccgccgccgtcgttgccgctagccggcgtagctgataggaaacctgaccacctgagccttctgtagaccagcctcagcgcaactcccaaccacttctcttatggcgctcctccttcgccgaggcgtggccctcgccgcccgctccttccgcgccgcggccgcctcctccgcttccaccactgtgcaccgcctcccagccggggcgtcccttgcgggcgccggggaattggctccggcgcagctcttcttcttcgagaaccgaagaggcttcgcgaaggggaagaaatcgaaggatgatcgaggtgacactgttcaagctgttcctgacattgggccaactgtcaaatcagctgccaccgcacnaatggacgctgcagtgatcgcactgtcacgagagctgagcaaaactacgactggaagagctacacctggcatgcttgaccatatcatggtggagaatgcaaaatgtaaagtttgcattgaatcgcattgccgttgttttctgtcctggacccccattaccttatccgggatgccttatggatcctacttccaggaaagcgaatcgagc

SEQ ID NO: 42070 - protein, 157 aa, Zea mays
  misc_feature: Ceres CLONE 1439250-F
  misc_feature (88)..(88): Xaa is any aa, unknown, or other
MALLLRRGVALAARSFRAAAASSASTTVHRLPAGASLAGAGELAPAQLFFFENRRGFAKGKKSKDDRGDTVQAVPDIGPTVKSAATAXMDAAVIALSRELSKTTTGRATPGMLDHIMVENAKCKVCIESHCRCFLSWTPITLSGMPYGSYFQESESS

SEQ ID NO: 42071 - DNA, 474 bp, Zea mays
  misc_feature: Ceres CLONE 1439251-F
  misc_feature (219)..(219): n is a, c, t, g, unknown, or other
tccccgcggtggcggccgctctagaactagtggatcccccgggctgcaggaattcgcacgagaccattacctagaacatcctaatcgaaaagcgccgtaccgccggcctctccccgttcttctccaatggcgtcgactcacgcaatcagcaagaagcggaagttcgtggcggatggccttgttcttcccggagcttgatggagatgcttgaccccccangctcccggaaggatggttcctccgggggttaaaggtcccgcgtccccccccctgggggcccccggaaaaatatttttcccgggggcccccccccacactcaaaaaattttttctccggaaaaaaaaggggccccgggggagaatccggggggtgcccccacccctcttggggggggaaaaaaaaaaagggttttttaacacccctcccgcccgggggggggggggggggggttttttacacccccccccccccca

SEQ ID NO: 42072 - DNA, 763 bp, Zea mays
  misc_feature: Ceres CLONE 1439252-F
  misc_feature: Encodes the peptide sequence at SEQ ID NO. 42073
ggagctccccgcggtggcggccgctctagaactagtggatcccccgggctgcaggaattcgcacgagaccattacctagaacatcctaatcgaaaaaccgatcacaaaaccaatcgcggagattcaatcacgtacgtatacacacggccacacgggcacgtagctagctagcagtcgtagcgtgacgatgagggttctctctgttgcggtcgctctggtcgtggtggtggccgcggcctgcctcgccgcgccgcggggcgcggacggcgcgggcgagtgcggtgcgacgccgccggacacggtggcgctgaggctggcgttgtgcgcgtcggcggcggaggaccccggctccgcgccgtcccgctcctgctgcagcgcggtgcacgtaatcgggaagcagagccccaggtgcctctgcgccgtcctgcttgccaaccacgccgggagcgcggggatcaagggccgaggtcgccatcacaatccccaaaagctgcaaccttcccaaaacgccccgtttggctacaaagggcgaaaattacactcctgccctggagcggggggggaaggccccccggcccggaattttttcgcatggggatgccccaaaattaacccaaaaacgcgaagcttctttgttttaaagagaaaccccggttttttgcccccacactcctccttaggggtgccccccaaaataaaaaaaaaaatttggcgaaaaaccaaaaaatggggggcacatttttaaaaaaagaggggcggtgta

SEQ ID NO: 42073 - protein, 185 aa, Zea mays
  misc_feature: Ceres CLONE 1439252-F
MRVLSVAVALVVVVAAACLAAPRGADGAGECGATPPDTVALRLALCASAAEDPGSAPSRSCCSAVHVIGKQSPRCLCAVLLANHAGSAGIKGRGRHHNPQKLQPSQNAPFGYKGRKLHSCPGAGGEGPPARNFFAWGCPKINPKTRSFFVLKRNPGFLPPHSSLGVPPKIKKKIWRKTKKWGAHF

SEQ ID NO: 42074 - DNA, 810 bp, Zea mays
  misc_feature: Ceres CLONE 1439253-F
  misc_feature: Encodes the peptide sequence at SEQ ID NO. 42075
ggagctccccgcggtggcggccgctctagaactagtggatcccccgggctgcaggaattcgcacgagaccattacctagaacatcctaatcgaaaacacttctggtgaaattgcagatctcaccttagttgcctcctccgtcttcgctccctccgcagcgtcagatcggccgtcgctcgccgagccctagcgccgccgatctcagcccgtaccagtcttgcagatcggggtcgcgccgcggcggcaagaacgatggccgaggaggccaagtacctggagactgcgcgggccgaccgctccgtgtggctcatgaagtgccccccggtcgtctcccgcgcctgggaggccgcctccgcccttcgcctcttcctccgggggcgggtaacgcccacccccgttggcccccaagggccccccttttcccttccacctgctccccccacaaaaaaacccccctaaagaaacgccccggaagaaccccccccctcccatttacaggagtgggtttggcggaccaaactaggccgtggggaaataccccccctaaaacctcacctctttgaagatatggctcccaaagattttcgcgggcccctggtgggggtttttcgcccgaactccttggtggggggaagcctctttccgggcgaggagagagagcggccaccctatttttttacacgtgggaaaccccccacgggagggagacctttctgcgggaatatggagggaatgctctgcttctcttagagaacaccccgccgaatattcgtttgtttcacgccactgagacgaaggaatcaccctctg

SEQ ID NO: 42075 - protein, 60 aa, Zea mays
  misc_feature: Ceres CLONE 1439253-F
MAPKDFRGPLVGVFRPNSLVGGSLFPGEERERPPYFFTRGKPPTGGRPFCGNMEGMLCFS

SEQ ID NO: 42076 - DNA, 709 bp, Zea mays
  misc_feature: Ceres CLONE 1439254-F
  misc_feature: Translation starting site: 184
  misc_feature (373)..(373): n is a, c, t, g, unknown, or other
  misc_feature (374)..(374): n is a, c, t, g, unknown, or other
  misc_feature (402)..(402): n is a, c, t, g, unknown, or other
  misc_feature (427)..(427): n is a, c, t, g, unknown, or other
acccgcggtggcggccgctctagaactagtggatcccccgggctgcaggaattcgcacgagaccattacctagaacatcctaatcgaaaagtcagccccttctccggcaacgagcacctaacaggctgaaaaaaaatcattgatacacgtacgccgtcagaggctgcagtatattctgtgagaatggcatggggtcaaggtgctaagaggtccatactagggcttctctttcgttctcagcaccaaactgctcgggcatactcttcttcagcattccagactcaccaattgagcactcatgttccccaagatggagtgtttattaggagattcggctctgaggtgtcttcttcagagcaaatgaaccttattnnagcactcagacaaagaacgagtgctccnaatcaaagatgtcaggcctctctangtaccctgcactgggatattgaggctgcacagaaggacctagggaagagaggtgttgctcttgctgccaaaaagtcttccacccactgctgctgaaggtttgctagctatcccaaagaatgaaaaaggggctgcttgaatttagcttaactgggaaactgatttcctaacaagaaagagggttttccaaaccttgggttcacctttggaaaaaaagggttttttcgccccagggcccggggaaattttcacaccctttggccccaaacttttaaaaaaccag

SEQ ID NO: 42077 - DNA, 761 bp, Zea mays
  misc_feature: Ceres CLONE 1439261-F
  misc_feature: Translation starting site: 167
  misc_feature (427)..(427): n is a, c, t, g, unknown, or other
  misc_feature (464)..(464): n is a, c, t, g, unknown, or other
aagctggagctccccgcggtggcggccgctctagaactagtggatcccccgggctgcaggaattcgcacgagaccattacctagaacatcctaatcgaaaaacgcgaatcctccaatctgcccttgccgccgactgctcactcctctccggtccgctccactccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatcccgcagtaccagaagagcacggagctgctcatcccgcagctcccctttcagcgcctcgtccgcgagatcgcgcaggactttcagaacgacctgcgggtccagtcntcggcggtggcgggccctccaggaagccgcggaggcntacctgttgggggttcttcaagaaacccaccttttggcccttccagcccaaaaggggccccatttgcccaagggaatccccctttccccccccattaaggggcaaaaggtgttaactttcccccctctttttctcccctttaaatttttaaaaaaaaagggggggccttttaattggggggccactagggggggtttttcccccaccaaaaaaggaaaccccccccccttctccacaaaaaaaaaaaaaaaaagaggggggcccccttttgggcgccccaacccaacaaaagaaaaa

SEQ ID NO: 42078 - DNA, 726 bp, Zea mays
  misc_feature: Ceres CLONE 1439263-F
  misc_feature: Encodes the peptide sequence at SEQ ID NO. 42079
  misc_feature (364)..(364): n is a, c, t, g, unknown, or other
tacccgcggtggcggccgctctagaactagtggatcccccgggctgcaggaattcgcacgagaccattacctagaacatcctaatcgaaaaaccgccgcggcttccttctctacccttccctcgcgccgccgccaccgcaagagtatctcaactccgcctcgagacctccccccctcgctggtctcagccatggtgaaatattcgacggagccgtccaaccccaccaagtccgctaaggccatgggccgtgacctacgtgttcacttcagaacacacgtgagacagcttttgcccttagaaagtgtcactcaccagggctaaaagtaccttgaggatgtgatcgccccacagcaggccatcccngttcgcaggtattggggtggtggtgggcgcactgctcaggcttagtttcgccactcaaatggtcaagaacccttgcctttcaagctttctaaattcattcaaaaccttccaaaaatgcaaaaagcattttttaggtaaaagggctttaaggggaaccccctcaatggggcccccatttcaatttaacggggcccaaaaccgcccccccgggaaataccgggtcttaggagcctaaacctttataattctcccccctggccaaaaaaaattctttttttgggaaaaaaaaaaaccctgaaaaaaagggggggtttttttatttccccccaagggtgttttaaaagggttttctttttctttgg

SEQ ID NO: 42079 - protein, 43 aa, Zea mays
  misc_feature: Ceres CLONE 1439263-F
MVKYSTEPSNPTKSAKAMGRDLRVHFRTHVRQLLPLESVTHQG

SEQ ID NO: 42080 - DNA, 755 bp, Zea mays
  misc_feature: Ceres CLONE 1439264-F
  misc_feature: Translation starting site: 186
  misc_feature: Pfam Name: Cpn10 Pfam Description: Chaperonin 10 Kd subunit
  misc_feature (284)..(284): n is a, c, t, g, unknown, or other
  misc_feature (335)..(335): n is a, c, t, g, unknown, or other
ctggagctccccgcggtggcggccgctctagaactagtggatcccccgggctgcaggaattcgcacgagaccattacctagaacatcctaatcgaaaagtgttgaggcgagtggaagcttcgagttttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctccctccggaacatccnagcagctgaatgctgctaaagtggtggctgttggccctggtgagcgcgacnaggcaggcaatctgatcccagttgctctgaaagaaggggaccctggtctcctgcccagagtatggtggaacttgaatttaagcttgcagctgaaaaagagtaacctccttttccaaaaacccaaaattttgggccccctttggggactgttttaaaaactcgggggccggggcctaagggttgggtttcaaacctttggggggggaagggggaaaaacaaaattcgggggaaaaaacccccaaaaactttagaaggtgggggagggtaaaaattttgggggaaaaaaacaaaaaatagcccgcctcttttgtggcacaaacatttttttttttaaaagggggccaaaaaaaaaaaaaaaaaaaaaaaaaatttttttttccccccccccccgcggggggggcggcgccctccccccctcc

SEQ ID NO: 42081 - DNA, 724 bp, Zea mays
  misc_feature: Ceres CLONE 1439267-F
  misc_feature: Encodes the peptide sequence at SEQ ID NO. 42082
tccccgcggtggcggccgctctagaactagtggatcccccgggctgcaggaattcgcacgagaccattacctagaacatcctaatcgaaaaaaatttcccaaacgcaaaaccgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcggggtcgtcgtcatgggcttcgtcggctttcttcgtaagctcatcttcatccccatcaacacatcatcgtcgggttcgggctagcttacaaggagtacaggcccactaccatgggaatagggcaattctttttgggaccaataaaaaacgagaaccctgggcttttcgatatgaatgggaaaagaaattttttccctccgggggggtttccaaaggaaacccgtggaacggaaaaaccctttggggaacccgggattttggaaaaccctttagacccctggggggagcccccccctccgggaaggggttttttcaaaaaaaaaaaaaaaaaaattttttttttcccccccccccccgcggggggggggcggggagcccaattttctctcaaaaaaggggatataataccccccccccgcgcggggcgctttt

SEQ ID NO: 42082 - protein, 69 aa, Zea mays
  misc_feature: Ceres CLONE 1439267-F
  misc_feature (10)..(66): Pfam Name: SecE Pfam Description: SecE/Sec61-gamma subunits of protein translocation complex
MDAIDSVVDPLRDFAKDSVRLVKRCHKPDRKEFTKVAARTAIGVVVMGFVGFLRKLIFIPINTSSSGSG

SEQ ID NO: 42083 - DNA, 745 bp, Zea mays
  misc_feature: Ceres CLONE 1439284-F
  misc_feature: Encodes the peptide sequence at SEQ ID NO. 42084
ggagctccccgcggtggcggccgctctagtctagtggatcccccgggctgcaggaattcgcacgagaccattacctagaacatcctaatcgaaaattgaattatccggccatctccgcggtcttcgcggagcagccatctgctgcgctgacggtgcgtcgcaccgtgacgaacgtcggcccaccgtcttcgacttaccatgtcaaggttacagagttcaaaggcgcagacattgtcgtcgaaccaagcaccctgcacttcacaagctcgaaccagaagctaacctacaaggtgacgatgacaaccaatgctgcccagaagacaccggagttcggagcgctgtcctggagcgacggcgtccacatcgtccgggagccccccttgtcctccatggctgccacccatgtgaccttcccttattttcccgggcgtttaaagccagccaatgggagcaggaacctttctgggccctgggtaatcaaccccaaaaatccctttttgtccccacgggaaggggcagaaaccgtttccctaacccacggaaaaaatcgtggcaaatctcccaagaaaacccgcctttttctcccaggggttccgccctatttcaaagggttccctttcgccctttaaattttcctcccacaacgggggccccaaaaaaatgggaaacaaatttccggaaaaaatttcctgcaaaaaaaaaaagaaaaagattttttttttccctcccccccccgggggggggg

SEQ ID NO: 42084 - protein, 110 aa, Zea mays
  misc_feature: Ceres CLONE 1439284-F
MTTNAAQKTPEFGALSWSDGVHIVREPPLSSMAATHVTFPYFPGRLKPANGSRNLSGPWVINPKNPFLSPREGAETVSLTHGKNRGKSPKKTRLFLPGVPPYFKGFPFAL

SEQ ID NO: 42085 - DNA, 746 bp, Zea mays
  misc_feature: Ceres CLONE 1439288-F
  misc_feature: Encodes the peptide sequence at SEQ ID NO. 42086
ggagctccccgcggtggcggccgctctatactagtggatcccccgggctgcaggaattcgcacgagaccattacctagaacatcctaatcgaaaaaccccgagccgccaaaaccctaccgccgccgcgaatcccgcacgaccccaaccatgaccgtgctgagccgccctaccccgggcacgacccagtgcttcgggcggaagaagaccgccgtcgcggtcgcgtacacgaagccggggcgcggcctgatcaaggtgaacggcgtcccgattgagctgatccgaccggagatgctccgcctcaaggccttcgagcccatcctgctggcggggcggtcccggttcaaggacatcgacatgcggatccgcgtccgcggcggcgggaagacgtcgcagatctacgccatccgccaggccgtcgccaaggggctcgtcgcctactaccagaagtacgtcgacgagggccgccagaaaggagatcaaggacatcttttacccgctacaaatcgccccctcctcgtcgctgacccccggggctgcaagccgaaaaaattccggcggacgtggggcccgcgcccgggttcagaaatcctaaccttgaacgggggcccggcccctctccgatttttcaaaagccggggggggggtcctccgccttatttccccacaaaggggactgggttttcgggggtctaaattagggggggggttttaccaaaaggtgtaaacttttaggcgccccccccgg

SEQ ID NO: 42086 - protein, 181 aa, Zea mays
  misc_feature: Ceres CLONE 1439288-F
  misc_feature (16)..(142): Pfam Name: Ribosomal_S9 Pfam Description: Ribosomal protein S9/S16
MTVLSRPTPGTTQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEGRQKGDQGHLLPATNRPLLVADPRGCKPKKFRRTWGPRPGSEILTLNGGPAPLRFFKSRGGGPPPYFPTKGTGFSGV

SEQ ID NO: 42087 - DNA, 854 bp, Zea mays
  misc_feature: Ceres CLONE 1439316-F
  misc_feature (34)..(34): n is a, c, t, g, unknown, or other
  misc_feature (43)..(43): n is a, c, t, g, unknown, or other
  misc_feature (416)..(416): n is a, c, t, g, unknown, or other
  misc_feature (465)..(465): n is a, c, t, g, unknown, or other
  misc_feature (467)..(467): n is a, c, t, g, unknown, or other
  misc_feature (474)..(474): n is a, c, t, g, unknown, or other
  misc_feature (495)..(495): n is a, c, t, g, unknown, or other
  misc_feature (497)..(497): n is a, c, t, g, unknown, or other
  misc_feature (504)..(504): n is a, c, t, g, unknown, or other
  misc_feature (535)..(535): n is a, c, t, g, unknown, or other
  misc_feature (542)..(542): n is a, c, t, g, unknown, or other
  misc_feature (543)..(543): n is a, c, t, g, unknown, or other
  misc_feature (550)..(550): n is a, c, t, g, unknown, or other
  misc_feature (551)..(551): n is a, c, t, g, unknown, or other
  misc_feature (632)..(632): n is a, c, t, g, unknown, or other
  misc_feature (655)..(655): n is a, c, t, g, unknown, or other
  misc_feature (656)..(656): n is a, c, t, g, unknown, or other
  misc_feature (665)..(665): n is a, c, t, g, unknown, or other
  misc_feature (708)..(708): n is a, c, t, g, unknown, or other
  misc_feature (709)..(709): n is a, c, t, g, unknown, or other
  misc_feature (717)..(717): n is a, c, t, g, unknown, or other
  misc_feature (766)..(766): n is a, c, t, g, unknown, or other
  misc_feature (854)..(854): n is a, c, t, g, unknown, or other
aatggccccctcgatcttgggtacgcacagaatnaaccttggngggtttatagtggaagtcccgcggtggcggccgctctttcatagtggatcccccgggctgcctgtatcgcacgagaccattacctagaacatcctaatcgaaaaacaaagagtgcgagcaagatttatgtattttcagacgattggatcgaattacttattacggcgaaggagacatcttccaccccactgcatccagcaagtgtacggaatggcttcttgctcctctgtccgcgccgcaccatcggtccccgtctcggcgccgcctaggccgcggctgcggagtacggccgaaagtcatcgggttgttccccgcagcagggccgtctcctgccgcctgcgccgtaccctctggggcggggcccggtgggggncaaggcccctgccaaagctgggcggagctgtgggtcggctggcgaagancnacacccncccccggcccgtgactccgcngncgcttgntggaggccggaaagggaatacaccaagggcncacgagnnaagaccnnccttggtaattgtgatcattccccccagcccccgccccgggcggggaggcccccagaaaggaggatcgcccgccctacgcnttccttcccaacccctttacaanngggaggggngagaataaatgggtttttaggaaaatttacggcgggccccganntggggagngagttccgcaaaaaattcggttgcttcaattttgccatgtccggggccnggaattcgaatgaatgtgtttcatacgcgcccttccatgctccaaagacagccagttgcgaccgacttatcgtccaccacgcgcctgn

SEQ ID NO: 42088 - DNA, 693 bp, Zea mays
  misc_feature: Ceres CLONE 1439318-F
  misc_feature: SWISSPROT Homolog: EC 3.2.1.23 Beta-galactosidase
ctccccgcggtggcggccgctctagaactagtggatcccccgggctgcaggaattcgcacgagaccattacctagaacatcctaatcgaaacattgtcctcagcggtggatccaccatgttccctggcatcgctgaccgcatgagcaaggagatcaccgcgctcgcgccaagcagcatgaagatcaaggtcgtcgctccgccggagaggaagtacagtgtctggattggaggatcaatcctcgcatccctgagcacattccagcagatgtggatctcaagggctgagtatgaggagtctggtccagctattgtccacaggaagtgcttctagacatcacctagccttgttctcctcgtggaaatgcctttgtttcatgacatatctatgggtggtcgctctgctacagctcgcagttttttgtgtatgccacaagccgcatatatatatatatatatatatatatatatatatatatatatatatatccattctggtaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcaa

SEQ ID NO: 42089 - DNA, 727 bp, Zea mays
  misc_feature: Ceres CLONE 1439322-F
  misc_feature: Translation starting site: 143
  misc_feature: Pfam Name: Rhodanese Pfam Description: Rhodanese-like domain
  misc_feature: SWISSPROT Homolog: EC 2.8.1.1 Thiosulfate sulfurtransferase
  misc_feature (349)..(349): n is a, c, t, g, unknown, or other
  misc_feature (385)..(385): n is a, c, t, g, unknown, or other
  misc_feature (397)..(397): n is a, c, t, g, unknown, or other
  misc_feature (398)..(398): n is a, c, t, g, unknown, or other
  misc_feature (418)..(418): n is a, c, t, g, unknown, or other
ggagctccccgcggtggcggccgctctagaactagtggatcccccgggctgcaggaattcgcacgagaccattacctagaacatcctaatcgaaaaagtacaaactcccgtcgtggcatctcaccgtttccaggatacgaccatgaggtcggccatcctgcttacgatctgcaccttgtccgcgctgctgctggtagcgcgcggctcggagaagccatcggccgcgccgccgccggtggtggccgtgggcgtggcggcggccagcgacctcatccgctccggcggtcaccgctacctggacgtcagaacagaggaggaattcaggagtgggcatgtggaggattcactncacgtgccctatcttttcttcacttcacaggaaggnagaagaatcccnnagtcatcgcacaggtcgcangcggtttcgacaaggagaacacatagtttgtgggctgcaaaaagcggaatgagtctgaattagcatgtgctgatctcatggcagctggatttaaaaatgtgaagaacatcgaagggggttaacccgcaggggtgaaaaggggccttgccccgaaaaaatttccagcccaaaaggaactaagaagggccacaacaggggggttctttcctgggtttaccaaaaccctttttaaaaaaaaaaaaggtttaagggggaaaaaaaaacctccctggggaattaaaaaaatagacccctttttttttccaacca

SEQ ID NO: 42090 - DNA, 671 bp, Zea mays
  misc_feature: Ceres CLONE 1439324-F
  misc_feature: Encodes the peptide sequence at SEQ ID NO. 42091
ggagctccccgcggtggcggccgctctagaactagtggatcccccgggctgcaggaattcgcacgagaccattacctagaacatcctaatcgaaaaacgcgaatcctccaatctgcccttgccgccgccgccgacggatccaggtctgtagactgctcactcctctacgctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcactgagctgctcatccgcaagctccccttccagcgcctggtccgcgagatcgcgcaggacttcaagacggacctgcggttccagtcgtcggcggtggcggcgctgcaggaggccgcggaggcgtacctggtggggctctttcgagacaccaacctctgcgccatccacgcccaagagggtcaccatcatgcccaaggacatccagctcgcccgccgcatcagggggcaagaggctggacctgtcccgctgctgttccccttggaaaaattggaagaggggggggtccctttccagggcggggttacggggggagggg

SEQ ID NO: 42091 - protein, 163 aa, Zea mays
  misc_feature: Ceres CLONE 1439324-F
  misc_feature (58)..(125): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFRDTNLCAIHAQEGHHHAQGHPARPPHQGARGWTCPAAVPLGKIGRGGGPFPGRGYGGR

SEQ ID NO: 42092 - DNA, 704 bp, Zea mays
  misc_feature: Ceres CLONE 1439328-F
  misc_feature: Encodes the peptide sequence at SEQ ID NO. 42093
  misc_feature (407)..(407): n is a, c, t, g, unknown, or other
  misc_feature (447)..(447): n is a, c, t, g, unknown, or other
  misc_feature (467)..(467): n is a, c, t, g, unknown, or other
cgcggtggcggccgctctagaactagtggatcccccgggctgcaggaattcgcacgagaccattacctagaacatcctaatcgaaaatcgaacgcatacactccaatggcagcgacggtgatggcctccatgagcccactcgcctccgccacccccggcgcgcgtcgcgatttccctgtacggctgctgctccaggcatctgcactcgcggcgcgccggcgcgccttggccgtgaccgtgagggcccagagcgacgacgccgaggccgaggcaaaggaggaggcggcgccggccaccaccccggcgccaaagtccaaggcggcggcgacggcgagccccgggctgtgggacgcgctggcgttcagcggcctggctcccgagcgcatcaacggccgcctcgccatggntgggcttcgtgtcggcgctcgccgtcgaagcgtcccgcgncggggggcctcctctcgcangccggcaacgggtccgggctcgcctggtttccggccaccggctgccgtgctttcctgggcctccctggggccccttctccagggccaacggccccaggccaagaacgcgccccttcttgagccccaaaccccaaatcttgaaaggcccctttcccatgtttgggcctttggggcgtcccttttagggaaaaaccccccgggcgcccgttttttaacggaaaaagggttttaattttt

SEQ ID NO: 42093 - protein, 197 aa, Zea mays
  misc_feature: Ceres CLONE 1439328-F
  misc_feature (101)..(101): Xaa is any aa, unknown, or other
  misc_feature (121)..(121): Xaa is any aa, unknown, or other
MAATVMASMSPLASATPGARRDFPVRLLLQASALAARRRALAVTVRAQSDDAEAEAKEEAAPATTPAPKSKAAATASPGLWDALAFSGLAPERINGRLAMXGLRVGARRRSVPRRGASSRXPATGPGSPGFRPPAAVLSWASLGPLLQGQRPQAKNAPLLEPQTPNLERPLSHVWAFGASLLGKNPPGARFLTEKGF

SEQ ID NO: 42094 - DNA, 692 bp, Zea mays
  misc_feature: Ceres CLONE 1439334-F
  misc_feature: Encodes the peptide sequence at SEQ ID NO. 42095
tggagctccccgcggtggcggccgctctagaactagtggatcccccgggctgcaggaattcgcacgagaccattacctagaacatcctaatcgaaaaaacacgcgcacatgtgacatgccccatggtcgccgccgctccaggcatcctcccgtggcctcacctccctctcccttcctcctcccacccgtctgacgcctctgacgccgccgcagcagcaacagacgccaacacctccgcgtatgacatccagatcttcgagcccacctccatcgaggagcgtcgtcgcctcctgatccagcggcgtcgcctccgactcgccgcctcccatgcctcgcggctcaccgttgcctcgcgcgtctcctccaaactcatcagcgccaccgcctcctgctccagcggcgtcgcatccgatctgccgcctcccctcctcatggatcgtcgttgcctcccgcctcttccccaacctcgcccttgccgcccttggaggatcccaaatccgacgactagctcagtaggcccacgcagacgcggatgtgctatgaacttcatattctgtatcgatggcaatgggttccagaacagtacacgaggcaatttcaagacggttattcaattgctcagatagctcagtaagtgagaacaaagaaacttcctaaatgtattaatatggtatgatgaatagtgtctcaca

SEQ ID NO: 42095 - protein, 33 aa, Zea mays
  misc_feature: Ceres CLONE 1439334-F
MCYELHILYRWQWVPEQYTRQFQDGYSIAQIAQ

SEQ ID NO: 42096 - DNA, 697 bp, Zea mays
  misc_feature: Ceres CLONE 1439337-F
  misc_feature: Encodes the peptide sequence at SEQ ID NO. 42097
  misc_feature (685)..(685): n is a, c, t, g, unknown, or other
tggagctccccgcggtggcggccgctctagaactagtggatcccccgggctgcaggaattcgcacgagaccattacctagaacatcctaatcgaaaagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcgccaccaagtacaggtgccgcgacttcctccccgaaaactgcggctgcaagatccactagactcatccacagcggcacagccgatggatccttccatgctcctccgtccgtccgccttgctacaagcaggcagccatcaataagctagctcttgttgttttgcatgtttgattgggtgtcccttcccactcgagatggaataaaataaatgtcaagcgcacgttaagacgtgttattacgatatttcccccctacaaataaaaactcgatctgtggggttaacactgtcccctagtattacaattaangaaaagatgtta

SEQ ID NO: 42097 - protein, 89 aa, Zea mays
  misc_feature: Ceres CLONE 1439337-F
MKSSTLLAILVLQALLVSAAVAKGPAGPTTKKQCWCGECTSWSGVWTCDDLLTKCAATCKNCVPVSTDKGATKYRCRDFLPENCGCKIH

SEQ ID NO: 42098 - DNA, 603 bp, Zea mays
  misc_feature: Ceres CLONE 1439342-F
  misc_feature (301)..(301): n is a, c, t, g, unknown, or other
  misc_feature (359)..(359): n is a, c, t, g, unknown, or other
  misc_feature (539)..(539): n is a, c, t, g, unknown, or other
ggagctccccgcggtggcggccgctctagaactagtggatcccccgggctgcaggaattcgcacgagaccattacctagaacatcctaatcgaaaaaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgatcgcgcggcggcgcggaagccctacgctagaactccccagacgggctcaccctgnagcagcgccgcgagagggactagaaagctctggaggagaaagcggctaaaaggcccancaggcagcggctgggggaccgttccttccacgaaaaaaacaaaaacaaggagggggcaaaaaaataaagaagcgggggcccccccccccccctttggacaaataaacgagcccttgaactttaaaatttgtccccaccctttggaggcgccaattttttttgggcccaaaaacctccccnaaaaaaaaaatcgaaatttgttggggaggaaaaaaaaaaaaggggggggggggtgttttttggt

SEQ ID NO: 42099 - DNA, 650 bp, Zea mays
  misc_feature: Ceres CLONE 1439372-F
  misc_feature: Encodes the peptide sequence at SEQ ID NO. 42100
  misc_feature (303)..(303): n is a, c, t, g, unknown, or other
  misc_feature (344)..(344): n is a, c, t, g, unknown, or other
  misc_feature (348)..(348): n is a, c, t, g, unknown, or other
  misc_feature (356)..(356): n is a, c, t, g, unknown, or other
  misc_feature (360)..(360): n is a, c, t, g, unknown, or other
  misc_feature (390)..(390): n is a, c, t, g, unknown, or other
tccccgcggtggcggccgctctagaactagtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcgaaggacggagtggtcnaacgggacccgcaggaggaccctgcgtgggtgcagcaggcntgcnagtggcantacngaaaagacaccccgcggaagaagggatgcnaaaacaagtgccccaagcggcaccaccaactaacccgggcaaggaccggaaaaagggggggaaccctaagtttcccccttcgggagggggaaggtccgccccattccttcccccccccaggggccccccgggaaaacccaaggttttggggggggcccccccccgaaatggccctaaaatgaaaaaaaaaaccccccccaaaaaaacgcgggaaatggggggaagggggcgccccccccccgggggggggggagaagccc

SEQ ID NO: 42100 - protein, 123 aa, Zea mays
  misc_feature: Ceres CLONE 1439372-F
  misc_feature (35)..(35): Xaa is any aa, unknown, or other
  misc_feature (50)..(50): Xaa is any aa, unknown, or other
  misc_feature (52)..(52): Xaa is any aa, unknown, or other
  misc_feature (54)..(54): Xaa is any aa, unknown, or other
  misc_feature (64)..(64): Xaa is any aa, unknown, or other
MGKGSVGASWWAFLLLAGVLLVVAATAGAKDGVVXRDPQEDPAWVQQACXWXYXKDTPRKKGCXNKCPKRHHQLTRARTGKRGGTLSFPLREGEGPPHSFPPPGAPRENPRFWGGPPPEMALK

SEQ ID NO: 42101 - DNA, 592 bp, Zea mays
  misc_feature: Ceres CLONE 1439381-F
  misc_feature: Translation starting site: 209
  misc_feature (376)..(376): n is a, c, t, g, unknown, or other
  misc_feature (583)..(583): n is a, c, t, g, unknown, or other
tagctggagctccccgcggtggcggccgctctagaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagttctgcaagaatattgttctagctggagttggaagtttatccttgatggatgataatgtantcacagaggaaggatctgaatgcaaatttcctaattcctcccggaagagaagcaaaatgggggggaaaaccccagccccagtttgggcgcgatcttttaaaaaatttctcaccccccgggggaaaaggtttccgtttgaaaaaggggggggcccccccccctttaatggggggggggggagaattttttctgttgggggagaagacnccccatctt

SEQ ID NO: 42102 - DNA, 661 bp, Zea mays
  misc_feature: Ceres CLONE 1439383-F
  misc_feature: Encodes the peptide sequence at SEQ ID NO. 42103
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (317)..(317): n is a, c, t, g, unknown, or other
  misc_feature (330)..(330): n is a, c, t, g, unknown, or other
  misc_feature (344)..(344): n is a, c, t, g, unknown, or other
  misc_feature (345)..(345): n is a, c, t, g, unknown, or other
  misc_feature (353)..(353): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (581)..(581): n is a, c, t, g, unknown, or other
  misc_feature (582)..(582): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaactgggactccccgcggtggcggccgctctagaactagtggatcccccgggctgcaggaattcgcacgagaccattacctagaacatcctaaatcgaaaaacaaggctaggcacaagcgaaccaaacccatggcgtccgaacggcagcggcgtggtgacggtgtacggcagcaacggcgcgaagctgctggagccngtcaagcagcccnaagtcgcgactttnnctcgtcangtggggctggcgcaaatgctcccggggcggggtcatcatggacgtggtgaccccgggagcagggcccgccttcccggaggaaagccccggccccggtgccccccttaatgggccccttgggaaaagggggttcccccccccccaaaaaaattctccnnncccccaaaaaaaagggggcgcccttttgggtgccccccgcctttttttttttaaaaacacacccggggnnttccctttctctccccccgccaaaaaaaaaaaaaaaaaaaaaggggggggccggcggcgaaaaacccccccccggtggc

SEQ ID NO: 42103 - protein, 50 aa, Zea mays
  misc_feature: Ceres CLONE 1439383-F
  misc_feature (23)..(23): Xaa is any aa, unknown, or other
  misc_feature (27)..(27): Xaa is any aa, unknown, or other
  misc_feature (32)..(32): Xaa is any aa, unknown, or other
  misc_feature (35)..(35): Xaa is any aa, unknown, or other
MASERQRRGDGVRQQRREAAGAXQAAXSRDFXSSXGAGANAPGAGSSWTW

SEQ ID NO: 42104 - DNA, 878 bp, Zea mays
  misc_feature: Ceres CLONE 1439384-R
  misc_feature: Translation starting site: 313
  misc_feature: SWISSPROT Homolog: EC 2.6.1.52 Phosphoserine transaminase
  misc_feature (760)..(760): n is a, c, t, g, unknown, or other
cgaattgggtaccgggcccgccctcgaggacgacggcatcgagaaggtgttattttttttttttagggcggccgacagcgcgttggagttattccttttgtcccgaaaaacgcgttacaattacaagggggatccatagaaatgaaattccatgaacccttaacaaaagcgagagaggaaaaaaaacattgcaaaatacagtagccgttacgttatggtactaatactacagatagatcccagggcgcaacgcgagacagctcttgcacgagctcacttatgctaggaaaaaagactgagtagcaataccaaatgatcataagcccaaggcaatcaagggttcctggcttggaagtccttcatgaaggcaacaagcttctcgaccccggcgagcggcatggcattgtaaatggaggcgcggacaccgccaacagacctgtgccccttgagctgcaccatgccctccttggccccctcggcgatgaactgcttctcaaagtccgggcccttggccagggagaagggcacgttcatgtgcgagcgcacggacttgtcgacggggcaaacgtagaaccctccgctggcatcaatggtgtcgtaaagggcgccggccttgcgcgcgttcttcttctcgacctcggcgaggccgccctgcgcgagcaggtcctcgaagacgagactgcaaacgaagatggcgaaccaggccggggtgttgtagagggaggcgttgtcggcgtgcgtcttgaagtcaaccatgacnggcgtgatgggctgaacggccccaatgagtccttgcccaccatggcaatggtgaccccgaagggctaactttctctgggcccccgcgaaaataaccccaaaccgggagacgtcaactc

SEQ ID NO: 42105 - DNA, 660 bp, Zea mays
  misc_feature: Ceres CLONE 1439384-F
  misc_feature: Encodes the peptide sequence at SEQ ID NO. 42106
aaactggagctccccgcggtggcggccgctctagaactagtggatcccccgggctgcaggaattcgcacgagaccattacctagaacatcctaatcgaaaaatgttcagttgcccatgcagccggccctagaccagaaatctttctccatcctctactctcatcaggcatgatggtcgcagccgccagcaagatcggactccctgcctcctgcagaacgacgcgatcgactgtcgcgcgctctcgagcggcgtccgccatgtgctctaccgtaagacgccaggtgcgcatccccctgatatggtgcggtgccgtgggaacttcatccccgtctcacattactgacatcaagattaagatcagagctgtccccaaaaatacaaccctgatcccgggaatctaccactctgatgggaagaccaagtgcaagaacagctcgtggactaacaagcttactgtacgaaaaacgagaacatcactcactgactttgagaggttcacacccctgtttgcaaagattaatacgagcggtgctatctcgtaagagctcgccaagcttaagaaggggtcttcatcttaaggagtctctttccgtgaatgtcctgtcacagcttttggctatgagttggatcatcaaatccattgagcgtcgtcaaagtcc

SEQ ID NO: 42106 - protein, 94 aa, Zea mays
  misc_feature: Ceres CLONE 1439384-F
  misc_feature (26)..(92): Pfam Name: Ribosomal_L14e Pfam Description: Ribosomal protein L14
MCSTVRRQVRIPLIWCGAVGTSSPSHITDIKIKIRAVPKNTTLIPGIYHSDGKTKCKNSSWTNKLTVRKTRTSLTDFERFTPLFAKINTSGAIS

SEQ ID NO: 42107 - DNA, 651 bp, Zea mays
  misc_feature: Ceres CLONE 1439387-F
  misc_feature: Encodes the peptide sequence at SEQ ID NO. 42108
cgcggtggcggccgctctagaactagtggatcccccgggctgcaggaattcgcacgagaccattacctagaacatcctaatcgaaaaatcatcaactgatcaaacagagacaaacctatactgctacatgcataatggttggtacatggtaaaactatagcaagctaaggtcgatcgctcgtctatagctagaccactaccacctccatggtttcttgactgatagatagacggacgagaatgaagaagctagctagctactagatatatcatcagtagagtgttcagttgttgatgatggcctcctccttgcccctggtcaccactgggctgcgccatcctcctcctccgcagcagtcgccgagggtggtcctgcagagcgaggacccgaccgagtggtgcgcgtgggcgcaccaggggcaccgcctgtgggtggccatgccggactccttctgggtgtacacctacaaggtggaccggtgcccgttccggggcaaccacgtgtggacgacgtgcccgtacgcgcactggggggagcgcgcgcgccgccgcgaccccagccgctacgcgtacgccgccgcgacgtgcccggactacgccgactccaagcgccggaaccgcctggccgggtccaccgcgccccccacctgc

SEQ ID NO: 42108 - protein, 119 aa, Zea mays
  misc_feature: Ceres CLONE 1439387-F
MMASSLPLVTTGLRHPPPPQQSPRVVLQSEDPTEWCAWAHQGHRLWVAMPDSFWVYTYKVDRCPFRGNHVWTTCPYAHWGERARRRDPSRYAYAAATCPDYADSKRRNRLAGSTAPPTC

SEQ ID NO: 42109 - DNA, 674 bp, Zea mays
  misc_feature: Ceres CLONE 1439391-F
  misc_feature: Encodes the peptide sequence at SEQ ID NO. 42110
  misc_feature (449)..(449): n is a, c, t, g, unknown, or other
aaagctggagctccccgcggtggcggccgctctagaactagtggatcccccgggctgcaggaattcgcacgagaccattacctagaacatcctaatcgaaaacatcacctataatattttgagcattcagaaacacaccaagcgaagcacattagcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaaacgcacagcaacaacnattcctaccagcactgagccacctagccatggtgaaccctgccgcctactttgcacagcagttgcttgcatcaaacccacttgctctgggcaacgtagtttgcaaccagccacaacaaagctgcaaaagtttctgccagcgctccatccactaggcatgggtgaacccttgccgcctacttaaaaaagaaacaaatgttttcacctaaacccgctcggtttgggc

SEQ ID NO: 42110 - protein, 143 aa, Zea mays
  misc_feature: Ceres CLONE 1439391-F
  misc_feature (1)..(143): Pfam Name: Zein Pfam Description: Zein seed storage protein
  misc_feature (93)..(93): Xaa is any aa, unknown, or other
MATKILSLLALLALFASATNAFIIPQCSLAPSSIITQFLPPVTSMGFEHPAVQAYRLQQAIAASVLQQPISQLQQQSLAHLTIQTIANAQQQXFLPALSHLAMVNPAAYFAQQLLASNPLALGNVVCNQPQQSCKSFCQRSIH

SEQ ID NO: 42111 - DNA, 648 bp, Zea mays
  misc_feature: Ceres CLONE 1439396-F
  misc_feature: Encodes the peptide sequence at SEQ ID NO. 42112
aaagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactactcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagacgacgacgtcctctccctcgcctggacgcgccgcctcctcgaatccttcctcctctgcctcgaggagttccgcgccctgctcttcggctccggggactcgcccgctgctcggcccccgctcgaccgcctcgtcgccgacttctccgaccgcgccgtcaaggcgctcgacctctgcaacgcc

SEQ ID NO: 42112 - protein, 123 aa, Zea mays
  misc_feature: Ceres CLONE 1439396-F
MPATDYSSSSSSSPAAAPLSSIGRSIRSLRRDQNQIHSFPPPPDATDAFQRRAAQLLADLPADDDVLSLAWTRRLLESFLLCLEEFRALLFGSGDSPAARPPLDRLVADFSDRAVKALDLCNA

SEQ ID NO: 42113 - DNA, 622 bp, Zea mays
  misc_feature: Ceres CLONE 1439401-F
  misc_feature: Encodes the peptide sequence at SEQ ID NO. 42114
tcaccgcggtggcggccgctctagaactagtggatcccccgggctgcaggaattcgcacgagaccattacctagaacatcctaatcgaaaaattcaccttggctgcagcctgcaacacaatcctacggttccgacttcaacgcgcgcccctcccattttcacctagccctactccatttgtacatagaaggaagatgggagcatatgcaacgactggtatgcagatgatagcaacacgcccttccatcccggcctacaggcaaatacttgggtcgacatcagcactatctggcattggaaggtcaatctagtccaaaactggctttgccatctcctttgaaagccacatcagcaggcacactggggttccttcaacttgcaagagggtcgttgtgaagggcaatgtcccaaaagggtgccccagggacttcccattggactctcccgggaaaaaaaacatttaaagccgggagttccccaaaaaaaaaaggggaaagggggggggaaattgcaaaaggccccggggcgggcggggggccaaaaattttggggggaaacgggggggccccgcccccaaacatttttaaaaaaaactttaaaacggggaaaaattttgaaaaac

SEQ ID NO: 42114 - protein, 38 aa, Zea mays
  misc_feature: Ceres CLONE 1439401-F
MGAYATTGMQMIATRPSIPAYRQILGSTSALSGIGRSI

SEQ ID NO: 42115 - DNA, 640 bp, Zea mays
  misc_feature: Ceres CLONE 1439406-F
  misc_feature: Translation starting site: 221
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (494)..(494): n is a, c, t, g, unknown, or other
aagctggagctccccgcggtggcggccgctctagaactagtggatcccccgggctgcaggaattcgcacgagaccattacctagaacatcctaatcgaaaaacaagcaaagcagcagcaacagccaacacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagtcacggcgggcagacccggagtgagcagctgggccatgaggggtacagcgagatgggcagcaagggcgggcagacccgcaaagagcagctgggccacaaganannnnnngggatgaggggaaggaaagggcggcctgagcaccatgcangagtccggcggcgagcgcgccgcccgggagggcatcgagatcgacgagtccaagttcaggaccaagtcctagatctgatgcgtgcccccgcttagcatgtagtacgtagctgcaggaatgtagtgtcgtcgtagtagtagggtagt

SEQ ID NO: 42116 - DNA, 671 bp, Zea mays
  misc_feature: Ceres CLONE 1439411-F
aagctggagctccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaatgcgccccgcaggcccaccttcgtgggcatctggaagaagcgtgcggtggagcagtactcgccgatcccgtacgtggcgacgct

SEQ ID NO: 42117 - DNA, 655 bp, Zea mays
  misc_feature: Ceres CLONE 1439415-F
  misc_feature: Encodes the peptide sequence at SEQ ID NO. 42118
acccgcggtggcggccgctctagaactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcgccgccgccgcgtcctcgtcctcgtcctcctccttcgcagcggctgcggctgggagcgcggtggctgtggtgtcggctgcggtggccgcctcgtcttcttcctcgccggcgtcgtcctcgccgcactcggagcggggtggtcttaaatctccatggtcccggaggaaaagaaaacgagcactttctcgtgaacagtgggagagtttgttttcagcaaatgggaagcttcgtgatggtggaaggaagtttctcaagaaagttcgcaa

SEQ ID NO: 42118 - protein, 119 aa, Zea mays
  misc_feature: Ceres CLONE 1439415-F
MKALRRSSTSSSPTAASSPPSSSWIHIRSLLAAAASSSSSSSFAAAAAGSAVAVVSAAVAASSSSSPASSSPHSERGGLKSPWSRRKRKRALSREQWESLFSANGKLRDGGRKFLKKVR

SEQ ID NO: 42119 - DNA, 625 bp, Zea mays
  misc_feature: Ceres CLONE 1439419-F
  misc_feature (234)..(234): n is a, c, t, g, unknown, or other
  misc_feature (322)..(322): n is a, c, t, g, unknown, or other
  misc_feature (392)..(392): n is a, c, t, g, unknown, or other
  misc_feature (451)..(451): n is a, c, t, g, unknown, or other
  misc_feature (479)..(479): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (499)..(499): n is a, c, t, g, unknown, or other
  misc_feature (504)..(504): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (574)..(574): n is a, c, t, g, unknown, or other
  misc_feature (580)..(580): n is a, c, t, g, unknown, or other
  misc_feature (581)..(581): n is a, c, t, g, unknown, or other
  misc_feature (596)..(596): n is a, c, t, g, unknown, or other
  misc_feature (609)..(609): n is a, c, t, g, unknown, or other
gctctagaactagtggatcccccgggctgcaggaattcgcacgagaccattacctagaacatcctaatcgaaaaaccaaattaaaccgccggcgcctccacttcgcgttctcgcctcatctcctcccgctcaggatccggcggcgaaggtaaggcaagatgtacaccgcgcaggaagaagatccagaaggataagggccttgagccctccgagttcgaagactccgtcgcccangctttcttcgacctggagaacggtaccaaggagctcaagagcgacctcagggacctttaccattcacgggctattcaactggattttnccgggaacaaaaagtttttttgaacccgggcccagggcgggtggttaaggcctcccgaagattggtgtcngatcctcgggggctgggaaaaaaattcccccccaaggattggtgttgtttgtcccccantaattttgggggccccccaaaagggctntttgttnnnncccccccccnaaaanactcgccgtctcccaaaagnnncccccggaaaaatttttcccccccccataattttggggagaggcggangtgtcnncgcgcgcgggggggncaggaatcccccnccgcccccgccgcggg

SEQ ID NO: 42120 - DNA, 675 bp, Zea mays
  misc_feature: Ceres CLONE 1439420-F
  misc_feature (337)..(337): n is a, c, t, g, unknown, or other
  misc_feature (344)..(344): n is a, c, t, g, unknown, or other
  misc_feature (364)..(364): n is a, c, t, g, unknown, or other
  misc_feature (366)..(366): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (519)..(519): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaagacggagtggtcgaacgggacccgcaggaggacttgcngtgtganacagtgatgatcgagaaccngnaagatcccgaaagatcaacgccacgccacacannnnnnnnnnnnngaggagggagagactggtgacctttttnnnnnnnnnnnnnnnnnnnnnnnnnnnnnnnnnnnttctccccctcccggggagggggaaaggggggcccaagttgctttnccccccccaaagggccccctggaacaattaggccccccgccccaaaaaatcccccaccgggccgggggttccccccnnnnnnnnnnnnnnnnnnnntgnnnntnnnnnnnnnnnnnnnnnnnnnnnnnnnnnnnnnnnnggggcggcccgccgcgg

SEQ ID NO: 42121 - DNA, 658 bp, Zea mays
  misc_feature: Ceres CLONE 1439427-F
  misc_feature: Encodes the peptide sequence at SEQ ID NO. 42122
  misc_feature (398)..(398): n is a, c, t, g, unknown, or other
aagctggagctccccgcggtggcggccgctctagaactagtggatcccccgggctgcaggaattcgcacgagaccattacctagaacatcctaatcgaaaaattccggccctctcgcccgtccgtctcctgcccccgtccctggtcggaccacgagagccccggactgcgttcacctctgccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccaggactggcatcctgccatggctccaggccaagatcgttgatcccgtgctgcangtcatcagaaggggagcagaacccaagcaactgggcttctctgctgccctcggtgtcacgattgggatctttccgatatgtgggaaccctgttattcttggtgcttgttgtgtagccatgttgggaagtcggtgccatgctgttactcttatgggtctaaatttggcccgcactccaattgaactaagcttgatcgtccctttcctgcgtttgggtggagccctcactgggcagcgggcaccttccctttgacaggcgag

SEQ ID NO: 42122 - protein, 107 aa, Zea mays
  misc_feature: Ceres CLONE 1439427-F
  misc_feature (24)..(24): Xaa is any aa, unknown, or other
MGSLLTRTGILPWLQAKIVDPVLXVIRRGAEPKQLGFSAALGVTIGIFPICGNPVILGACCVAMLGSRCHAVTLMGLNLARTPIELSLIVPFLRLGGALTGQRAPSL

SEQ ID NO: 42123 - DNA, 632 bp, Zea mays
  misc_feature: Ceres CLONE 1439432-F
  misc_feature: Encodes the peptide sequence at SEQ ID NO. 42124
  misc_feature (449)..(449): n is a, c, t, g, unknown, or other
  misc_feature (470)..(470): n is a, c, t, g, unknown, or other
  misc_feature (471)..(471): n is a, c, t, g, unknown, or other
  misc_feature (482)..(482): n is a, c, t, g, unknown, or other
  misc_feature (586)..(586): n is a, c, t, g, unknown, or other
tggagctccccgcggtggcggccgctctagaactagtggatcccccgggctgcaggaattcgcacgagaccattacctagaacatcctaatcgaaaagccggcgatcggcggagatccgctgttctgacatcgtctcccgctgctgacttgtgaacaaggcagcagcatggttcagtttggaaacatgtcatcaaagaagatagagttggatcacaaggacatggtccatgattctgctatcgactactatggcaagcgccttgccactgcctcctcagactctaccgtgaagatcatcaacattggcgcggcaaatgccccatcccaggtcctggcaacgcttagtggccactatggtcctgtgtggcgtgttgcttgggcccatccaaagtatggcgctatccttgcttcgtgcagttatgatggccgtgtcattattggaaaggangatgcacgagggcattggtcnntcagtcatgtngtcagtgacaaacagtcatctgtcaactccattgcatgggctccgtatgaaggtgggctttgccttgcctgtgcatcttcaggtggaaagatatccatcttganaatccagctgatgggggttgggatactgcaaccatggaccgagccc

SEQ ID NO: 42124 - protein, 155 aa, Zea mays
  misc_feature: Ceres CLONE 1439432-F
  misc_feature (53)..(93): Pfam Name: WD40 Pfam Description: WD domain, G-beta repeat
  misc_feature: SWISSPROT Homolog: EC 2.3.1.48 Histone acetyltransferase
  misc_feature (94)..(94): Xaa is any aa, unknown, or other
  misc_feature (102)..(102): Xaa is any aa, unknown, or other
  misc_feature (140)..(140): Xaa is any aa, unknown, or other
MVQFGNMSSKKIELDHKDMVHDSAIDYYGKRLATASSDSTVKIINIGAANAPSQVLATLSGHYGPVWRVAWAHPKYGAILASCSYDGRVIIGKXDARGHWSXSHVVSDKQSSVNSIAWAPYEGGLCLACASSGGKISILXIQLMGVGILQPWTEP

SEQ ID NO: 42125 - DNA, 644 bp, Zea mays
  misc_feature: Ceres CLONE 1439445-F
  misc_feature: Encodes the peptide sequence at SEQ ID NO. 42126
aagctggagctccccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggccgc

SEQ ID NO: 42126 - protein, 119 aa, Zea mays
  misc_feature: Ceres CLONE 1439445-F
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGIAVDYGR

SEQ ID NO: 42127 - DNA, 609 bp, Zea mays
  misc_feature: Ceres CLONE 1439447-F
  misc_feature (310)..(310): n is a, c, t, g, unknown, or other
  misc_feature (314)..(314): n is a, c, t, g, unknown, or other
  misc_feature (315)..(315): n is a, c, t, g, unknown, or other
  misc_feature (323)..(323): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgcccgcggttcatctaccgcccgcggtgcatctgccacctccggttnaccnntgcactcngtgcatctcccaccgccggtccacctgccgccgccggtcccactgcccacgncnngtcatggtgccgcgccggttcatctgcggcgccaccatgccattaccttaattaaacggcccgggcttagccttatccccgagcaaacctatggccgggccaaaagcccaatccaaaccccggccaatttaagggaaacttggggttttggccacccccattttgggccaaggggccaaattcttgaggaataggggcccccaggggaacccccctttttcccccctgggc

SEQ ID NO: 42128 - DNA, 629 bp, Zea mays
  misc_feature: Ceres CLONE 1439452-F
  misc_feature: Encodes the peptide sequence at SEQ ID NO. 42129
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaacattaactagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacagcggtggcggcggctacngtggcggcggcggctacggtggtggtgg

SEQ ID NO: 42129 - protein, 133 aa, Zea mays
  misc_feature: Ceres CLONE 1439452-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (125)..(125): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYSGGGGYXGGGGYGGG

SEQ ID NO: 42130 - DNA, 656 bp, Zea mays
  misc_feature: Ceres CLONE 1439454-F
  misc_feature: Encodes the peptide sequence at SEQ ID NO. 42131
  misc_feature (541)..(541): n is a, c, t, g, unknown, or other
tccccgcggtggcggccgctctagaactagtggatcccccgggctgcaggaattcgcacgagaccattacctagaacatcctaatcgaaaaatcgcgtggtggccgcgccgctctgttcatccgtcccctcctccttccggctctcgctgtcacatgtcgtgtggtatgggggcgctctgatgcggatggtgcagcgccgcgggatcacccacggccatgattgatcgcgaacgagcacaggatatgcaagttaataatgaggcaccactacggtgcctccagccaaatatttctcagtataactctccacagcacataggtggtgttgaagggtttcctgagaataatgaaaaaaggaatgatattgttgctgcgggaaaaatctggggaggagactccgacccaaagccttaacaggcccatctaccggacaaaattttatgcctgggcatgtatttatttcgattatccaatctggggtcagcccctacctttatgtttttgcccccaattttattaccaaaaatgggggaccccggnttcccctattgaaaacggggggcaatattcttcccttcgaaaaaggtcccctcaaggtcaccccccggaatgcccaactttccgggaatttcaccaattttgtgggctaatcgcc

SEQ ID NO: 42131 - protein, 65 aa, Zea mays
  misc_feature: Ceres CLONE 1439454-F
MIDRERAQDMQVNNEAPLRCLQPNISQYNSPQHIGGVEGFPENNEKRNDIVAAGKIWGGDSDPKP

SEQ ID NO: 42132 - DNA, 635 bp, Zea mays
  misc_feature: Ceres CLONE 1439466-F
  misc_feature: Encodes the peptide sequence at SEQ ID NO. 42133
  misc_feature (635)..(635): n is a, c, t, g, unknown, or other
aagctggactccccgcggtggcggccgctctagaactagtggatcccccgggctgcaggaattcgcacgagaccattacctagaacatcctaatcgaaaaatcagtcctgtccaccagcaccgccaccacactcgccgaccggcaatgaaccacggcggcggcgggaggagcagcagccggctccgggaccggctggcccggatgttccgcccgagcgcgctgctccgctccacctgcaacacggccgccgccgcatcctcctgctcctcctcgtctcccgcgtccacggccaagcctccgcctccgcctgtggctgcggcggcctccgcgtgctcctccagccgcgcgctgctcggcgccgtcgtcgacggggactcgtcgttcctcgcctcctcgcggcgcgacctcgccgtcgccggccgcgccgagtccttctccgccgccgtggaccgccggcgccgcagccgcagcagcagcctggacgcggcggcgccgccgccctcccgcttctccgtcgacgcgccggcggctctggcggagacgggcggggacaaggaggagaagaagaagaagaagaagagcccgcgcgacgacgacgacgacgagcaccggctcggtgtcggtggcagcagcn

SEQ ID NO: 42133 - protein, 163 aa, Zea mays
  misc_feature: Ceres CLONE 1439466-F
MNHGGGGRSSSRLRDRLARMFRPSALLRSTCNTAAAASSCSSSSPASTAKPPPPPVAAAASACSSSRALLGAVVDGDSSFLASSRRDLAVAGRAESFSAAVDRRRRSRSSSLDAAAPPPSRFSVDAPAALAETGGDKEEKKKKKKSPRDDDDDEHRLGVGGSS

SEQ ID NO: 42134 - DNA, 623 bp, Zea mays
  misc_feature: Ceres CLONE 1439471-F
  misc_feature: Encodes the peptide sequence at SEQ ID NO. 42135
aagctggagctccccgcggtggcggccgctctagaactagtggatcccccgggctgcaggaattcgcacgagaccattgcctagaacatcctaatcgaaaaattttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacagggatgaggt

SEQ ID NO: 42135 - protein, 148 aa, Zea mays
  misc_feature: Ceres CLONE 1439471-F
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTKVKGYRDE

SEQ ID NO: 42136 - DNA, 625 bp, Zea mays
  misc_feature: Ceres CLONE 1439478-F
  misc_feature: Encodes the peptide sequence at SEQ ID NO. 42137
tggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtccaagattacaatgaa

SEQ ID NO: 42137 - protein, 151 aa, Zea mays
  misc_feature: Ceres CLONE 1439478-F
  misc_feature (1)..(151): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNE

SEQ ID NO: 42138 - DNA, 646 bp, Zea mays
  misc_feature: Ceres CLONE 1439480-F
  misc_feature: Encodes the peptide sequence at SEQ ID NO. 42139
  misc_feature (527)..(527): n is a, c, t, g, unknown, or other
tccccgcggtggcggccgctctagaactagtggatcccccgggctgcaggaattcgcacgagaccattacctagaacatcctaatcgaaaaaccagagtcaccgcggcgagttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccccactctgtacgggttccgtggttgaacgcatctcttccctcgtctgcagcggctgcccgtggcgtttcctcanttccctctgccctgcctggctttgatgtagaaagtatcaaaataaaataatctctgaagtgcttcgtattggggggaaacatgtggtccaccagggctgggaaatcagatccagatgtt

SEQ ID NO: 42139 - protein, 103 aa, Zea mays
  misc_feature: Ceres CLONE 1439480-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGPTLYGFRG

SEQ ID NO: 42140 - DNA, 623 bp, Zea mays
  misc_feature: Ceres CLONE 1439481-F
  misc_feature: Encodes the peptide sequence at SEQ ID NO. 42141
ggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatcctggctccggagcgggcagcagaagctggattgtgaacttagagggaggtgcgtggtgcaacagcgccaagacatgccggctcaccaggagctccggcccgtgctcgtcggaccacatggacaaagagatccccttcaccggcatcatgagcagcacccgaccctggatccctgttctcgcccgattt

SEQ ID NO: 42141 - protein, 146 aa, Zea mays
  misc_feature: Ceres CLONE 1439481-F
  misc_feature (41)..(140): Pfam Name: PAE Pfam Description: Pectinacetylesterase
MADRPSLPALIIAIAVLAGSYCRVASSASPAVEDELRGGGGAGGPTTMRRRAASVMVPITILKSAVSDGAVCMDGTPPAYHLDPGSGAGSRSWIVNLEGGAWCNSAKTCRLTRSSGPCSSDHMDKEIPFTGIMSSTRPWIPVLARF

SEQ ID NO: 42142 - DNA, 596 bp, Zea mays
  misc_feature: Ceres CLONE 1439482-F
  misc_feature: Encodes the peptide sequence at SEQ ID NO. 42143
  misc_feature (189)..(189): n is a, c, t, g, unknown, or other
  misc_feature (354)..(354): n is a, c, t, g, unknown, or other
  misc_feature (367)..(367): n is a, c, t, g, unknown, or other
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccngagatggcggaccggccgtcgcttcctgctctcattattgctatcgccgttcttgctggcagttactgccgcgtggcgagctcggcctcgccggcggtggaagatgagctgcgcggtggaggaggagccggcggtccgacaacgaatgcggcgcgcgcggcgtcngtgatggtgcccnatcacatccctcagtccgctgttagcgacngagctgtgtgcatggatggaaacgcacctgcttaccacttggatcctggctccggagcgggcagcagaagctggattgtggacttagagggaggtgcgtgggtgcacagcgccaagacatgcccgctcaccagagctccggccctgggtcgtcggaccccatgaacaagaagacccctttaccgggattatgaacagga

SEQ ID NO: 42143 - protein, 122 aa, Zea mays
  misc_feature: Ceres CLONE 1439482-F
  misc_feature (59)..(59): Xaa is any aa, unknown, or other
  misc_feature (69)..(69): Xaa is any aa, unknown, or other
MADRPSLPALIIAIAVLAGSYCRVASSASPAVEDELRGGGGAGGPTTNAARAASVMVPXHIPQSAVSDXAVCMDGNAPAYHLDPGSGAGSRSWIVDLEGGAWVHSAKTCPLTRAPALGRRTP

SEQ ID NO: 42144 - DNA, 630 bp, Zea mays
  misc_feature: Ceres CLONE 1439484-F
  misc_feature: Encodes the peptide sequence at SEQ ID NO. 42145
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatgggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagaagctctggcaaaccttttcctcctaatctcaggcaccacaatttcttcccttcaaccaactggctaacactgaaccctggctggttatttgccggcaacaactattacctttcagcccggtaagttaatggctaattttaaaa

SEQ ID NO: 42145 - protein, 183 aa, Zea mays
  misc_feature: Ceres CLONE 1439484-F
AGAPRGGGRSRTSGSPGLQEFARDHYLEHPNRKINHIIETNKQHRKWNPVATTEQQWATKIFSLLMLLALSACVANATIFPQCSQAPIASLLPPYLPSMIASVCENPALQPYRLQQAIAASNIPLSPLLFQQSPALSLVQSLVQTIRAQQLQQLVLPVINQEALANLFLLISGTTISSLQPTG

SEQ ID NO: 42146 - DNA, 578 bp, Zea mays
  misc_feature: Ceres CLONE 1439488-F
  misc_feature: Encodes the peptide sequence at SEQ ID NO. 42147
  misc_feature (51)..(51): n is a, c, t, g, unknown, or other
  misc_feature (457)..(457): n is a, c, t, g, unknown, or other
  misc_feature (528)..(528): n is a, c, t, g, unknown, or other
  misc_feature (546)..(546): n is a, c, t, g, unknown, or other
aagctggagctccccgcggtggcggccgctctagaactagtggatcccccngggctgcaggaattcgcacgagaccattacctagaacatcctaatcgaaaaaacgaagaaccgaatgcccagtcctgaatcacgtcttcacccgtgctcgtgcgctgcgcccatcccttccgcctccacgctccccacgtgcaccgtgcacagcaccacacagccaggtccccatggcggcggcggcggcggttgcgtctgcgacgacggcggaagacgaagcgcgcctgctgcgcctggaggagcaggcggagcacggcggcggcggcgcctgggaatacctctgcctcggccgccggctccgcgcccgccgccccgctcacgtcctccgcgtcgggcttcgcctcctcacaacggctccgcgcgcttcgggcttgcctcagaacagtgaacgctctacgagcangtgggcacggcgggcatggattgccagcgtctccatgttgcaaaagactgtattggaatcctttcaaaacnatttcctgggaacaaccnggttgcccggctagaagctcgtctgtttgaac

SEQ ID NO: 42147 - protein, 111 aa, Zea mays
  misc_feature: Ceres CLONE 1439488-F
  misc_feature (78)..(78): Xaa is any aa, unknown, or other
  misc_feature (102)..(102): Xaa is any aa, unknown, or other
  misc_feature (108)..(108): Xaa is any aa, unknown, or other
MAAAAAVASATTAEDEARLLRLEEQAEHGGGGAWEYLCLGRRLRARRPAHVLRVGLRLLTTAPRASGLPQNSERSTSXWARRAWIASVSMLQKTVLESFQNXFLGTTXLPG

SEQ ID NO: 42148 - DNA, 582 bp, Zea mays
  misc_feature: Ceres CLONE 1439490-F
  misc_feature: Encodes the peptide sequence at SEQ ID NO. 42149
  misc_feature (511)..(511): n is a, c, t, g, unknown, or other
  misc_feature (512)..(512): n is a, c, t, g, unknown, or other
ccccgcggtggcggccgctctagaatagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcaaatgccctgccccctgcccgggctgcagggcttgttacgggcttgcccccgcctgaaaaccatgaatgggcggcggggggcttttcccctaaccgaataacttgagggaccccattggcaccccttgggggggggcccttttatacccgggggggggcgcccaaaaccccttttcccccccccccccgaaaaggggtttccccccccaaaaaaggaggtggcagggggcccccccccccccccccccccaaaaaaataaaccctttgggggggggcgcgccccccccccagaannttttttttaaaaaccccttttttgttaaaaacccccacacttttgtttgtgggccccccgggttttcccc

SEQ ID NO: 42149 - protein, 54 aa, Zea mays
  misc_feature: Ceres CLONE 1439490-F
MKMVIVLVVCLALSAASASAMQMPCPLPGLQGLLRACPRLKTMNGRRGAFPLTE

SEQ ID NO: 42150 - DNA, 647 bp, Zea mays
  misc_feature: Ceres CLONE 1439497-F
  misc_feature: Encodes the peptide sequence at SEQ ID NO. 42151
tggagctccccgcggtggcggccgctctagaactagtggatcccccgggctgcaggaattcgcacgagaccattacctagaacatcctaatcgaaaaggttctgtttgtttggtgagatgtgttttcctctttctcctacgttgtgagtttccatttggtggacatccttttccagatcccttcgtggattagatccacgctcctctagtcgagatcgtcttgcatttttctgagatggagattgggaccgaaaaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaaccttgttacagcagtt

SEQ ID NO: 42151 - protein, 90 aa, Zea mays
  misc_feature: Ceres CLONE 1439497-F
MFPEEGCTVTISSIVQNSRWWYPSCSRCHKSSSQTSTGYHCTSCGCTNIKFRYKLSFIATDGTCEAEFFCFDSIARKIVGEPWGNLVTAV

SEQ ID NO: 42152 - DNA, 756 bp, Zea mays
  misc_feature: Ceres CLONE 1439499-F
  misc_feature: Encodes the peptide sequence at SEQ ID NO. 42153
  misc_feature (354)..(354): n is a, c, t, g, unknown, or other
tttttttttgggaccgggggggggggggggcccccccccccctagtgggcgccctttctcagggggggctccccggggtggcggccgctctataatagtggatcccccgggctgcggggattcgcacgagaccattacctagaacatcctaatcgaaaaatgcgcccgccgtcctctcctctcctccccggccccttcactccaccaacgaaccccacgcaggcagcagcacgcgcaagccgcaaggcaaggcacaaacactaggggccgggcatggcgacgcgggcggacgtggagaagggcgggccggcgaggaaggagcccggcaaggtgccgtcgccgctgtacccgcancacgagggggaacgggagtgggtgccctggctcgtccccgtcatcttcgtcgccagcatcaccgtcttcgtcgtcaccatgtacgccaacgagtgggggggtggggcgaacacccaaaaagtgcccccccgggttcgtcggcgggtttttccttcgcggccgctgcgacagaacccggtcttgcggggccgtgttcgggccgctcaccaaaagggggggcccttggtggtgggaaaaaggggggtggacccgccaccagggggctggcggcctccctcctccagggagggggggttcccgggcccggggagtcgatcccaccctgggtccgccaaaaaatggctctggccctcccctccttccatacgggcaagggcgcccctccgaagaaaaggaagttcc

SEQ ID NO: 42153 - protein, 161 aa, Zea mays
  misc_feature: Ceres CLONE 1439499-F
  misc_feature (27)..(27): Xaa is any aa, unknown, or other
MATRADVEKGGPARKEPGKVPSPLYPXHEGEREWVPWLVPVIFVASITVFVVTMYANEWGGGANTQKVPPRVRRRVFPSRPLRQNPVLRGRVRAAHQKGGPLVVGKRGVDPPPGGWRPPSSREGGFPGPGSRSHPGSAKKWLWPSPPSIRARAPLRRKGSS

SEQ ID NO: 42154 - DNA, 648 bp, Zea mays
  misc_feature: Ceres CLONE 1439510-F
  misc_feature: Encodes the peptide sequence at SEQ ID NO. 42155
aagctggagctccccgcggtggcggccgctctagaactagtggatcccccgggctgcaggaattcgcacgagaccattacctagaacatcctaatcgaaaaagaaaccctaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattgggcaattgatgtgtctttttctgttcaaaaaaaaaaaaaaaaacttatcgataccgtcgacctcgagggggggc

SEQ ID NO: 42155 - protein, 60 aa, Zea mays; identical to SEQ ID NO: 1569
  misc_feature: Ceres CLONE 1439510-F
  misc_feature (3)..(42): Pfam Name: Ribosomal_L29e Pfam Description: Ribosomal L29e protein family

SEQ ID NO: 42156 - DNA, 734 bp, Zea mays
  misc_feature: Ceres CLONE 1439515-F
  misc_feature: Encodes the peptide sequence at SEQ ID NO. 42157
  misc_feature (297)..(297): n is a, c, t, g, unknown, or other
  misc_feature (372)..(372): n is a, c, t, g, unknown, or other
  misc_feature (373)..(373): n is a, c, t, g, unknown, or other
aaagctggagctccccgcggtggcggccgctctagaactagtggatcccccgggctgcaggaattcgcacgagaccattacctagaacatcctaatcgagaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctcccgtctatatgcccgctccgntctatctgccgccgcagcagcagccgcagccatggcaatacccccactcacccacgcagctaaaccccggtgcanncaattggaatcttgggggggtcggaaggtcggaaaaccgtttcctgggcaatgggctcaaagttcctagaggcacctttggaccccggggggggaaccccctagggttcccccaaaggggggggggggttaaaaaaaagaggggcccccaaaaataagggggggggggagccccctcccccaaaccaaaaaaaaaaaggggggggggggcaaaattcccctcccggaaaaaaaccccgggggggagcccccccttttttttatggccccccatatagcccccccacgaggggggggggggggggggggtgagaaaaaaaaacacccccctcctccctcaaaaaagggggggggggagtaaa

SEQ ID NO: 42157 - protein, 37 aa, Zea mays
  misc_feature: Ceres CLONE 1439515-F
  misc_feature (15)..(15): Xaa is any aa, unknown, or other
MAIPPLTHAAKPRCXQLESWGGRKVGKPFPGQWAQSS

SEQ ID NO: 42158 - DNA, 666 bp, Zea mays
  misc_feature: Ceres CLONE 1439527-F
  misc_feature: Encodes the peptide sequence at SEQ ID NO. 42159
aagctggagctccccgcggtggcggccgctctataactagtggatcccccgggctgcaggaattcgcacgagaccattacctagaacatcctaatcaaaaatacctcctcaagggacgttcaccacagtcctctctttccccggcaccaccaccacccaggctaaccggactggaccgagtgttgaacaacactgacggcgaggcacatagagcgacggcaggcatggtgagccatgaaaatttgcacctggtgctggacccggcgtctctgggcgcgccgagggccgacccgtccgccgcatacatcccgccgcagctcctcgccgcgctggtagagtacctctcctccaaccgctcctagggcggcgacctctccactgacgttgacgacgagttcatgatgcacgagttcaaggagcacatgtgctcgcgccccctgatccacaactggacggagtgcacctacgcccacccggctgaggccacgcggattggggacccccgccctgtggactaagccccggagacgtgtcctgactaccagcccctccaagtcgcgagagatcgcgtgcctggaggcgactgcgtgccagaacgcgaacaaggacattcgatctgtggtctcctgacgtgccggtacagtaggaacacctagcttcatgcgc

SEQ ID NO: 42159 - protein, 45 aa, Zea mays
  misc_feature: Ceres CLONE 1439527-F
MVSHENLHLVLDPASLGAPRADPSAAYIPPQLLAALVEYLSSNRS

SEQ ID NO: 42160 - DNA, 638 bp, Zea mays
  misc_feature: Ceres CLONE 1439528-F
  misc_feature: Encodes the peptide sequence at SEQ ID NO. 42161
ccccgcggtggcggccgctctagaactagtggatcccccgggctgcaggaattcgcacgagaccattacctagaacatcctaatcgaaaaactttccttgtgcggggtatacaggctctctccctccgcgcttccgaacagctcattacgactccaggaggggggcacttggctttcccctcctcctcctgcaagcaccatcctcgcctcgctctattgggctcttcacaccctatatactgccaggttgtgacgctgagcttgtcgatgcactgccaaggatgcaagaagaatgtcaacaaggtgctcagaaacatcggcggcgtgtaccgatgcaaaatcgatgcccggagcaacaaggtggagccgaccgtctacaccaatctcgactcctagatgcatccccccaacgtgtaccagttcggcaagaacgacataccttgtccccgtagcagccaggtgtagtcctcaccaccagccagaacctctacctgacagcccaaggaccggcggaccccaaggaacaaccctcctggggtaccccgggcacacccgcggaaacctgccgaaggagggcggctccacccgcctacacggccgaagggcaccccggggagaacccatcaccccttttcctg

SEQ ID NO: 42161 - protein, 42 aa, Zea mays
  misc_feature: Ceres CLONE 1439528-F
MHCQGCKKNVNKVLRNIGGVYRCKIDARSNKVEPTVYTNLDS

SEQ ID NO: 42162 - DNA, 627 bp, Zea mays
  misc_feature: Ceres CLONE 1439532-F
  misc_feature: Encodes the peptide sequence at SEQ ID NO. 42163
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (405)..(405): n is a, c, t, g, unknown, or other
  misc_feature (411)..(411): n is a, c, t, g, unknown, or other
  misc_feature (431)..(431): n is a, c, t, g, unknown, or other
  misc_feature (530)..(530): n is a, c, t, g, unknown, or other
  misc_feature (531)..(531): n is a, c, t, g, unknown, or other
  misc_feature (540)..(540): n is a, c, t, g, unknown, or other
gggggggggggggggggtcaggcgaggcgggttggggagatcctaatcgaaaagttcactagcttcggagtttctttcgaataattaaaacgaaaacaatggcgacgggtcagttcttcaaccaattcccctgcacaacccgagtccaaaggccaccaaaccctaaacccctctccaagccaacgactctggtgcctatgagcacgctcactcgccgtccgttgttctcccccggcgaattcgccgtttcccgtgcggattnnngagtcagagtcatcgatgcagaagacgagttggatccggagacgagtgagggaggatctgctctattggtgggggaggaagcaatcgaatccgtggaagagacggaggttctcaagagatcgctgggggattcgggggggnggacanaccgagggttgagcgcatcnagcgagacgagagccgagatcggagatctaatcacacagctcgagtccaagaaccctacaccagctcccaccgatgctctcttccttctcggcaggggnntgatcctcncgtacacatcgttcgttggtttggtcccgttgctttcacgagggatcgtgccgttagttaaagtcgacgagatctcacagactattg

SEQ ID NO: 42163 - protein, 143 aa, Zea mays
  misc_feature: Ceres CLONE 1439532-F
  misc_feature (58)..(143): Pfam Name: PAP_fibrillin Pfam Description: PAP_fibrillin
  misc_feature (22)..(22): Xaa is any aa, unknown, or other
  misc_feature (23)..(23): Xaa is any aa, unknown, or other
  misc_feature (70)..(70): Xaa is any aa, unknown, or other
  misc_feature (72)..(72): Xaa is any aa, unknown, or other
  misc_feature (112)..(112): Xaa is any aa, unknown, or other
  misc_feature (115)..(115): Xaa is any aa, unknown, or other
MSTLTRRPLFSPGEFAVSRADXXVRVIDAEDELDPETSEGGSALLVGEEAIESVEETEVLKRSLGDSGGXTXRGLSASSETRAEIGDLITQLESKNPTPAPTDALFLLGRGXILXYTSFVGLVPLLSRGIVPLVKVDEISQTI

SEQ ID NO: 42164 - DNA, 641 bp, Zea mays
  misc_feature: Ceres CLONE 1439535-F
  misc_feature: Encodes the peptide sequence at SEQ ID NO. 42165
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
ccccgcggtggcggccgctctagaactagtggatcccccgggctgcaggaattcgcacgagnnnattacctagaacatcctaatcgaaaacttagccgcgcggacgcccaccagcagctgcccccttgctgtcgccgcctctccgcgcgaccgatctaccgccgccgccaccannncgctgatcgccggcgaggacttccaacatattctgcgtctgctgaacaccaacgtggatgggaagcagaagatcatgttcgccatgacctccataaagggtgtnnnncgccgcttctccaacatcgtctgcaagaaggccgacatcgacatgaacaagagggccggtgagctgacgcctgaagagctggagcgcctgatgacggtcgtggcgaaccctagnnnnttcaaggtgccggactggttcctcaacaggaagaaggattacaaggacggaaggttctcacaggtcgtctccaacgccctcgacatgaagctcagggacgacctcgagaggctcaagaagnnnnngaaccaccgtggtctgcgtcactactggggcctccgtgtccgtggccagcacaccaagaccactggcaggcgcggaaaaactgttggtgtctccaagaagcgataagctacatatc

SEQ ID NO: 42165 - protein, 126 aa, Zea mays
  misc_feature: Ceres CLONE 1439535-F
  misc_feature (1)..(116): Pfam Name: Ribosomal_S13 Pfam Description: Ribosomal protein S13/S18
  misc_feature (11)..(11): Xaa is any aa, unknown, or other
  misc_feature (49)..(49): Xaa is any aa, unknown, or other
  misc_feature (50)..(50): Xaa is any aa, unknown, or other
  misc_feature (91)..(91): Xaa is any aa, unknown, or other
  misc_feature (92)..(92): Xaa is any aa, unknown, or other
MFAMTSIKGVXRRFSNIVCKKADIDMNKRAGELTPEELERLMTVVANPXXFKVPDWFLNRKKDYKDGRFSQVVSNALDMKLRDDLERLKKXXNHRGLRHYWGLRVRGQHTKTTGRRGKTVGVSKKR

SEQ ID NO: 42166 - DNA, 653 bp, Zea mays
  misc_feature: Ceres CLONE 1439539-F
  misc_feature: Encodes the peptide sequence at SEQ ID NO. 42167
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
ctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggannnnctagcgacggcggcgtgctaccggtgacattgtccccctcggcccctccatccctgacgcagcggcgccagcctgcaggaagccagcccctattcgagacaaggtcgatctttgctgccttggcgagcttcagcnnnntcaaggtcgagcatggcggcaggccagtaaatagagcaacacaaaacccttcaaattaatggagacctctgcagcaaccccgacccggccgccacaccaggcggccacttccccatcgccnnnnccctcgtcgtcgctgaggctgtggaggccagcggcgcagcgcaacatgcgcaatcagtggtcccatctgagcgccgccaaggagcagtggctggc

SEQ ID NO: 42167 - protein, 53 aa, Zea mays
  misc_feature: Ceres CLONE 1439539-F
  misc_feature (22)..(22): Xaa is any aa, unknown, or other
METSAATPTRPPHQAATSPSPXPSSSLRLWRPAAQRNMRNQWSHLSAAKEQWL

SEQ ID NO: 42168 - DNA, 677 bp, Zea mays
  misc_feature: Ceres CLONE 1439541-F
  misc_feature: Translation starting site: 468
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (437)..(437): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgnnnnggctgatcctggccggcaccgtgatcgcgctcacggtggccacccccgtgctggtgatcttcagcccggtgnctggtgccggccgccatcgcgctnnnnctcatggcggccgggttcgtcacctccggcggcctcggcgtcgctgcgctgtccgtgttctcctggatgtacaagtacctgacgggnnnncacccgccgggcgccgaccagctggaccacgccaaggcgaggctggcgtccaaggcccgcgacatcaaggatgcagcacagcaccgcatcgaccnnnntcaggggtcttgagagaagaaccac

SEQ ID NO: 42169 - DNA, 636 bp, Zea mays
  misc_feature: Ceres CLONE 1439542-F
  misc_feature: Encodes the peptide sequence at SEQ ID NO. 42170
  misc_feature (69)..(69): n is a, c, t, g, unknown, or other
  misc_feature (70)..(70): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
aaagctggagctccccgcggtggcggccgctctagaactagtggatcccccgggctgcaggaattcgcnnaagaccattacctagaacatcctaatcgaaaaaaccgcagcagggcgttgggcgagtgagtgagtcagtgaggctgggatagcagcagcagcatcagtgcgccgcactcnnnttctcttcttgccgtgcggtgcggcgcggcgcggggaggcaccgcacggccgcaagcaatgccgcgccggcagaggacgcgcagcagcgaggagctcaaggcgnnngacttcgtcgactcggtgctcaacttcggcggcgaggaggaggatggggaagaggagaagcaggaggccggcggggacggccagccggcggcggagttcaagtccaagaacnnngaggccgagcggaagcggcgcggcaagctcaaccgcaacatcctcgcgctcagggccgtggtgccgaacatcaccaagatgagcaaggagtccaccctctcggacgctatcgacctcannnngaagctccagaaccaggtccttgagctgcagcgccagctcgccgactcgcccggagaggcctgggagaagcagggcagcgcgtcgtgctctgaatccttcactgccacggaa

SEQ ID NO: 42170 - protein, 132 aa, Zea mays
  misc_feature: Ceres CLONE 1439542-F
  misc_feature (51)..(98): Pfam Name: HLH Pfam Description: Helix-loop-helix DNA-binding domain
  misc_feature (16)..(16): Xaa is any aa, unknown, or other
  misc_feature (54)..(54): Xaa is any aa, unknown, or other
  misc_feature (94)..(94): Xaa is any aa, unknown, or other
  misc_feature (95)..(95): Xaa is any aa, unknown, or other
MPRRQRTRSSEELKAXDFVDSVLNFGGEEEDGEEEKQEAGGDGQPAAEFKSKNXEAERKRRGKLNRNILALRAVVPNITKMSKESTLSDAIDLXXKLQNQVLELQRQLADSPGEAWEKQGSASCSESFTATE

SEQ ID NO: 42171 - DNA, 661 bp, Zea mays
  misc_feature: Ceres CLONE 1439550-F
  misc_feature: Encodes the peptide sequence at SEQ ID NO. 42172
  misc_feature (76)..(76): n is a, c, t, g, unknown, or other
  misc_feature (77)..(77): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
aaagctggagctcaccgcggtggcggccgctctagaactagtggatcccccgggctgcaggaattcgcacgagacnnttacctagaacatcctaatcgaaaaatcacataagtccgccgcccctctccctcagtaaacccccctctcttcttcccgcggtctgctcgttcgatctgtgcagcagatctgnnntctcgagcgaccgtgaagcagcttcaatcgtcggcatggcgctcgtattgcatagtggggctggaaacaagaatgccttcaaagcacttattgctgcagaatacnnnnggatcaaggttgagttgaccaaggattttgagatgggtgtctccaacaagacccctgagtttcttaagatgaacccccttgggaaggttcctgttctggagactcctgatggccnnnnttttgagagtaatgctatcgcacgctatgttgctcgcttgaaggatgacaaccctctttttgggtcttcccgtattgaacaagcccacgttgagcaatggatggattttgccgcaacagaagnnnatcctggtgttgcatggtacttgtatccaaggcttgggtacctcccttatgtcagcacaactgaggaaacagctatttcttcattgaagaggtcgcttggtgctctgaacacacacct

SEQ ID NO: 42172 - protein, 144 aa, Zea mays
  misc_feature: Ceres CLONE 1439550-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (24)..(24): Xaa is any aa, unknown, or other
  misc_feature (25)..(25): Xaa is any aa, unknown, or other
  misc_feature (63)..(63): Xaa is any aa, unknown, or other
  misc_feature (64)..(64): Xaa is any aa, unknown, or other
  misc_feature (105)..(105): Xaa is any aa, unknown, or other
  misc_feature (106)..(106): Xaa is any aa, unknown, or other
MALVLHSGAGNKNAFKALIAAEYXXIKVELTKDFEMGVSNKTPEFLKMNPLGKVPVLETPDGXXFESNAIARYVARLKDDNPLFGSSRIEQAHVEQWMDFAATEXXPGVAWYLYPRLGYLPYVSTTEETAISSLKRSLGALNTH

SEQ ID NO: 42173 - DNA, 655 bp, Zea mays
  misc_feature: Ceres CLONE 1439560-F
  misc_feature: Encodes the peptide sequence at SEQ ID NO. 42174
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (449)..(449): n is a, c, t, g, unknown, or other
  misc_feature (450)..(450): n is a, c, t, g, unknown, or other
  misc_feature (537)..(537): n is a, c, t, g, unknown, or other
  misc_feature (630)..(630): n is a, c, t, g, unknown, or other
  misc_feature (631)..(631): n is a, c, t, g, unknown, or other
  misc_feature (633)..(633): n is a, c, t, g, unknown, or other
  misc_feature (635)..(635): n is a, c, t, g, unknown, or other
  misc_feature (638)..(638): n is a, c, t, g, unknown, or other
  misc_feature (640)..(640): n is a, c, t, g, unknown, or other
  misc_feature (646)..(646): n is a, c, t, g, unknown, or other
  misc_feature (647)..(647): n is a, c, t, g, unknown, or other
  misc_feature (652)..(652): n is a, c, t, g, unknown, or other
aaagctggagctccccgcggtggcggccgctctataactagtggatcccccgggctgcaggaattcgcacgagaccattacctagaacatcctaatcgaaaaattttgcaggaatccaaatcattcgccctctagatcgtgctgccatgtctctgtccacccccaccaccttgtgttccgcgacgtctcctctctctctctctctctctagagttgctgatagtttttttactaactcactccaccaaatccgttccaattccggtgcaaactgcttgttcgtgcgagacaataaagccatggaactagctaacccttgctgaactgtggaatggtttctgagcagagcgtnnntttttctgaagcagaccctgctggcgaccacgctggagctggaggcggcgagggaggagctgaggcggaaggagcagagcatcgccaagctgttnnacctggtgcgcgaggtggccaaggagcgcgacgacgcgcgggaccaggcgcagagcctccgcctcctcgctgcccaggccgcgtggntttcgtcacgtccagcgtcaccgactccgactgcagcctcgcgtcgtcccccgtggacccgttcttcgaccccgtcacgtccgccgtgttggnnancnccncncttacnnccccnccc

SEQ ID NO: 42174 - protein, 108 aa, Zea mays
  misc_feature: Ceres CLONE 1439560-F
  misc_feature (8)..(8): Xaa is any aa, unknown, or other
  misc_feature (40)..(40): Xaa is any aa, unknown, or other
  misc_feature (69)..(69): Xaa is any aa, unknown, or other
  misc_feature (100)..(100): Xaa is any aa, unknown, or other
  misc_feature (101)..(101): Xaa is any aa, unknown, or other
  misc_feature (102)..(102): Xaa is any aa, unknown, or other
  misc_feature (103)..(103): Xaa is any aa, unknown, or other
  misc_feature (106)..(106): Xaa is any aa, unknown, or other
MVSEQSVXFSEADPAGDHAGAGGGEGGAEAEGAEHRQAVXPGARGGQGARRRAGPGAEPPPPRCPGRVXFVTSSVTDSDCSLASSPVDPFFDPVTSAVLXXXXLTXPP

SEQ ID NO: 42175 - DNA, 636 bp, Zea mays
  misc_feature: Ceres CLONE 1439562-F
  misc_feature: Encodes the peptide sequence at SEQ ID NO. 42176
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
gctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggnnngcctgctcagcaatggtgactttgagacagcaccaagtggtggttttgtaaaatctgcttctgttgctgagggtgcatcgtcaatccctggttnnncgatcaacggcacggttgaactcatttcagcaggccaacaccagggtggcatgatcctgattgttccacagggggaccatgctgtnnnnctagggaatgatgctagcgttgggcaggtggtggacgttgagaagggttcggagtatgctatcacattcagtgctgcccggacatgtgcacnnnntgagtcactgaatgtttccgtgct

SEQ ID NO: 42176 - protein, 133 aa, Zea mays
  misc_feature: Ceres CLONE 1439562-F
  misc_feature (32)..(32): Xaa is any aa, unknown, or other
  misc_feature (33)..(33): Xaa is any aa, unknown, or other
  misc_feature (64)..(64): Xaa is any aa, unknown, or other
  misc_feature (65)..(65): Xaa is any aa, unknown, or other
  misc_feature (94)..(94): Xaa is any aa, unknown, or other
  misc_feature (125)..(125): Xaa is any aa, unknown, or other
  misc_feature (126)..(126): Xaa is any aa, unknown, or other
MEADSARKRLALLALLLLAAPVRPASAAPVEXXLLSNGDFETAPSGGFVKSASVAEGASSIPGXXINGTVELISAGQHQGGMILIVPQGDHAVXLGNDASVGQVVDVEKGSEYAITFSAARTCAXXESLNVSV

SEQ ID NO: 42177 - DNA, 615 bp, Zea mays
  misc_feature: Ceres CLONE 1439569-F
  misc_feature: Encodes the peptide sequence at SEQ ID NO. 42178
  misc_feature (72)..(72): n is a, c, t, g, unknown, or other
  misc_feature (73)..(73): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (348)..(348): n is a, c, t, g, unknown, or other
  misc_feature (439)..(439): n is a, c, t, g, unknown, or other
  misc_feature (448)..(448): n is a, c, t, g, unknown, or other
  misc_feature (506)..(506): n is a, c, t, g, unknown, or other
aaagctggagctccccgcggtggcggccgctctagaactagtggatcccccgggctgcaggaattcgcacgnnaccattacctagaacatcctaatcgaaaaattcctcggagaggagaagccgccgtcgcagcaatcacagcagcccggagaacggccaggtccgacaagatgcagatctttgtgaagacgctgacagggaagaccatcnnnctcgaggtcgagagcagcgacaccatcgacaatgtcaaggccaagatccaggacaaggaagggatcccgccggaccagcagcggctgatctttgccgggaagcagctggaggatggccgcacccttgcggactantacatccaaaaggagtctacgctccacctcgtgctcaggctgcgcggtggcatcattgagccctcgctgcaggcgctcgctcgcaagtacnaccaggacnagatgatctgccgcaaatgctatgcacggctgcaccctagggctgtcaactgccgcangaagaagtgtgggtcccagcaccagctgagggcaagaaagagatcaagaactgaaggggtgctgccagtccgtttcatggaacatgttggtttggttggtgaaaccggg

SEQ ID NO: 42178 - protein, 148 aa, Zea mays
  misc_feature: Ceres CLONE 1439569-F
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (14)..(14): Xaa is any aa, unknown, or other
  misc_feature (59)..(59): Xaa is any aa, unknown, or other
  misc_feature (90)..(90): Xaa is any aa, unknown, or other
  misc_feature (93)..(93): Xaa is any aa, unknown, or other
  misc_feature (112)..(112): Xaa is any aa, unknown, or other
MQIFVKTLTGKTIXLEVESSDTIDNVKAKIQDKEGIPPDQQRLIFAGKQLEDGRTLADXYIQKESTLHLVLRLRGGIIEPSLQALARKYXQDXMICRKCYARLHPRAVNCRXKKCGSQHQLRARKRSRTEGVLPVRFMEHVGLVGETG

SEQ ID NO: 42179 - DNA, 674 bp, Zea mays
  misc_feature: Ceres CLONE 1439579-F
  misc_feature: Translation starting site: 200
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgaacgcctccgtggtgggctggccgtggccacccggtgttcctgatcttcagccccgtgctcgtccccgccgcgctgctcatcgggacggccgtcatggggttcctcacgtcgggcgcgctggggctcgggggcctgtcctcgctcacgtgcctcgccacacggcgcggcaggggttccagcgcacccggactacgtggaagaggcgcacgcaggatggcggaagccgcggcccacgcgggccacagaacgcgcaggcaggccagccat

SEQ ID NO: 42180 - DNA, 673 bp, Zea mays
  misc_feature: Ceres CLONE 1439591-F
  misc_feature: Encodes the peptide sequence at SEQ ID NO. 42181
  misc_feature (492)..(492): n is a, c, t, g, unknown, or other
aagctggagctccccgcggtggcggccgctctagaactagtggatcccccgggctgcaggaattcgcacgagaccattacctagaacatctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtgtcgaggaagatcttcgactcnctgccggccggaggacaaccggctgttgccactcgcacgcgcaccaaatcaagttcaggccttgtgaacgagccccgcacgttgcgggggcttcctggaagaagggcgaagctgggacccccatggccccccccctttcgggcaaagttccgggtgcaccctgggcaagggggaacccccg

SEQ ID NO: 42181 - protein, 173 aa, Zea mays
  misc_feature: Ceres CLONE 1439591-F
  misc_feature (26)..(153): Pfam Name: DUF1264 Pfam Description: Protein of unknown function (DUF1264)
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLIGVEYIVSRKIFDSLPAGGQPAVATRTRTKSSSGLVNEPRTLRGLPGRRAKLGPPWPPPFRAKFRVHPGQGGTP

SEQ ID NO: 42182 - DNA, 691 bp, Zea mays
  misc_feature: Ceres CLONE 1439599-F
  misc_feature: Encodes the peptide sequence at SEQ ID NO. 42183
aagctggagctccccgcggtggcggccgctctagaactagtggatcccccgggctgcaggaattcgcacgagaccattacctagaacatcctaatcgaaaatccatcttatcatccgccgccaatgctgcgccgcaacccaacccgcatcgagctcacctcctccgaccgcgacgagctcgaagaccacctccgcgccgccgcggcgagctccaccaaggatccttccggttacaccactccgtctccagtccttggcccgcagacctccaatcccctgctccaattcctccacccgaagcccggcgccgcgccatccaagtcccaacgcatcggcatcggcctctccaccccgccggctccggccccgaacccgcgaccaccccatccacctcatggaggttgagatcaagctccgcctccccgacgccgccgcgcaccgccgcctgtccgcgttcctcgcgccccgcctccgccgcacccacgcccagcggaacctcttcttcgacgacgccgcgcgcacgctcggagccgccaccgccgcgctccgcgtccgcctctacgacgggcccgacgaccgcggcccctcgcgcgccgtcctcgcgctcaagcgccgcccgcggatcgaggccggcgtcagccgcgtcgaagagatcgaggagcccctcgagcccgcgctcgccgtcgcctgc

SEQ ID NO: 42183 - protein, 99 aa, Zea mays
  misc_feature: Ceres CLONE 1439599-F
MEVEIKLRLPDAAAHRRLSAFLAPRLRRTHAQRNLFFDDAARTLGAATAALRVRLYDGPDDRGPSRAVLALKRRPRIEAGVSRVEEIEEPLEPALAVAC

SEQ ID NO: 42184 - DNA, 691 bp, Zea mays
  misc_feature: Ceres CLONE 1439601-F
aaagctggagctccccgcggtggcggccgctctagaactagtggatcccccgggctgcaggaattcgcacgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgcctccatgccactaccctactcaaccgccccgggctcagcctgatccccagccacacccatgcccgtgccaacagccccatccaagcccgtgccatctgcagggaacctgcggcgttggcagaaccccgatccttggccaatgcggcggagttccggaggcattgttcctgcccgacggggacaccctagtgctcccctcaatgccaatcttttgggccttgcttgttgccgccgcctccggcagggggagccctctgcgcgggtaccagggcaatct

SEQ ID NO: 42185 - DNA, 665 bp, Zea mays
  misc_feature: Ceres CLONE 1439602-F
  misc_feature: Encodes the peptide sequence at SEQ ID NO. 42186
aaagctggagctccccgcggtggcggccgctctagaactagtggatcccccgggctgcaggaattcgcacgagaccattacctagaacatcctaatcgaaaactccgcatttccatcttcccgtgggatcccagccgccgccgcaagaagaagagctcggggacttccaggtgtcgcgagaagatggtcctagtgttgccgacatcgctgacggacccagacaatgttattctgctctggttttgtacaatctctccgaagcagatccacgagatcaaggatttccttctcaccgcgaggaggaaggatgcccgatcagtgaagatcaagaggagcaaggatgttgtcaagttcaaggtccgctgttccaagtacttgtacaccctttgcgtattcgacgctgagaaggcaaacaagttgaagcaatctctccccccaggcttgagcgtccaggaggtttgattggatacatggcaacgtcgggtcgaacctctagggcatctttatcattagcagagcatgctgtttatgtagttttggaccttaagctattagacatgtcagtgttggatttgtggatcttgaatttttggagaaataccaatttgcctcgttcaaggacgcacctttcagttttttcttatttaactgcatgttccccttcg

SEQ ID NO: 42186 - protein, 92 aa, Zea mays
  misc_feature: Ceres CLONE 1439602-F
  misc_feature (25)..(92): Pfam Name: Ribosomal_L38e Pfam Description: Ribosomal L38e protein family
MVLVLPTSLTDPDNVILLWFCTISPKQIHEIKDFLLTARRKDARSVKIKRSKDVVKFKVRCSKYLYTLCVFDAEKANKLKQSLPPGLSVQEV

SEQ ID NO: 42187 - DNA, 663 bp, Zea mays
  misc_feature: Ceres CLONE 1439618-F
  misc_feature: Translation starting site: 284
  misc_feature (24)..(24): n is a, c, t, g, unknown, or other
ggtttcagaaacagcccccgggcngcaggaactccccccagaccattaccgagaacatcctaatcgaaaaatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggctgcatcaagggctacaagcgcacctttaatctcgcttgcattgaccacagaggcacaccggagcatccggcgaggacctgcacgcttgaaaccgacgacgaggccatatgctgggggaattgcatattgtgtcaaggggtggtcagaaaaaagagctaaagcaatacagtacttggagagaagagagtgtgagtccgaccagaaaatatccattgatttcctacaggaaagagatccccttgaacccgttgtgacggggggtcttaagtggtccgttcccccccccgaaaccaattgggcaacag

SEQ ID NO: 42188 - DNA, 557 bp, Zea mays
  misc_feature: Ceres CLONE 1439620-F
  misc_feature (52)..(52): n is a, c, t, g, unknown, or other
  misc_feature (189)..(189): n is a, c, t, g, unknown, or other
  misc_feature (317)..(317): n is a, c, t, g, unknown, or other
  misc_feature (318)..(318): n is a, c, t, g, unknown, or other
  misc_feature (320)..(320): n is a, c, t, g, unknown, or other
  misc_feature (321)..(321): n is a, c, t, g, unknown, or other
  misc_feature (505)..(505): n is a, c, t, g, unknown, or other
  misc_feature (506)..(506): n is a, c, t, g, unknown, or other
aaagctggagctccccgcggtggcggccgctctagaactagtggatcccccngggctgcaggaattcgcacgagaccattacctagaacatcctaatcgaaaaagcagatcttgtgaccctccctcagccgcgtcgcgtcgcatcctacgatccaaagctctctctggtcgcaggtcgcagccatggcngaagaactacccccgaccgtgagcgccgaagttacagcaagggcttgtggacaaagcccagggcccaagcgtccccaacccccccttttcccccaaaaaaaaaaaaaaggggggggcccccccccttnnannaatatttccccccccgggggcccccccggggaattttaaatttttaaaaaagggggggctttttcgcggaaaaaaacacccccaaaattttcccggggggcccagggggggaaaaatccggggggtccccccccccccccgggggggggccccccccccccccccccaaaaaaataaccccggnnaaaatttttggggggggagaaaaacccggggggatgagggaaatctctccc

SEQ ID NO: 42189 - DNA, 635 bp, Zea mays
  misc_feature: Ceres CLONE 1439628-F
  misc_feature: Encodes the peptide sequence at SEQ ID NO. 42190
cgctctagaactagtggatcccccgggctgcaggaattcgcacgagaccattacctagaacatcctaatcgaaaagattgggtccaacaccagccgccgccatgtcgaagcgaggcaggggaggttcggcggggaacaagttccgcatgtcgctgggtctgccggttgccgcgacggtgaactgcgcggacaacacgggcgccaagaacctctacatcatctccgtcaagggcatcaagggccgcctcaaccgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggtgtctacatgtacttcgagataatgctggagtgattgtgattcccagggtgagatgaaaggtccgctatcactggacctatcggcaagagtgtgctgatctttggctaggattgctagcgcgcaaacgcatcgtttgaaactggttggatatggtcaacttctaatgacatcttataaccagtgctaaatggtttgggctaatgggcccttatggttgtccccccattttggaaaaacaaatttggtaccccgggg

SEQ ID NO: 42190 - protein, 103 aa, Zea mays
  misc_feature: Ceres CLONE 1439628-F
  misc_feature (19)..(101): Pfam Name: Ribosomal_L14 Pfam Description: Ribosomal protein L14p/L23e
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEIMLE

SEQ ID NO: 42191 - DNA, 819 bp, Zea mays
  misc_feature: Ceres CLONE 1439633-F
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttttcaccccccccctttccatccccctcccctcccnncgccaannncacaaaatggagctcacctcggtggcggccgctctataactagtggatcccccgggctgcaggaattcgcacgagaccattacctagaacatcctaatcgaaaaacagaccacggcttgctcgcgttgagtcttcaacatcacgtccctctctggatagctctccccctcacgcatacgaaaacactctctgctttccccaacctctcgctcatctctatcaaggagcacgcacgcaccgccccatcaaagccaaccatgacgcggggccggccgcccatggacttcccgccattcttgggcagctacccggtaccggacggagaaccgcggccgaagtggcccctcccgacgatgctgctgagagctaggttttttggctgccgcccctttccccacggacacgcagatgcgcagcttcttcccccgccacaggaaagctacccacactgacatcaaccggcacgctgttccctgggggccgccccggccacggtcggccggctacatccgggcttgcaggcggcacgtttgggggatgcatccgtccccctgctgccccatgttccatccgctcccccgcgcccggactgctcgtggggcccggaggcggctttaacccgtcaaacccgactcgccacggagcccgcttctcccctgtccggaacataaaaaatccgcgcttttcacggacccccgtgtatttccgcccaggcataggcacatcgcgcccaagccccgccccgcggaaaaacaccccttcctgggtctcg

SEQ ID NO: 42192 - DNA, 703 bp, Zea mays
  misc_feature: Ceres CLONE 1439642-F
  misc_feature: Translation starting site: 175
  misc_feature: SWISSPROT Homolog: EC 3.4.25.1 Proteasome endopeptidase complex
aaagctggagctccccgcggtggcggccgctctagaactagtggatcccccgggctgcaggaattcgcacgagaccattacctagaacatcctaatcgaaaaggcatccaacgacgcaattgacatcccctcgcctaccccagctctacccgcgacgaagcatcaccaggaaggatgacgtgctcaatggatctcccggccaagggcgggttcagcttcgacctgtgccgccgcaacagtatgctggagaagaacgggctcaaactcccgggattcaggaagaccggaacaaccatcgtcggcctcgtctttcaggatggggttgttcttggggcagacacaagagcaactgaggggcctatagttgctgaataaaattgtgagaagaatccactttatggcgccaaacatttattgttgtggagcaggaactgctgctgacactgaggctgttacagacatggtcagctcgcagctacagctgcaccgttacgcaacgggtcgcgaatctagagtcgtaactgctcttacactgctgaagtcacatctctttaggtatcaaggccatgtcagtgctgcccttgttcttggtggagtggattgtactggaccgcatcttcacactgtttatccacacggctccactgatactcttccttttgccacgatgggttctggatcccttgctgcaatgtcagtgttt

SEQ ID NO: 42193 - DNA, 783 bp, Zea mays
  misc_feature: Ceres CLONE 1439658-F
  misc_feature: Encodes the peptide sequence at SEQ ID NO. 42194
  misc_feature (740)..(740): n is a, c, t, g, unknown, or other
agtggcccggattgcaaccggccctacccctacctggtcccccttcccctccaacgggagctccccgcggtggcggccgctctagactagtggatcccccgggctgcaggaattcgcacgagaccattacctagaacatcctaatcgaaaaacttcaattggcgttggccgaagaacacgagaagcgaagcaggcaggcttcgcgaacaagggggagggggaggaccaagcgaatcggggaactagaccaagatgggcggcgaactgctgcttgcgctcccccccgcctctgttgctgccgcccctcaggaacttggagctgggaatggagacaatcacatgagaatcttccacgaggacatgattgagaccgtcaacacccatcccagtgcggggtggagactatcacgcaacccttactccccaaacccccccgttgcccctctgcccccgtgcttggagtgcaacaagtcccacacaatgccctaagcaagggtcctggccaaacttatcccagatcgatggaccttcccacagacctggaggccgcctttgcccgggcccagtcgcatccccattgggaacagaccccaaccaaggcaaccgcgccctcttgtagcggccaacgctgatgtggacacccctcccgggaagtcttctggatgcctcctcaccgggacgccctttaaactttgcgcgaaagcaccctagccggggacgagcccccgcccatccactgncccccaaacggcgtgttgacccgagggctttttccaacatggg

SEQ ID NO: 42194 - protein, 78 aa, Zea mays
  misc_feature: Ceres CLONE 1439658-F
MGGELLLALPPASVAAAPQELGAGNGDNHMRIFHEDMIETVNTHPSAGWRLSRNPYSPNPPVAPLPPCLECNKSHTMP

SEQ ID NO: 42195 - DNA, 682 bp, Zea mays
  misc_feature: Ceres CLONE 1439665-F
  misc_feature (613)..(613): n is a, c, t, g, unknown, or other
cgctctagaactagtggatcccccgggctgcaggaattcgcacgagaccattacctagaacatcctaatcgaaaaacgacgagttagacccgaagaaggacagcagcaccgagagcgccaacggaacggccgtgccagaggatacggcagcgacgacgactaaagcggcaacgtctcctacgaaaccgcagcagccgcagcagaaaaagaacaagcctctgctgaagaagtttgggagcttactgaaaaagaaaaacagcaagtagccgaacggtgggctgtactactactagtgttgttttgattttcttctttcctctccctttttcttttttttttctttttggggtctgtttgacgaggtgttgtgcttgctatgcgtcgtttaccgccaatgcctgtatttgtgggtgattggagaagtttgtgggtgtcgtgaattttttaacttggggacctatatggtgttggctgctgctgtctacacgtttgtggcagatcctcccatgtgtgtaaatggagttactcttcctgatcagaatgcatggctattcgtttctgggactgtgcagctcccctgatgattgcaaggtcatgtgatgtaaacctctancagagaatgtgatctggcatgcatttgggatcatagtgcaaaacacttgaaacagaatgagtttgctta

SEQ ID NO: 42196 - DNA, 701 bp, Zea mays
  misc_feature: Ceres CLONE 1439671-F
  misc_feature (596)..(596): n is a, c, t, g, unknown, or other
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaaccgcagttcccacccaccaaaccaaactctcctccacaaccacaacctcccccgccgcccctcctcttctcggcttctcccctgccttgttcggccccaaaacggcaagagccgacgccagcaaaccctcgggttcgggagggaaggaaggcacgagcagtgcggctgcctacccgcagctaaccccaaacagcaacgtcgtagccgacgagagcctccgccacctacccaccaactcccgcccgtcgtcgcctccgcttgggttctcgtcgagcagttggtgggcacctaccgcatccagccacagagagagagtgagccactgagccagggcggcaagggggagatgaagaagctgtaccagggcggcaagggggcggcgggtgcacccggcgccggctgacgcatcggcagccgtggcgctgccggccgccgtgctggccctggcgtccgcgctgacggccgaggagcaggaggtgctggcctacctcctngtcctgcggcggcggccggcaccaccacggccacggccgccgccgcggggcccacccgccggagatgggctgcgcctgcttcggctgctacaagagcttctgggn

SEQ ID NO: 42197 - DNA, 847 bp, Zea mays
  misc_feature: Ceres CLONE 1439672-F
  misc_feature: Encodes the peptide sequence at SEQ ID NO. 42198
  misc_feature (45)..(45): n is a, c, t, g, unknown, or other
  misc_feature (47)..(47): n is a, c, t, g, unknown, or other
agtggcccctctccctcacgaagccatatgacaaaaaaagaaccncnccacacagctggagctccccgcggtggcggccgctctacactagtgcatcccccgggctgcaggaattcgcacgagaccattacctagaacatcctaatcgaaaaatgtgcggctgctccgtgcctggttgccagcctgccacagctcggttctataatccactccctgacctgtgcggcgttcccgtgtccggacggaacatcgatcgcaaggcccgcgccggcgccgcgcataaggactcagcgctgctctaccactacccgtgcccggacggagcgttcgaagcgctcgccgctcagctctgtttttcccgtgctgcccacccgaggagatccttcccccataccgactacgaccacatcaggagcgattccacttcccctggaagaaaaaaaagatgtgtacctgtctggagctcccaggcaccctcctgggttttcttgtacgacactgcccccctgggggccgaaaccctaacccatccctggactctcttaagcacccgctttttagaaccaattgtgcctgtaaaaggcccaccctttccgggcaaagatcgtgaccccaaggttggaatggaacatttccccccacccgggttgccacacaaatcgccctttgaacgtggccgtcttatacaaaaggtttctttaaaaccaaactttgagccccccccccgggggtcttataagaaaggggggcataaaccctcttccttccaagcgcgcaaaatatttttacgcctcgatatctgcggggacctcaaaacccgctcccgcacgtcttgttttttcaatat

SEQ ID NO: 42198 - protein, 231 aa, Zea mays
  misc_feature: Ceres CLONE 1439672-F
MCGCSVPGCQPATARFYNPLPDLCGVPVSGRNIDRKARAGAAHKDSALLYHYPCPDGAFEALAAQLCFSRAAHPRRSFPHTDYDHIRSDSTSPGRKKRCVPVWSSQAPSWVFLYDTAPLGAETLTHPWTLLSTRFLEPIVPVKGPPFPGKDRDPKVGMEHFPPPGLPHKSPFERGRLIQKVSLKPNFEPPPRGSYKKGGHKPSSFQARKIFLRLDICGDLKTRSRTSCFFN

SEQ ID NO: 42199 - DNA, 732 bp, Zea mays
  misc_feature: Ceres CLONE 1439676-F
  misc_feature: Translation starting site: 254
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaacgcactccgcaattccgcatcacgcaccccaccccaccgcccgcaaccgcaagctcagattccctcccaccccaccccaccgtcccgctcactccagcccagcccgcgtccccacagcccagcgacagcgagcaccggcggcatccagccatgtgcggcggcgccatcctgtcggacatcatcccgccgccgccgccgcggcgggtcacggcgggccacctctggcccgagagcaagaagccgaggagggctgcagccggcaggaggagagcccccgtggagcaggagcaggaggaggatttcgaggccgacttcgaggagttcgaggtggagtccggcgagtcggagctcgagtccgaggacgagcccnagcccagccctttcgccgccccagcagcgcgctcgccagagtggactaaacactggtgcagctggtgtccatggccctgctgcaaatccgttaaaagaagaggaagacccggtcaggggtatccgcccgcgcccgtggggcaaatggctgctaaaatcaaaaatcctcaaaaggctgggccctctggcgtcgaacatttaaccctcccaaaaaactttccaaattttaccaccccagggcccgagaacccgcggaaaaa

SEQ ID NO: 42200 - DNA, 700 bp, Zea mays
  misc_feature: Ceres CLONE 1439688-F
  misc_feature: Encodes the peptide sequence at SEQ ID NO. 42201
  misc_feature (539)..(539): n is a, c, t, g, unknown, or other
agagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccagtagctctggcaaacctttctccctactctcagcaaacacaatttcttcatttcaccnactgtctacattgaaccggtgctgctatttgcagcaacaactattaccatcagccagttagttactgcctactttaagaacaacaaatttcttcatttaacaaatggcccccctggaacccgcctgcttatttgccccgccaatacctcctcccttttgcc

SEQ ID NO: 42201 - protein, 104 aa, Zea mays
  misc_feature: Ceres CLONE 1439688-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQ

SEQ ID NO: 42202 - DNA, 678 bp, Zea mays
  misc_feature: Ceres CLONE 1439690-F
  misc_feature: Encodes the peptide sequence at SEQ ID NO. 42203
  misc_feature (404)..(404): n is a, c, t, g, unknown, or other
  misc_feature (612)..(612): n is a, c, t, g, unknown, or other
  misc_feature (627)..(627): n is a, c, t, g, unknown, or other
  misc_feature (651)..(651): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccagaatgcatgagggcgtgccgccgccgcggactggccgtcgacatggagcaagagtacggtcgncgcaacgagagcgcngggcaagtgccggggagaggtgcnagccccaccaccgcggggactgggggg

SEQ ID NO: 42203 - protein, 114 aa, Zea mays
  misc_feature: Ceres CLONE 1439690-F
  misc_feature (64)..(64): Xaa is any aa, unknown, or other
MGKGSVGASWWAFLLLAGVLLVVAATAGAEDGVVERDRKEDLRWCKQACEWQYGKDTPRKRECXSECRERHQQADAGEDGDSGVDAYVSRSGRGECRRQCLRRHEGQPWETQNA

SEQ ID NO: 42204 - DNA, 795 bp, Zea mays
  misc_feature: Ceres CLONE 1439697-F
  misc_feature (48)..(48): n is a, c, t, g, unknown, or other
  misc_feature (508)..(508): n is a, c, t, g, unknown, or other
  misc_feature (564)..(564): n is a, c, t, g, unknown, or other
  misc_feature (615)..(615): n is a, c, t, g, unknown, or other
  misc_feature (700)..(700): n is a, c, t, g, unknown, or other
  misc_feature (774)..(774): n is a, c, t, g, unknown, or other
  misc_feature (788)..(788): n is a, c, t, g, unknown, or other
aaatcacacgccaccctacgccggggccgcctagcgggcgcccacccncttaaaagtggggctccccgcggtggcggccgctctagaactagtggatcccccgggctgcaggaattcgcacgagaccattacctagaacatcctaatcgaaaaattttgttgtgctcttctctagacaatcttctacagagacatgggtaatgagagagacgaggtggtactaaacaagatctgaggcttatcgattttcaaaagaaatggcgacccaagccccatgcttcttcgttggatcggccgtgtgcctgtcctctctaggcggcgttgccaacgcagacaccgacaacttagagattttctgaagccaaggatcgcctcattgtcacagttgtccagtggaatgcgccacccgcctcatcctgttccttcacggagggagggcgctgctattttggaggtttcccacccccgcaactgggcgcttcataaacacgccgtgccgggggccttncgggactccttatgggagttcaccggcgaacacgaaggggaacactgccgggtcgntctcctctgttccacgtaagaggattgggcctatttttattacagaggggnaaattatacaccccccccctataggtgagacaagaccacaaaactggggggtttttgcttccatacttgaaaccgaacgggaaanacacccggattgaggttacataggaatgaagaaccccctgtcttacgcgaccggtttgtcctcctccctcgagnctacatataaactntttcgga

SEQ ID NO: 42205 - DNA, 793 bp, Zea mays
  misc_feature: Ceres CLONE 1439697-R
  misc_feature (13)..(13): n is a, c, t, g, unknown, or other
  misc_feature (721)..(721): n is a, c, t, g, unknown, or other
  misc_feature (725)..(725): n is a, c, t, g, unknown, or other
aaagttatatttnggtcgtcttaatccttaacttcagtttgttgagagccatctttttgtgagtttgactgcacaataaaaagaagaaaaaatggtcaagctgacatgttaacatgtacactagcggtcatgaccgaatcacaaaccggacaagtttgtaacgaagccgatcctcagactgttacactaacacaaatgacgacaaggtaacacctacacgctcgcttctctatcagtttatcgcttgcaacaacatccttcctgaataatagcgccgcaacattgaactcaacggatgctgcttcgactccccataatcttctgctacgggtggcgcgatggtcaacctcttgtgatttgagctatatcttaatctacgtttgttcgaacgtcatcctcgtgtgcttccttggtttgagccatctcactccatgctccgtttgtcaactgttagtcacttgaccctgtgatgcattacccctctaaaatgtgccatacgtacgatctcgaaccactgtccatctggaaatcatgagctatgcgtcctactgaacgagatcactaacatcgttcctttgcgttcgatgacgagcttcatgctctgtcgtagtctggacgatcgctgagctacaaactgagcaatagcagactgttggtgcgtgctcgatagtaatgtcaaagtgccccgtagtccatctacgaagctaagccaaaggcaccngacntactgctgacctgagacgcaaactgatgctctagagcaaggtgactcccctctaggacgtatggccta

SEQ ID NO: 42206 - DNA, 673 bp, Zea mays
  misc_feature: Ceres CLONE 1439706-F
  misc_feature: Encodes the peptide sequence at SEQ ID NO. 42207
tcagaactagtggatcccccgggctgcaggaattcgcacgagaccattacctagaacatcctaatcgaaaagttcaccttccgccgtccggttccgacggcaaggcctccggaaccggtggcaagtggcgtaggaccgcggccggtacggacacctcgaggcgtcgcacttcggtgccgcgtgggagtcttccagatcgtcaacgcctggcggggatatcccgagtgcgaggggaacctcgacggcgcgagtacgtctctacgtcctgtcgggaaaaaaagatttgcaatctaatatatttatggaagcctttgctctgagataaaagttgcggggtcagacagatgagggaggacctcccaagaaagagtggtggaagcccacatcagcactccccctcccaaaagtcgtgggacctaacttgtggtatggggattctacaacagttacacacaaggaagaacaagttgtacttggtttgtcacgtgactgtggctctggtgttctatcttacgttttccccgtgaatgacgcaaatgttgtccagatacagagggcattggcaagaccctttcttaagctacccaggttcgggggatctgagcaattttggggtgagaaaccatagtttttgaaggcagggtaccgggccggaattcatgctcgtctttta

SEQ ID NO: 42207 - protein, 60 aa, Zea mays
  misc_feature: Ceres CLONE 1439706-F
MREDLPRKSGGSPHQHSPSQKSWDLTCGMGILQQLHTRKNKLYLVCHVTVALVFYLTFSP

SEQ ID NO: 42208 - DNA, 710 bp, Zea mays
  misc_feature: Ceres CLONE 1439707-F
aagctggagctccccgcggtggcggccgctctagaactagtggatcccccgggctgcaggaattcgcacgagaccattacctagaacatcctaatcgaaaaggttctgtttgtttggtgagatgtgttttcctctttctcctacgttgtgagtttccatttggtggacatccttttccagatcccttcgtggattagatccacgctcctctagtcgagatcgtcttgcatttttctgagatggagattgggaccgaaaaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaaccttgttacagcagttacaacttctgagagtcccagcagccctagccgctattgtgtgtctgaaatttactcttg

SEQ ID NO: 42209 - DNA, 729 bp, Zea mays
  misc_feature: Ceres CLONE 1439713-F
  misc_feature: Encodes the peptide sequence at SEQ ID NO. 42210
aagctggagctccccgcggtggcggccgctctagattagtggatcccccgggctgcaggaattctcacgagaccattacctagaacatcctaatcgaaaacttaactgaataagaaactatggagggatgattctccgctccggtcctcacttttatgtagatcatctggagcgggcccgctgcacagaccgtatccgtctacgcggaccgcgcgaagatcaagactgcgatcatagatggttgtatggcgaaaggcctctcctggagctgttacctcaccgcctgcaccaaagtggaaaacttctcgggcttccacatcaggatcatgtccgcagacatcttggataactgccgcgcgtactccctgtactttggcatcaatgtcctctccaagaacgtcaacgacctctacttttcgacctgtccattcgtagataatgaaaactctcctccctccctaatctaagcctctatcgatgccactttagccgtctcgagaaccctccacttctccgggtcagatgcgtactggaaccgcctcatcgctcccagtgctgtctgtgacggtgccggactcatcttccgtatacaggagatccacagtatactgggacggcgactccgactatgagatgagtaccattctcctacacagagtacggactcccacataatatgtccatccaccgttcgcaatacgcttaccgtgacttcataagatcaatgtc

SEQ ID NO: 42210 - protein, 73 aa, Zea mays
  misc_feature: Ceres CLONE 1439713-F
  misc_feature: SWISSPROT Homolog: EC 1.8.1.9 Thioredoxin-disulfide reductase
MAKGLSWSCYLTACTKVENFSGFHIRIMSADILDNCRAYSLYFGINVLSKNVNDLYFSTCPFVDNENSPPSLI

SEQ ID NO: 42211 - DNA, 728 bp, Zea mays
  misc_feature: Ceres CLONE 1439716-F
aagctggagctccccgcggtggcggccgctctagatctagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatcccagcccgtgccagctgcagggaaccctgcggcgttggcaccaccccgatcctgggccagtgcgtccagttcctgaagcattattgcagcccgacggcgacgccctactggctcgctcaatgccaatcgttgccgcagcagtgttgccagcacctcaagcaggtggaacccccacaccggtaccaagcgatcttcggcttgggtcctccagtcccatcctggaacaacagcccga

SEQ ID NO: 42212 - DNA, 728 bp, Zea mays
  misc_feature: Ceres CLONE 1439724-F
  misc_feature: Encodes the peptide sequence at SEQ ID NO. 42213
ggagctccccgcggtggcggccgctctatatctagtggatcccccgggctgcaggaattctcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgagtccaggtcgacggcggaggaggtgaccccggacctgggcgcgacgacggccatcatcacgggcgccacgtccgggatcggcgccgagacggcgcgcgtgctggcaaagcgcggcgcgcgcgtggtgatcccggcgcggagcgccaaggcggcggaggacgtgcgcgcgcgcatcgtgaccgaaagccccgccgccgccgtcctcgtgctcccgctcgacctcagctcgctcgcgtccgtgcgcgccttcgccgacaggttcctagcgttcgggctcccgctccacctcctaatgtacgtacgttcgtcgatcgggggcgccgccaccgcagccctcgtccaagtccacagtacatgtatgtatgcgtatgtgtgtaatgcctgtgcccccgcccgtgcaaaaaaacccccggaagttctcgcacgggcagttggccctctcgaaggacggcgtgggagataaactttcgccaccaactaacttgggccactttccg

SEQ ID NO: 42213 - protein, 171 aa, Zea mays
  misc_feature: Ceres CLONE 1439724-F
MLRAARYLLGSPGASGFESRSTAEEVTPDLGATTAIITGATSGIGAETARVLAKRGARVVIPARSAKAAEDVRARIVTESPAAAVLVLPLDLSSLASVRAFADRFLAFGLPLHLLMYVRSSIGGAATAALVQVHSTCMYAYVCNACAPARAKKPPEVLARAVGPLEGRRGR

SEQ ID NO: 42214 - DNA, 721 bp, Zea mays
  misc_feature: Ceres CLONE 1439727-F
  misc_feature: Encodes the peptide sequence at SEQ ID NO. 42215
  misc_feature (721)..(721): n is a, c, t, g, unknown, or other
aagctggagctccccgcggtggcggccgctctagattagtggatcccccgggctgcaggaattttcacgagaccattacctagaacatcctaatcgaaaagtctacgatgccgttgcgcacctcttctctctcgccgccccgagacccccacgcttccctctccgcccccgaactgtggcgcctccccccgccgccgcaacgatgccactcgcggcagagcccgactacgctcatgaggaaagggagaatcatcagctgctaattacaacgaagggagggcccgggcttgagggactggtggtggggagctactgccacgatgtgctaatcccgggcgggcgcatagtgggggagacgctcggcggggctgcggccttcatgtccaacgtgctctacgccgcttcgccccagggcgccacgctcaacgagacatccccctttgtcgttgtggccaaggtgggtcacgacttcatctacgcccgcgcgccggtgtcggcgcggcatccgcctctgctctgctcgtccccaaccacctccttccacgctcagttctcggagaccgccgcctctgcgcacgcccccaatcgggagctccggcgcgtgcgctcctgcgacccgatctaccccgccgagcttcacgagcgccgcttctcctacagactctctgtctgcgtcaccagaaaagtgcttccggagaccctctaccagatgatctggctn

SEQ ID NO: 42215 - protein, 173 aa, Zea mays
  misc_feature: Ceres CLONE 1439727-F
MPLAAEPDYAHEERENHQLLITTKGGPGLEGLVVGSYCHDVLIPGGRIVGETLGGAAAFMSNVLYAASPQGATLNETSPFVVVAKVGHDFIYARAPVSARHPPLLCSSPTTSFHAQFSETAASAHAPNRELRRVRSCDPIYPAELHERRFSYRLSVCVTRKVLPETLYQMIWL

SEQ ID NO: 42216 - DNA, 679 bp, Zea mays
  misc_feature: Ceres CLONE 1439728-F
aagctggagctccccgcggtggcggccgctctatactagtggatcccccgggctgcaggaattcgcacgagaccgttacctagaacatcctaatcgaaaaagcgatctaggccgccgcctctcctactgcatcgccctcgctctcgtcggctcgttcgcttcgcctccgccgcgccccgtcccaagaagagcgcatgcctatccggagctgggatgggggacgctaagcattaccagcaccatcagcggccgccgcagcaggcgtgagcggcagccaccggtgtgcggaaaacagtctagcccttctttaacggaggggcctctggcatgctcacaacctgcgccatcctgcctatctacatggtctgggtgaggatccagtagggcgagggatctggtggtcagggcacaaggaacatgcttgctaaggagggtgtccgttctttctacttggattgaccgacgaattgctgacgcaagcaacaacacgagtgctcggcttgaatcatttacgggtcgttctaacagatggggtcattataatgaggggcatccattgcctcgatgtcaaaaagtgtttgttggcctgactgctggtgcacttggcgctagtgttggaaggcctgctgagctggcactcattacaatgcaggtctattcaaccccgcgggttgcacta

SEQ ID NO: 42217 - DNA, 697 bp, Zea mays
  misc_feature: Ceres CLONE 1439735-F
  misc_feature: SWISSPROT Homolog: EC 1.14.11.20 Desacetoxyvindoline 4-hydroxylase
tccccgcggtggcggccgctctagaactagtggatcccccgggctgcaggaattcgcacgagaccattacctagaacatcctaatcgaaaaactttctctttgtctcgtcagataataaaggactgttggattaatatggctccaacgaccgccaccaaagaagactgtggctactgttactagtgccggtgctagctgcaggcgttctacaaaacaaagctgggggtgaaaggtctggtggactcctgcatcgaatccatcccgtccatcttccaccacccgccggaagccctgagcgacataatttctccggagcctctgccgccgtctccgccctccggcgccgccctcccggtggtggacctctcggtgacgcggcgcgaggacctactcgagcaggtgatgcactcgcccaggactgtgggcttcttctgcctggtgaaccgcgcagtgccttaggagctgatggccgacatgctccgcgggatgctccatttcaactagtgccccgtggacgcgaatcacgcgctctactcgagtgacctcgctctcaacatgagcttcacctcctacttctacctctatcaggctgctgatttcagatgccatctacactctctttccgttaggtggctccgaacccgccacctcgggaggagctgctggattcgctcatgtacgtgatgctggaatatg

SEQ ID NO: 42218 - DNA, 873 bp, Zea mays
  misc_feature: Ceres CLONE 1439737-R
  misc_feature: Translation starting site: 565
  misc_feature: Pfam Name: EF1G Pfam Description: Elongation factor 1 gamma, conserved domain
cgaattgggtaccgggccccccctcgaggtcgacggtatcgataagcttttttttttttttttttaatcccaaaccagcacaaattttaaccagttcatagcagggtataccaaatcaccttcaaccctagtaaaagggcaaactcttccataggcaaattcaagggctaaacatttctgtctccgggcaagcacactcacttgaagcatttcgcgtcaagcaaggcctccccctcaaagggctccgggccctcaatcatcgcattgacaccctccttctgggcctcatcaaaaatgccccccttggcccactcgaaaagccccatgtcataaacctcatccattacaaacttgggaacatcctggccacgaaaaacccaaaggcccttcaccttgaaggggggctcaaagcctatcacgagcatcttcccaaaggcgtacttgcggcacaggtccatccgctgcagaaatccaccaaccttgttcagggccacaaaggaaacggggttcccatcattgaacttgtagccccaaaaccacaaaaagaacccctctgggtcgaacatgtcccaaaaacctttgatggcaacctcccgaaagttggcctttgtgtttgagtatagcctcttccagtcatcaaggaccatcttgcttggtggcaccaagtcaagagaattctttggctttggctttggggcttcctcttctgctggtgcctcaaccccctttggcttggtggcctcctttggagcctccttcttgacatcctttgcctttggctccttaaaagaagcacctttttcgaaaaggaagggcaaactctgcctgcttgacctcacaagtgaccttcttgaagttaggcgggtaaacatg

SEQ ID NO: 42219 - DNA, 664 bp, Zea mays
  misc_feature: Ceres CLONE 1439737-F
  misc_feature: Encodes the peptide sequence at SEQ ID NO. 42220
ccccgcggtggcggccgctctagaatagtggatcccccgggctgcagattcgcacgagaccattacctagaacatcctaatcgaaaaatcacatatttccgccgcccctctccctcagtaaacccccctctcttcttcccgcggtctgctcgttcgatctgtagcagcagatctgaggtctccagcgaccgtgaagcaacttcgatcgtggggatggcgctcgtattgcatagtggggctggaaaccagaatgccttcgaagcacttattgctgcccaatacagcgggatcaaggttgagttgaccagggattttgagatgggtgtctccaacaagacccctgagtttcttaatatgaacccccttgagaaggttcctgttctggacactcctgatggccctgtttttgaaaggaatgctctctcacgctatgtggatcgcttgaccgagactcccctctttttgggtgcttcccggattggacttccctcttggagaaatgaagggattttgacccatcaaaagttgatcctggggttacaagaaactctggatcaaggcttgtggacctcccttatgtccctggactgaggaaacagctatttcttcgttgatgaggtcgcttgccgatctgaacacacaccttgcctgcaacgcatacctg

SEQ ID NO: 42220 - protein, 125 aa, Zea mays
  misc_feature: Ceres CLONE 1439737-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGAGNQNAFEALIAAQYSGIKVELTRDFEMGVSNKTPEFLNMNPLEKVPVLDTPDGPVFERNALSRYVDRLTETPLFLGASRIGLPSWRNEGILTHQKLILGLQETLDQGLWTSLMSLD

SEQ ID NO: 42221 - DNA, 709 bp, Zea mays
  misc_feature: Ceres CLONE 1439738-F
  misc_feature: Encodes the peptide sequence at SEQ ID NO. 42222
  misc_feature (462)..(462): n is a, c, t, g, unknown, or other
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgcaccacggantgccggaggagctgatgggcggcatgctccggcgggtgcgtcagttcacgcaggccccgtggaagcgaagcaggcgctctactcgagggacctcgctcgcacctgcgacttcgctccaacttctactctttcaagctgctgcggtcgactggcgcgacacgctcttctgcgaagtggctccgaacccgccccgcgggaggagctgccggacccactctgaacgtgatgcttgagtaccgccccgcgg

SEQ ID NO: 42222 - protein, 182 aa, Zea mays
  misc_feature: Ceres CLONE 1439738-F
  misc_feature: SWISSPROT Homolog: EC 1.14.11.20 Desacetoxyvindoline 4-hydroxylase
  misc_feature (106)..(106): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVHHGXPEELMGGMLRRVRQFTQAPWKRSRRSTRGTSLAPATSLQLLLFQAAAVDWRDTLFCEVAPNPPRGRSCRTHSERDA

SEQ ID NO: 42223 - DNA, 726 bp, Zea mays
  misc_feature: Ceres CLONE 1439743-F
  misc_feature: Encodes the peptide sequence at SEQ ID NO. 42224
aaactggagctccccgcggtggcggccgctctagaactagtggatcccccgggctgcaggaattcgcacgagaccattacctagaacatcctaatcgaaaagatttgtttaccccccgaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggtggtatggcggcgccgccggcgagggccagggccgactacgactaccttatcaagctgctcctcattggagacagcggtgttggcaagagttgcctcctgttgcggttctctgatggttccttcactacaagctttattaccacaattggtattgactttaagatacgaacgatagaattggatgggcagcgtataaagctacagatttgggatacggcgggccaagaacgcttccggactattaccaccgcgtactaccgaggagctatgggcatcttgctggtttatgatgtcaccgatgaatcttctttttaacacatccggaactggattcggaaacatggacaacacgcctctgattatgtcaaccaagatttgggttgcaaacaggccgatatggacgaaagcaagaggctgtacctactgcaaaagaacagcacttgctgatgagtacgggatcaagt

SEQ ID NO: 42224 - protein, 103 aa, Zea mays
  misc_feature: Ceres CLONE 1439743-F
  misc_feature (17)..(104): Pfam Name: Ras Pfam Description: Ras family
MAAPPARARADYDYLIKLLLIGDSGVGKSCLLLRFSDGSFTTSFITTIGIDFKIRTIELDGQRIKLQIWDTAGQERFRTITTAYYRGAMGILLVYDVTDESSF

SEQ ID NO: 42225 - DNA, 713 bp, Zea mays
  misc_feature: Ceres CLONE 1439748-F
  misc_feature: Encodes the peptide sequence at SEQ ID NO. 42226
aaagtggagctccccgcggtggcggccgctctagaactagtggatcccccgggctgcaggaattctcacgagaccattacctagaacatcctaatcgaaaaatcaaccatattattgagaccaacaagcaacatagaaagtggaatccagtaacaacaatagagcaacaatggcgaccaagatattttccctccttatgctccttgctcttactgcatgtgttgctaaggcgaaaattttccctcaatgctcacaagctccgatagcttcccttcttcccccataccttccatcaatgatagcttcagtatgtgaaaacccagctcttcaaccctataggctccaacaagcaatcgcagcaagcaacatacctttatcacccttgttacaacaatcgccagccctatctttggtgcaatcattggtacaaaccatcagggcacagcagctgcaggaaatcgtgatacctgtgatcaaccaggtagctctggcaaacctttctccctactctcagcaacaacactatcttccattcaaccaactgtctacattgaaccgtgctgcttatttgccgcaacaactattaccattacagccagctaactacgggctacatctcgaaaccaacaacttacttccatttaaccaattggcccgaaaggaacccccgccgcctatttgcaagaactaaatacccacaccaactttagcca

SEQ ID NO: 42226 - protein, 173 aa, Zea mays
  misc_feature: Ceres CLONE 1439748-F
MATKIFSLLMLLALTACVAKAKIFPQCSQAPIASLLPPYLPSMIASVCENPALQPYRLQQAIAASNIPLSPLLQQSPALSLVQSLVQTIRAQQLQEIVIPVINQVALANLSPYSQQQHYLPFNQLSTLNRAAYLPQQLLPLQPANYGLHLETNNLLPFNQLARKEPPPPICKN

SEQ ID NO: 42227 - DNA, 676 bp, Zea mays
  misc_feature: Ceres CLONE 1439750-F
  misc_feature: Encodes the peptide sequence at SEQ ID NO. 42228
aagctggagctccccgcggtggcggccgctctagaactagtggatcccccgggctgcaggaattcgcacgagaccattacctagaacatcctaatcgaaaaaccgacctttccccctcccccgcattccacctcgcggagatccagtccagccctagggtttcgccagcggcgagccaaactccacgagcgggggaagaggggaaagcagggactacgagggggcggccatggggcagcagtcgctgatctacgcgttcgtggcccgtggaacggccatactggccgagtacacggagttcaccggcaactgcaccaccatcgactcccagtgcctcatgaacctccccgcaagcaacaacaagttcacctacaactgcgagggtcacactttcaattacctcgtggaagacggattcacatactgtgttgttgctgttgaatcggtggggcaaccaattcctattgctttcatggatagggctaaggaggatttcacctaacggtatgggggtgggaaagctgctactgctgcatctaacagcctctatcgagagtttggatcaaaacttaaagaacacatgcagtattgtgtggatcaccctgaagaggttagcaagctggacaaagtgaaggcgcaggtttcagaagtcaagggtgttatgatggaaaacatc

SEQ ID NO: 42228 - protein, 90 aa, Zea mays
  misc_feature: Ceres CLONE 1439750-F
MGQQSLIYAFVARGTAILAEYTEFTGNCTTIDSQCLMNLPASNNKFTYNCEGHTFNYLVEDGFTYCVVAVESVGQPIPIAFMDRAKEDFT

SEQ ID NO: 42229 - DNA, 716 bp, Zea mays
  misc_feature: Ceres CLONE 1439751-F
  misc_feature: Encodes the peptide sequence at SEQ ID NO. 42230
aagctggagctccccgcggtggcggccgctctagattagtggatcccccgggctgcaggaattctcacgagaccattacctagaacatcctaatcgaaaaaatctctctcttctcctcgcctcgccttggtgttcacgccgtcgctagcgcctgctgcggcaaaacttctgtcctccccggcgccaggctcgggtcgtcgtcggccaggcagctgctacgcgtgaacacggccacaccagtatgggagtaccacgccacatgaacggtgaactcgtgaagaacaaagccgccactgaggaaaccctagcgacggcggcgtgctaccgatgacattgtccccctcggcccctccatccctgacgcagcggcgccagcctgcacgaagcctgcccctattcaagacaaggtcgatctttgctgccttggcgagcttcagccgaatcaaggtcgagcatggcggcaggcctgtaaatagagcaacacataacccttcaaattaatggagacctctgcagcaaccccgacccggccgccacaccaggcggccacttccccatcgccatcgccctcgtcgtcactgaggctgtgtaggccagcggcacatcgcaacatgcgcaatcagtggtcccatctgaacgccgccaatgagcagtggctggccgacgttgctgacgggcgggctcacgcctccgggctacggaacgtccacctctct

SEQ ID NO: 42230 - protein, 72 aa, Zea mays
  misc_feature: Ceres CLONE 1439751-F
METSAATPTRPPHQAATSPSPSPSSSLRLCRPAAHRNMRNQWSHLNAANEQWLADVADGRAHASGLRNVHLS

SEQ ID NO: 42231 - DNA, 738 bp, Zea mays
  misc_feature: Ceres CLONE 1439752-F
  misc_feature (435)..(435): n is a, c, t, g, unknown, or other
aagctggagctccccgcggtggcggccgctctagaactagtggatcccccgggctgcaggaattcgcacgagaccattacctagaacatcctaatcgaaaaacggagcataacgaaacgcggcttccagcacaacccaactgagcgcgactcgactccaatcgaagagtcccgtcctttcggttctacctttccctcccaaggcgacgcatccgcctccagggccggggaaaccctagccacctcgtcagtgccgcgcgccgggtgtatcgtcgtcgtccgtcactggagctgacaccgccggagcgatcggatctcgagaccgtcacgagacacaatggatgattgcgattcagaatattaccagcccgttgctcctgttgcgaaagtcgagccgcttacaatcagcgtgctgatgaacatgtggatgccaacnacttaaacattcatgtcaagaagagtatgactacgaaatacctactcaggcggctggtctaacaaacgcgactaaatcatgagcctagggcttcctgtgaaaaccggaaaaactcaggctccaccaggggccgaggacaccaaccaacctttggatcccccttaagaaaaaactcccccaaggagggttagggaaaaaattggacttccagttcacctccgaacccttttaacaagaaaacgggggaaccaaaaacccaaaaaaggttgttccccaaatccccaaaagggtttttgcgaaaag

SEQ ID NO: 42232 - DNA, 746 bp, Zea mays
  misc_feature: Ceres CLONE 1439755-F
  misc_feature: Encodes the peptide sequence at SEQ ID NO. 42233
  misc_feature (445)..(445): n is a, c, t, g, unknown, or other
tccccgcggtggcggccgctctagaactagtggatcccccgggctgcaggaattcgcacgagaccattacctagaacatcctaatcgaaaaacattcctaaagtttgtgtccgcaatgatccaaagtccaccaaaccgagatcatgtggaggatcatcaatcatttgatctggaagattggcttccaataacagcatcaagaaatgcaaattggtactattcagctttccacaacgtaactgcaatggttggtgctggagttcttggccttccctacgccatgtcagagcttggatggggacctggggttgcggtgctgatcctgtcatgggtgatcacgttgtacaccctctggcaaatgattgagatgcacgagatgtttgaagggcaacggtttgataggtaccacgagctgggtcaggcagccttttggaagaaagctggnttgtatatcatcgtggccgctacagcttcttggtgaaacaaggcgtgcattacctatatggtgacgggaagtgaatcgttgaaaaaggttcctcacctttccgtggaaaatgacagtggcccaaagctaaaaaccgaaaccttcattttaaaatttgcccctccccaatttggggccctccccctcttaaaaaatttcacccccatttccgggggttcccttttgggggcccccccctttttttttaaacatacccccaaaaaacgttgggggaacccccccggggaaaagggaacccccg

SEQ ID NO: 42233 - protein, 121 aa, Zea mays
  misc_feature: Ceres CLONE 1439755-F
MIQSPPNRDHVEDHQSFDLEDWLPITASRNANWYYSAFHNVTAMVGAGVLGLPYAMSELGWGPGVAVLILSWVITLYTLWQMIEMHEMFEGQRFDRYHELGQAAFWKKAGLYIIVAATASW

SEQ ID NO: 42234 - DNA, 711 bp, Zea mays
  misc_feature: Ceres CLONE 1439758-F
  misc_feature: Encodes the peptide sequence at SEQ ID NO. 42235
aagctggagctccccgcggtggcggccgctctagaactagtggatcccccgggctgcaggaattcgcacgagaccattacctagaacatcctaatcgaaaaaaatttctcctctctaacaaccctatcggtaaaacctttgctccgtcccgccgtcgcctgttcccatcccgccgccggcgatgccaccggcatctggcaaggagatcaccgccggggagggtgctcgcggggccatcctgtctcccgtgcccgatgttggccctcccctcctccatgatctgcgcgagaccatggcaagtgtcccgccaccaacgaggacctcaccatggatgatatcgtgccgggcaagaccaacaccatctggaagcccagaccttatgcccgctgcaagcattcaaggaatacttagtatttttagcaacaacaggaatgttatcctgcttacgactgttactttggagtggacgcttccctctcccggaccagaacttgcgagtgcactctaccatgatgacgctgcctgcagggttatacccggaatacccaagaaagcatatgacgctgcagcacttttggatctggctgagacactgattcctgctacagttgcaggagctacacctgcagctgttgtctccagaggagaaagagccattgacgatgagattggtcctgaagggaacaatatctgacgtgatatcaaccctgg

SEQ ID NO: 42235 - protein, 170 aa, Zea mays
  misc_feature: Ceres CLONE 1439758-F
  misc_feature (67)..(133): Pfam Name: Prp19 Pfam Description: Prp19/Pso4-like
MPPASGKEITAGEGARGAILSPVPDVGPPLLHDLRETMASVPPPTRTSPWMISCRARPTPSGSPDLMPAASIQGILSIFSNNRNVILLTTVTLEWTLPSPGPELASALYHDDAACRVIPGIPKKAYDAAALLDLAETLIPATVAGATPAAVVSRGERAIDDEIGPEGNNI

SEQ ID NO: 42236 - DNA, 848 bp, Zea mays
  misc_feature: Ceres CLONE 1439758-R
  misc_feature (808)..(808): n is a, c, t, g, unknown, or other
ccgattgggtacggggccccccctcgaggtcgacggtatcgataagcttttttttttttttttttcgtttgaaaccactggaatctgcgcaaagaactttagctgtttagcatcgtactcaacaaaacaaattgtatcctcttcaaaaaaattagtagggcctacagtacaacaatatcacagtttgttttacaccgaccgaagctcaaaccagtaatccccgccgggacccttccctctggggacggggatgtatccatgtgcaatcagtctatccttccccccagtataaggaggatgatggcaaaaaaaacaaattaggcaccatgaattcccatcactcggccgctgggtttgatccccccattggaccatccccggggaaaccaaatatccgtaaatggcggcccataaaacctatggctatgtatttcgcgtctcctccaaattttacggaagttactttccctgttcctgaaaaatcgggaaaggtcttgaaaagattccattcggccttaacattacctacttggaaaacccttatatctaaaccaccaagggcaagatagtttcccctaaaatcaaattccacaatatgtggttggcgtgtccaaatcaaagggagagaaagtcctaaaatttcttaatttacaaagatcccaaagcttaacaccttcatgagcggcagtcgttaggaagtaacctttttcagaaaaagacatagcagtgactggcccaacatgaccctcaaattttgcgacatttaactgacccttcacgccccaaattttaccaacagcatcagtangttcctggtcctaaggataaaaccatcttggatggaaaaa

SEQ ID NO: 42237 - DNA, 698 bp, Zea mays
  misc_feature: Ceres CLONE 1439764-F
tccccgcggtggcggccgctctagaactagtggatcccccgggctgcaggaattcgcacgagaccattacctagaacatcctaatcgaaaagtcgctcccatgcctcagcagtgacgggcatggccaaaacagcgtcgcgcactgtgtaggataacattgtctgggtgcttcctgcctaggtgacttttgtcgcaacttggaggagaccactcaccagtttgcctttccgattggaatttcctgtccttgtccatgttctcgcagaggagatgggctggtttatgagaacatttgaggatgggaacacagctagcagcataggatccatgacataacagccctgttaattattgtgcagcagcggagaagatcgagaagactgtcgcacgcgtttgctatagggagtagactgtcgagaagactgtcgcacgcgttttcgaataacccttagagtgttgatcaagccgacggtctccatagaagcaacctgcaaggttgtcagcattgcaaccactgctcaggagaagatgaagctgtggaaggagacttccaggagttccaagactacgacgagttctaggtgtgggttagcggcaacccccagtcggctgcctgtgagggctgcgtttatctacgtttcgtgttcgcacttgatttattgtaggactatatggacgtctcagacgtatgatgtaat

SEQ ID NO: 42238 - DNA, 678 bp, Zea mays
  misc_feature: Ceres CLONE 1439765-F
  misc_feature: Encodes the peptide sequence at SEQ ID NO. 42239
  misc_feature (309)..(309): n is a, c, t, g, unknown, or other
  misc_feature (594)..(594): n is a, c, t, g, unknown, or other
  misc_feature (643)..(643): n is a, c, t, g, unknown, or other
ggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccnagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaatggaaaggagctgtncagaaagcggaagagatacaagcaaagacacccaactcttacatccttncacaatttgaaaatccagctaaccccaagattcat

SEQ ID NO: 42239 - protein, 151 aa, Zea mays
  misc_feature: Ceres CLONE 1439765-F
  misc_feature (12)..(152): Pfam Name: PALP Pfam Description: Pyridoxal-phosphate dependent enzyme
  misc_feature: SWISSPROT Homolog: EC 2.5.1.47 Cysteine synthase
  misc_feature (38)..(38): Xaa is any aa, unknown, or other
  misc_feature (133)..(133): Xaa is any aa, unknown, or other
  misc_feature (149)..(149): Xaa is any aa, unknown, or other
MGEASPSIAKDVTELIGNTPLVYLNKVTEGCVGRVAAXLESMEPCSSVKDRIGYSMITDAEEKGLITPGVSVLIEPTSGNTGIGLAFMAAAKGYKLTLTMPASMSMERRIILKAFGAELVLTDPLLGMERSCXESGRDTSKDTQLLHPXTI

SEQ ID NO: 42240 - DNA, 534 bp, Zea mays
  misc_feature: Ceres CLONE 1439767-F
tctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgcttggtgtgccaaatggggggcctgcccccccctttggaattttccggccccccccccccgccgaaaatttttttttccccccgcgggggggaggtttttttgggggaggggtgggtggggaaaaaacggggttttttccccaaaaaaagtcttctccggcccacaaaggaaaacccacaggtttgtttttgcaagaaaaatatctcaaaaaaaggggggcgcccccgggttttttcccccccctctcctccaaaaaaaaaaaaggcgcccttttttggggggggggggggtcgagaagaaaaaaatgtgcgtctttggggggggggccccccccccccacgagaggacccccc

SEQ ID NO: 42241 - DNA, 876 bp, Zea mays
  misc_feature: Ceres CLONE 1439769-F
  misc_feature: Encodes the peptide sequence at SEQ ID NO. 42242
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (876)..(876): n is a, c, t, g, unknown, or other
tttcttcttgtcnnnnggtntctcttccgggcnnnnnnnnnnnncaaactggaactccccgcggtggcggccgctctagtttagtggatcccccgggctgcaggaattgttacgagaccattacctagaacatcctaatcgaaaaacacaacccaaagcagccacagcagcctccttcctcctctcactctcgctcgtgctgcgctcgctacctcgcttcgcattctattctaggagagcggtgagaggggaggaaaggcaagatgttcatcgagagcttccgcgtcgagagcccccacgtgcggtacggctcgacggagatcgagtcggagtaccggtacaacaccacggagctggtacacgaggggaaggactgcgcctcacgctggggccatccgccccatagctctggtggttatatttttaggaataggaagcggcggtggcccaaacctcgggggtggagggtagaccccacatccgtggacaacatcggtggtcgacccctgactcgctcggtgtcacttgccccacccagggagaggaaaaccccacgtcgtcgcaccaatgcgcgtagcagagcaccacaggacgaagttaactgagcggtctcccccccccccagaataggctggcgccgcaggcacaaaccgcgggaccgcttacgatgggcgggaagatcatatactcttgcgctccttggagagagacacctggacgggccctgtgcgagcatacctcgagagcgactatgcgcggttacgccattgcgtggggagagagccgggcccgccttgtgaagccggttttctcattgtctatatgtaagttgtgtccacggcgcgcaggggacgtgcagacctgtcgggccagacn

SEQ ID NO: 42242 - protein, 113 aa, Zea mays
  misc_feature: Ceres CLONE 1439769-F
  misc_feature: SWISSPROT Homolog: EC 5.5.1.4 Inositol-3-phosphate synthase
MFIESFRVESPHVRYGSTEIESEYRYNTTELVHEGKDCASRWGHPPHSSGGYIFRNRKRRWPKPRGWRVDPTSVDNIGGRPLTRSVSLAPPRERKTPRRRTNARSRAPQDEVN

SEQ ID NO: 42243 - DNA, 658 bp, Zea mays
  misc_feature: Ceres CLONE 1439771-F
  misc_feature: Encodes the peptide sequence at SEQ ID NO. 42244
gaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccggacagccaaccacggtagcgtccaaggtgctggacatgggcgcggcggcgatgcattcgttgcgccccgtgaagcaggcgaagcagcacatgtgcacgttcgcgctgtacgcgcacgacccgaagcggcaggtggagacgcaccactacatctcccgcctcaaccaggacttcctccagtgcgccgtctatgactccgacaaagtcgacgcgcgtctcatccgcgtggagtacatcgtgtccaggaagatcttctactctctgccggcggaagatcagcggcttgtgtcctcgcacccccacgagatcaagtcaggcttgtgaacaagcccccacttggcggggcctgctgaaaaaggcggaactggaccatatggcccccacgttcgccaagtttctggtggccctggcagggggaccccgggaaccgcctggcgctgggctcccccgtgtcttatggggtcccccgaaggccaaccccgctggaaccgtgcccc

SEQ ID NO: 42244 - protein, 133 aa, Zea mays
  misc_feature: Ceres CLONE 1439771-F
  misc_feature (26)..(133): Pfam Name: DUF1264 Pfam Description: Protein of unknown function (DUF1264)
MASSDGKPLPTPASVGGGGGSSTAPPGQPTTVASKVLDMGAAAMHSLRPVKQAKQHMCTFALYAHDPKRQVETHHYISRLNQDFLQCAVYDSDKVDARLIRVEYIVSRKIFYSLPAEDQRLVSSHPHEIKSGL

SEQ ID NO: 42245 - DNA, 822 bp, Zea mays
  misc_feature: Ceres CLONE 1439775-F
  misc_feature: Encodes the peptide sequence at SEQ ID NO. 42246
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnnnnnnnnnnnnnnnggggnaagannaccccccccnnnnnnnaaagctggagctccccgcggtggcggccgctctagaatagtggatcccccgggctgcaggaattcgcacgagaccattacctagaacatcctaatcgaaaaaaaaatatccgcgcgaccccgacctcccccctcccactccgggcagcagccagcagccagcaggcatggggatacccgtggtggttcccgtcgcggcggcctactcgtgctcctcctccctcgccgcgccaccgagggccgccgccgccgcggcgagggcgccgagccgcgcgcacgtcgcggcggccgggatgtcctccagggcgtcctccttcgtcgggggcagcggaggcgacctcgcggcggtggccgcgtcggtagccgcgcggcccaggagggcgggctccgggggaggggggcgcgctcgggtgcaagtgcctctttccccctccggcgggcgggagttcgccgtaaccgccgggggcccccccccttcgtgttccgggcccaagcacctcccccaaaatcggcccgcagcattcggcaagacccgtcaaggagcttcccagcgggcgggctaaggggtttggaacatggacttgaaaaaaagaaccctgggggaaaggggggtaatcagcccccccccctgccacctcccaccaaccttttaaattgcgcctgaaaggaaaaaggggtttggagggtttttattagccaagggaaaaccccgtgaagaattagggaaccaacccaaggggggggtgcacaaaaattggttttgccgtggctct

SEQ ID NO: 42246 - protein, 131 aa, Zea mays
  misc_feature: Ceres CLONE 1439775-F
MGIPVVVPVAAAYSCSSSLAAPPRAAAAAARAPSRAHVAAAGMSSRASSFVGGSGGDLAAVAASVAARPRRAGSGGGGRARVQVPLSPSGGREFAVTAGGPPPSCSGPKHLPQNRPAAFGKTRQGASQRAG

SEQ ID NO: 42247 - DNA, 775 bp, Zea mays
  misc_feature: Ceres CLONE 1439776-F
  misc_feature: Encodes the peptide sequence at SEQ ID NO. 42248
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (31)..(31): n is a, c, t, g, unknown, or other
  misc_feature (39)..(39): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (527)..(527): n is a, c, t, g, unknown, or other
  misc_feature (775)..(775): n is a, c, t, g, unknown, or other
gggtgggcccccnnnnnnnnnnnncncccangcgaggcncctcttaannnnnnnnaaaangggaactccccgcggtggcggccgctctataactagtggatcccccgggctgcaggaattcgcacgagaccattacctagaacatcctaatcgaaaaattcacgcccccaccacgacttccgtgctcgccgccttctcggactaggggggttcggctcgagatctgatttcgggcgccggaggactacatggaggttagggagatggcgatggccgcggcggctgcggctgcggcgtccggcgggggaggcgtcaagctgccgccgcccaatcccaacctgccctacagggaggactgctggagcgacggcgagacggcagctctcgtctccgcctggggcagccgctacgtcgagctcaaccgcggtaacctgcgccagaagcagtggcaggaggtgggggacgccgtccactcccgccggggagcctccgcgcggcgccgcccgccgcgcaccgacatccagtgnaagaaccccgtcaataccctcaagaagaattaaaaggccgaagcttcgcccgcaacgcgccgtccggcctggtcctactttccccgaaactctgacgccctcgttcgggcccaaacgcttaaagggccctctcccttccagaagaaccctgtgggggtcctccgccctcccccaaattccggcttgtgccccatggcattcccaccggggcggtggcgggaaggcccccccgttcgtgcgcttacgcn

SEQ ID NO: 42248 - protein, 103 aa, Zea mays
  misc_feature: Ceres CLONE 1439776-F
  misc_feature (93)..(93): Xaa is any aa, unknown, or other
MEVREMAMAAAAAAAASGGGGVKLPPPNPNLPYREDCWSDGETAALVSAWGSRYVELNRGNLRQKQWQEVGDAVHSRRGASARRRPPRTDIQXKNPVNTLKKN

SEQ ID NO: 42249 - DNA, 722 bp, Zea mays
  misc_feature: Ceres CLONE 1439782-F
  misc_feature: Translation starting site: 192
ggagctccccgcggtggcggccgctctagatctagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccgggcgcctcggcgtcgctgcgctgtccgtgttctcctggatgtacaagtacctgacggggcaagcaccgcccgggcgcccaccagctggaccacgccaaggcgaggctggcgtccaaggcccgcgacatccaagatgcagcacagcaccgcatcaaccagcgcaggggtcttttgaaaaaaaaaccaccctccagccggaccggcgcgcgccaacctccttaaaccactggccg

SEQ ID NO: 42250 - DNA, 795 bp, Zea mays
  misc_feature: Ceres CLONE 1439787-F
  misc_feature: Encodes the peptide sequence at SEQ ID NO. 42251
ggagctcaccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcaacgacctcaccggcacgaccgcggcttgcaacaacatgatggacataccctccctcatcatgccttttgaacttcccccaattgaaaataaaaacgcccaatttttggaaccctgggggcgaggggggcccccccaagggccccttggtttatggaaaacaaggaataacccccccaaaagaaattttcccaattttctttcctgcccccaaaaaaaaaggatttttttcccccaaaaaatttttttcttttttaaaacaaaaaaatttaccccccccccccgtttgttccaaaaaaaaaaaaaaaataattttgccccccccagatttttttaaaaccccccccctaacaattttccccaagaagaaaaccccccccaaaaaccccccctgaaatagtaaggggggggaaaaaatattatttttttttttgctcacccaccaccaaaaatttttgtctcccaacactcgcgggagaaaaaaccctccttcttatataaaaaaaatt

SEQ ID NO: 42251 - protein, 153 aa, Zea mays
  misc_feature: Ceres CLONE 1439787-F
MASAAAATQVGTYFLRNYYNLLQQTPDVVHQFYSEASTMVRVNDLTGTTAACNNMMDIPSLIMPFELPPIENKNAQFLEPWGRGGPPQGPLGLWKTRNNPPKRNFPNFLSCPQKKRIFFPQKIFFFFKTKKFTPPPRLFQKKKKNNFAPPRFF

SEQ ID NO: 42252 - DNA, 718 bp, Zea mays
  misc_feature: Ceres CLONE 1439792-F
  misc_feature (651)..(651): n is a, c, t, g, unknown, or other
acccgcggtggcggccgctctagaactagtggatcccccgggctgcaggaattcgcacgagaccattacctagaacatcctaatcgaaaaatcatgcttaatctctctccagtttcccccagttcccgtttccatctccatcctcccccccgggagcaggagctgcagccaggagtcgagtcggcgtcgtcacgggagatatcagcttcgctatcaccggatccccctctgctccctccgcacctcccatctgcgctctctgttttcttccgcgcaccccggctgttggtgtcccgtccggcagcgttgctggtggctgaatccgagcctttgaggggtctgctgccgccgccgccgccgctgtcaccgctcttgagatctctttattgatctggagagattaaagagggattcttgccttcctactggagcaagagaaaggggagaacgtgtttcttcaggcgtggttgaacagtgaggaccggagaacaatgcgaggttcgggattaaagatgtttctggcttaggggcccgtcttctgaagcaggggacgggcgattcgaccaccgagctcagatctgattacaaaacgttcagaaaacacaaggcgttctcacaccgccctttcacttcttgcttactttggcaccnactccactgcgactgggtctccacctcccgcctacaccaaagaacacatgcccaagccgatctagcg

SEQ ID NO: 42253 - DNA, 699 bp, Zea mays
  misc_feature: Ceres CLONE 1439799-F
acccgcggtggcggccgctctagaactagtggatcccccgggctgcaggaattcgcacgagaccattacctagaacatcctaatcgaaaaacctttccatcctatcattcatcctactcgctccctctccaactcgaccgccccgccgccggccgccggccgccatctcccgccgccgaccacccccgacccaccggccgcgcccagccccaactcgcccccgttgctgtccttgtgtcgctgtccccgcccgcgttgcgcctggattgcactcagccttggccgcaatccatccgtgctttccggcgctacccaccacacatcgagttgtttgattttcgattgattcgcccgaagagggcaggccggccgacgaggtaagggtgcggtgcgaagcgttggtcagatgccccagtaccttgcggtcggcgtgctacacggagtgtgtgaactgtgaagccgccggcgcagctagctttggcatgagcacaaccgcacgaggcaagctcaggtaatcagctatccatgttgttacgtctgcccgtaggtttcgataggccagcagctactgctccccactcagaatgtgcgagggacatgccaaattggactgggttttccaacccctgaaaaaacctaaccattctcctggggctttatgaaaaaccgagaaaaaaaatggtgttttaaaaaattttt

SEQ ID NO: 42254 - DNA, 918 bp, Zea mays
  misc_feature: Ceres CLONE 1439800-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (498)..(498): n is a, c, t, g, unknown, or other
  misc_feature (656)..(656): n is a, c, t, g, unknown, or other
  misc_feature (745)..(745): n is a, c, t, g, unknown, or other
nnnnnnnnggggggggggggggactatgnnnngtctcnnnnntaaactggagctcaccgcggtggcggccgctctatattagtggatcccccgggctgcaggaattcttacgagaccattacctagaacatcctaatcgaaaactcgctagtcgctactcactgtaccgcaccgccgccgccgtctcgcacacggggcacaggacgcgcgcgatcccctcgagtctggattgccatgggccacgagggcgttcgccgccgccgggttcttcccgcccaccttgaatccctcccgacactttgggccccgacggcgtcggggcccccggcgaatcctaaccttttatacggttttttctccagacctgcgacgcctggatccccgacgcatttccccctggcccctccggacccccggggggggggggtgggtggggggccccccaagggcgggggggggatggtgggtgggtggggtggggggtcgccccccccaccntgtggggcggcccaaggtcccccccgcgaggggtgatcctgtcccccccctcactagcgcgacccgcgggggcggggggcggcgggcgccccaccccggtggggcacatgaggcggcgctgcgcgaggaggtggtatgtgtggtgtgatcaccccaanccgccccctccgcggggaggtggtgcgtgcatacgagcggtgccatcagaacactagaggatgtttgttttcagcggcggcggggtgcncggtaacgaggggacgctcgccccacagcgcggagcgtgagcctagtgtattacattgagcgggggagcggccggaacgcgagcagaaaactactggacgcggggacgacgccgcggcgagggcggacgggaacaatacgtcattgacggcggacgaaggcggcgccccccgg

SEQ ID NO: 42255 - DNA, 731 bp, Zea mays
  misc_feature: Ceres CLONE 1439804-F
ctccccgcggtggcggccgctctagaactagtggatcccccgggctgcaggaattcgcacgagaccattacctagaacatcctaatcgaaaaaccccgccgccgaagccaccgtgccgctagccttccccgccgccgcagaatgggcgcctccgcgcgacccctggttaccgcgacggctccttacggctacttgtcctcgtactgctcgccggttccgctgacgtaccgcctcctgccaccaatgcggccagagatactgttgccactaacaaagctgacagcaacgcggcggcgcttctgacgatgccggcgtcggcgtccacggggcagctgaatggcatcatccagtgcctgctgggctgcttcacgcaggtgttcagctgctcgttcgggtgtatgggaaagcagggcgccgacctgccgctctgcatcatcggctgcgaccagaggagcgtcgtttgttgatccgctgcgggctcgcgccgtcgccgcccacgccctcgccaccggcgcccaagccgccgtcgcccaagccacccacgccgaaacctcccacgcccaagccgcccacgcccgcgccacccacgcccgcgcccacacctaagccgcccacacccaagcctcccacgccagcgccaccaacgcccgcaccgccgacgcccatgccaccaacgccagcgcctccagggccgccgtacactccaccgtacgccgtcaccggacgcaaga

SEQ ID NO: 42256 - DNA, 726 bp, Zea mays
  misc_feature: Ceres CLONE 1439812-F
  misc_feature: Encodes the peptide sequence at SEQ ID NO. 42257
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaaaccatgcatgtgttcaaaacggaaagtctgatctgaagccagcagacgtgaaaccgacagcacgtacgtacgtgtgagggctgagggctgctcggcggccatgggacaatggtgctttaagaaacgcgcagctctggtgattattgtggccattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacgggtcgtcacgntcgtgttcgggggaggaggcggtggtggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggaacccagcgagaccgtctccttccagtactccaactccttctcctaccagctcagtgtcgcctccgtcgcgtgccactagagatcatcgaaccaa

SEQ ID NO: 42257 - protein, 169 aa, Zea mays
  misc_feature: Ceres CLONE 1439812-F
  misc_feature: SWISSPROT Homolog: EC 2.1.1.43 Histone-lysine N-methyltransferase
MGQWCFKKRAALVIIVAISSLQLLLITAQEAGGDHEVWSSSSSPAGGRGGGAVVVPTARMGPDGSSRSCSGEEAVVVYQSSANPLPSGIPAYTVQIINVCGGGCTVYDVHVSCGDFASTELVDPAKFQRVAFDDCVVKGGAALEPSETVSFQYSNSFSYQLSVASVACH

SEQ ID NO: 42258 - DNA, 890 bp, Zea mays
  misc_feature: Ceres CLONE 1439813-F
  misc_feature: Encodes the peptide sequence at SEQ ID NO. 42259
  misc_feature (22)..(22): n is a, c, t, g, unknown, or other
  misc_feature (23)..(23): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (890)..(890): n is a, c, t, g, unknown, or other
gcccccccccccggggggggcnnccgctcccccnnnnnttannnnnnaaagctgggactcaccgcggtggcggccgctctagattagtggatcccccgggctgcaggaattcttacgagaccattacctagaacatcctaatcgaaaaacaggctcatctcgctttggatcgattggtttcgtaactggcgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaagtgcccctcaagatcttcttcacctcggtctgccacaccaacgtctacttctggggaggccaagggggaaaactccgcggggttccctcaagattttttggcccacaaaccccccccccccccccttattagactcgtctggaaaacggtggtgtccttgaccgttccaccccggggcaaaccggggtccctttccttggggtttactctcgggcggaatgttgtctatggaagccgtgctgcctccctggcgcagttctcggagtgaaaatctcactcctctgctgttcgatcttgctctcccatgattacgaacctgcccgcaccgcgcgttgatgtatatttagtataggctttaacgtggcaaactctcttctctattctttctaattccttgtcggtgaatggaagaattcgcagacctcccgtacgtcgcgggcagaactatcagagcacttatacgagagagtaacgaccccgccatgaccgcgcgaccgacgggaagctgagatcgtccaaccccgacn

SEQ ID NO: 42259 - protein, 79 aa, Zea mays
  misc_feature: Ceres CLONE 1439813-F
  misc_feature: SWISSPROT Homolog: EC 1.1.1.1 Alcohol dehydrogenase
MATAGKVIKCKAAVAWEAGKPLSIEEVEVAPPQAMEVPLKIFFTSVCHTNVYFWGGQGGKLRGVPSRFFGPQTPPPPPY

SEQ ID NO: 42260 - DNA, 723 bp, Zea mays
  misc_feature: Ceres CLONE 1439816-F
  misc_feature: Encodes the peptide sequence at SEQ ID NO. 42261
  misc_feature (602)..(602): n is a, c, t, g, unknown, or other
  misc_feature (622)..(622): n is a, c, t, g, unknown, or other
  misc_feature (638)..(638): n is a, c, t, g, unknown, or other
aagctggagctccccgcggtggcggccgctctagaactagtggatcccccgggctgcaggaattcgcacgagaccattacctagaacatcctaatcgaaaaaagcgcactgctggactccaactcgactgctctgcgtagcggagtaggctgatcagaggcgagatatgaggagcggccggcggatggcggcagctctggtggcgctggcgtgggcgctcgcggctgtggctgtggcggcggcgcaaaagtacaatgccatcttcaacttcggcgactccatcaccgacacggggaacctctgcaccagcgggaggccgtcgcagatcaccttcacgcagccgccctacggcgagacctacttcggcacgccgacgtgccgctgctgcgacggccgcgtgatcccggacttcctctgctccaagttcgggctgccgttcctgccgccgtccaagtcgacgacggccgacttcaaggagggcgccaacatggccatcaccggcgcgactgccatggacgcgcccttcttccgctcgctggggctctccgacaagatctggaacaacgggcccatcagctcccaagctggagtggttccagcangtcgcgtccgccgtgtgcgncggggggcaggcgcancaggccgactgcaagagctacctggccactcccctgggtcgtgtttcgcgagttcggcggcaacgactacaacgccatgctggtc

SEQ ID NO: 42261 - protein, 185 aa, Zea mays
  misc_feature: Ceres CLONE 1439816-F
  misc_feature: SWISSPROT Homolog: EC 3.2.1.51 Alpha-L-fucosidase
  misc_feature (146)..(146): Xaa is any aa, unknown, or other
  misc_feature (158)..(158): Xaa is any aa, unknown, or other
MRSGRRMAAALVALAWALAAVAVAAAQKYNAIFNFGDSITDTGNLCTSGRPSQITFTQPPYGETYFGTPTCRCCDGRVIPDFLCSKFGLPFLPPSKSTTADFKEGANMAITGATAMDAPFFRSLGLSDKIWNNGPISSQAGVVPAXRVRRVRRGAGAXGRLQELPGHSPGSCFASSAATTTTPCW

SEQ ID NO: 42262 - DNA, 711 bp, Zea mays
  misc_feature: Ceres CLONE 1439823-F
  misc_feature: Encodes the peptide sequence at SEQ ID NO. 42263
  misc_feature (402)..(402): n is a, c, t, g, unknown, or other
aaagctggagctccccgcggtggcggccgctctagaactagtggatcccccgggctgcaggaattcgcacgagaccattacctagaacatcctaatcgaaaaaccatgcatgtgttcaaaacggaaagtctgatctgaagccagcagacgtgaaaccgacagcacgtacgtacgtgtgagggctgagggctgctcggcggccatgggacaatggtgctttaagaaacgcgcagctctggtgattattgtggccattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacggtcgtcacantctccttgttccgggggaggaggcggtggtggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggaaccagcgagaccgtctcctttcagtactacaactccttctcctacagctcagtgtcgcctccgtcgcgtgccact

SEQ ID NO: 42263 - protein, 169 aa, Zea mays
  misc_feature: Ceres CLONE 1439823-F
  misc_feature (67)..(67): Xaa is any aa, unknown, or other
MGQWCFKKRAALVIIVAISSLQLLLITAQEAGGDHEVWSSSSSPAGGRGGGAVVVPTARMGPDGRHXLLVPGEEAVVVYQSSANPLPSGIPAYTVQIINVCGGGCTVYDVHVSCGDFASTELVDPAKFQRVAFDDCVVKGGAALEPARPSPFSTTTPSPTAQCRLRRVP

SEQ ID NO: 42264 - DNA, 777 bp, Zea mays
  misc_feature: Ceres CLONE 1439827-F
  misc_feature: Encodes the peptide sequence at SEQ ID NO. 42265
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
tttcttttttnncnncanaaagttccccccccccccnnnnnnaaaaactggaactccccgcggtggcggccgctctagattagtggatcccccgggctgcaggaattcttaccagaccattacctagaacatcctaatcgaaaaaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggttcgagaaggaggctgctgaaatgaacaagcggtccttcaagtacgcgtgggtgctcgacaagctcaaggctgagcgtgagagaggtatcaccattgatatcgctctgtggaagtttgagaccaccaaccactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaaaatgctcctccttgccttcccccttgaagtgaaacaaaataatttgctggctgcaacaaaaatggaatgcaaccacctccccaaatactcccagggccacgttaatgaaaaaaaattggtgaaaggaaaattctccatccctacctccaagaaaagtt

SEQ ID NO: 42265 - protein, 143 aa, Zea mays
  misc_feature: Ceres CLONE 1439827-F
  misc_feature (5)..(143): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTNHYCTVIDAPGHRDFIKNMITGTSQADCAVLIIDSTTGGFEAGISKDGQTRENAPPCLPP

SEQ ID NO: 42266 - DNA, 729 bp, Zea mays
  misc_feature: Ceres CLONE 1439828-F
  misc_feature: Translation starting site: 197
  misc_feature: SWISSPROT Homolog: EC 5.3.1.1 Triose-phosphate isomerase
  misc_feature (682)..(682): n is a, c, t, g, unknown, or other
ggagctccccgcggtggcggccgctctagaactagtggatcccccgggctgcaggaattcgcacgagaccattacctagaacatcctaatcgaaaaacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgtttgtggaggtcgttgtcagccctccttatgtcttccttcctgtggtcaagagccagctgcgccaagagttccatgttgcggctcaaaactgctggggttagaaagggaagtgcttttcaccggtgaagtcagtgctgaaatgcccgtcaacctgggtgtccctgggtcattcttgggaacctctaaaaggaaacctcgctggggaaaatcaaataaatttttgggaaaaaaggtggcctatcccctgttccccgggaaaaaaagggcattgcttgtgttgggagaaacctttaaaacaaggggaggtgggctctcaccggggggtggtttgcccccaaacaaaaaacatttttgaaaaaaaacatgggggggggcnacccttttttttctccccaaacccctttggggtttttgaaaaaagaa

SEQ ID NO: 42267 - DNA, 714 bp, Zea mays
  misc_feature: Ceres CLONE 1439830-F
  misc_feature: Encodes the peptide sequence at SEQ ID NO. 42268
  misc_feature (657)..(657): n is a, c, t, g, unknown, or other
  misc_feature (672)..(672): n is a, c, t, g, unknown, or other
  misc_feature (677)..(677): n is a, c, t, g, unknown, or other
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggtgggtagtagtcaatacctgcttagcaatgggaccgccctagtgctcttcctctccccggtgcctacgttcatccgcatctggaagaaggggtcggtggagcagtactcgccgatcccgtacgtggcgacgctgctgaactgcatgatgtgggtgttgtacgggctgccgctggtgcacccgcacagcatgctggtgatcaccatcaacggcaccggcatgctcatccagctgacctacgtggcgctcttcctcgtctactccgcgggggcggcgcgccgcaaggtgtccctcctgctggnccgcgaggtcgcttncgtcngcgccgtcnccgcgctggtgctcgccctggcgcacac

SEQ ID NO: 42268 - protein, 71 aa, Zea mays
  misc_feature: Ceres CLONE 1439830-F
  misc_feature (53)..(53): Xaa is any aa, unknown, or other
  misc_feature (58)..(58): Xaa is any aa, unknown, or other
  misc_feature (60)..(60): Xaa is any aa, unknown, or other
  misc_feature (63)..(63): Xaa is any aa, unknown, or other
MMWVLYGLPLVHPHSMLVITINGTGMLIQLTYVALFLVYSAGAARRKVSLLLXREVAXVXAVXALVLALAH

SEQ ID NO: 42269 - DNA, 728 bp, Zea mays
  misc_feature: Ceres CLONE 1439831-F
  misc_feature: Encodes the peptide sequence at SEQ ID NO. 42270
  misc_feature (354)..(354): n is a, c, t, g, unknown, or other
  misc_feature (398)..(398): n is a, c, t, g, unknown, or other
  misc_feature (440)..(440): n is a, c, t, g, unknown, or other
  misc_feature (442)..(442): n is a, c, t, g, unknown, or other
aaagctggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctgnctcccccaccacccggggcgcgacctcccgcttctcaccctggncgggcaggaccgcaccgacgccttcgcccgcctacacccccntnggggggcccgttcctcggccgtttcttcggtgggcggcctctcgactacgccgtctcccccgggtccgccgaataccgccgcctccttggggcagttttcctccgggggccttcttaaaaccggtcgcgcccacccccagggtccatttcgtcctgagggggcttcctttttttaagcccgggtttaaactttttcctccccttggcccaggcctggggggcaccctcccccggggggggcccccacggttttccctgggaacccacccccgggggagggggcccc

SEQ ID NO: 42270 - protein, 138 aa, Zea mays
  misc_feature: Ceres CLONE 1439831-F
  misc_feature (22)..(125): Pfam Name: Cyt-b5 Pfam Description: Cytochrome b5-like Heme/Steroid binding domain
  misc_feature: SWISSPROT Homolog: EC 1.6.2.2 Cytochrome-b5 reductase
  misc_feature (51)..(51): Xaa is any aa, unknown, or other
  misc_feature (66)..(66): Xaa is any aa, unknown, or other
  misc_feature (80)..(80): Xaa is any aa, unknown, or other
  misc_feature (81)..(81): Xaa is any aa, unknown, or other
MPPSVDAMPAPGDAAGGGDVRMISSKELRSHASADDLWISISGDVYDVTPXLPHHPGRDLPLLTLXGQDRTDAFARLHPXXGARSSAVSSVGGLSTTPSPPGPPNTAASLGQFSSGGLLKTGRAHPQGPFRPEGASFF

SEQ ID NO: 42271 - DNA, 733 bp, Zea mays
  misc_feature: Ceres CLONE 1439839-F
  misc_feature (288)..(288): n is a, c, t, g, unknown, or other
  misc_feature (463)..(463): n is a, c, t, g, unknown, or other
  misc_feature (472)..(472): n is a, c, t, g, unknown, or other
ctccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcangagagagatagcaggggggctagctagctgagctcgtgcgacgaagaatggccggaattggcaggaacatggtggcgccgctcctggtgctcaacctcatcatgtacatcatcgtcatcggctttcgcgagctggaacctgaaccacttcatcaacgggcagaccaactaccccnggctggccngcaacggcccgacgttctactttcctggtgtcccccatcctggcgggcgtgggtgggcgcgggcttccaaacttggcgggggttgccccaagtggcgcgccttgggcccaaaaaaagcttggcccaccaaagccgggttgtattttaattggccgggggcaatcacggggcctccccctttgggggggccctgaaaggaaatcaccatttgggggaaaacccccggttggggccctccgccctgtgggggagccctctccc

SEQ ID NO: 42272 - DNA, 689 bp, Zea mays
  misc_feature: Ceres CLONE 1439840-F
  misc_feature: Encodes the peptide sequence at SEQ ID NO. 42273
  misc_feature (689)..(689): n is a, c, t, g, unknown, or other
tctgaactagtggatcccccgggctgcaggaattcgcacgagaccattacctagaacatcctaatcgaaaagttttccaacacagcgaggcccacgttgtagggttttttgcttgcttcgcccggcggtaaagctgagcgcggcgagagccggagaccgaagaagcgccgcccgccgcgcgcccggtcatggagatcggacagtaccccgcgagcggctgctccaaggagcaccagaagatctaccaggagtggttcgcgctcgcggacgcagatggggatggccgcatcacgggccccgatgcgatcaagttttttggcatgtccaagctctcccgccctgacctcaagcaggtctgggctatcgcggacaccagaaggcaggggtatctgggtttctctgagttcgtcacggcgatgcagctagtctctctggcacaggcaggcggcgagattactcaagatagccttaagcgagatgatttgagcagtttgaatccccctgtgatggaaggtttggatggcctactggcgaaatctaagcatttggtgaaccgtgttgatccaaaaatggatggatatcctcgggaacaatcgccctttaagaaacggatgggtttggctcaaagctcttaaaaaaaattccttctgacagcccgtactttcgtgtattcggagggtttgaaaaan

SEQ ID NO: 42273 - protein, 148 aa, Zea mays
  misc_feature: Ceres CLONE 1439840-F
  misc_feature: SWISSPROT Homolog: EC 2.7.11.1 Non-specific serine/threonine protein kinase
MEIGQYPASGCSKEHQKIYQEWFALADADGDGRITGPDAIKFFGMSKLSRPDLKQVWAIADTRRQGYLGFSEFVTAMQLVSLAQAGGEITQDSLKRDDLSSLNPPVMEGLDGLLAKSKHLVNRVDPKMDGYPREQSPFKKRMGLAQSS

SEQ ID NO: 42274 - DNA, 688 bp, Zea mays
  misc_feature: Ceres CLONE 1439845-F
  misc_feature: Encodes the peptide sequence at SEQ ID NO. 42275
tccccgcggtggcggccgctctagaactagtggatcccccgggctgcaggaattcgcacgagaccattacctagaacatcctaatcgaaaaaccggtccaccgcgcatcgaacccccacttgtgccgattctgctgatccctcgccgacaacggccggcgaatcgacaccatggccgctgcgcgccggggccgtggcgacggcgccaacggcgtcgtccgtccccgcccccgcgaccgcggcgggagcatggcggggcgcgtggccgtcctcgccttctgtgtcgcagggatctggtccgcctacatctaccagggcgtcctccaggagactctatcgacgaagcggttcgggccggatgcgcggcggttcgagcacctcgcgttcctcaacttcgcgcagaacgtcatctgcttcgcctggtcccttcataatgattaagctgtggtcgggccggaatagctccaatggccagcccaccaatttggaagtactgggggggtcagcgtccccaaatcccttcgggcccaccagggggaaacagggctcccaaaaaaatcaactaccccgggttagggggttaaccgaaaccttcaaaaaaaatcccgggaagggtgaggggaaacccttccccttggggggagaaacccccccctcccaaaaaatatttgccccccctttttgtgtgc

SEQ ID NO: 42275 - protein, 89 aa, Zea mays
  misc_feature: Ceres CLONE 1439845-F
MAAARRGRGDGANGVVRPRPRDRGGSMAGRVAVLAFCVAGIWSAYIYQGVLQETLSTKRFGPDARRFEHLAFLNFAQNVICFAWSLHND

SEQ ID NO: 42276 - DNA, 709 bp, Zea mays
  misc_feature: Ceres CLONE 1439847-F
  misc_feature: Encodes the peptide sequence at SEQ ID NO. 42277
tggcggccgctctagaactagtggatcccccgggctgcaggaattcgcacgagaccattacctagaacatcctaatcgaaaaaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggccggcaggctcaagggctccacgctccttaccgaaggagtggtgacggatggatcaaatgaatgggcaatctacgggcgggaccggagagtttgctatggcgagaggtgtcgtcaaaagaaagtaccttgcccatagggatgggcgcgggaaacctgacgagctccgcatggcaggtttctgcccggtgtttggctcctcccgccaaccaaaacaggccgcatctctgtccccaaaattgggtttagggggtgggcaaaggaaggttcggccccaggacctccccaac

SEQ ID NO: 42277 - protein, 143 aa, Zea mays
  misc_feature: Ceres CLONE 1439847-F
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSNEWAIYGRDRRVCYGERCRQKKVPCP

SEQ ID NO: 42278 - DNA, 729 bp, Zea mays
  misc_feature: Ceres CLONE 1439858-F
  misc_feature: Encodes the peptide sequence at SEQ ID NO. 42279
  misc_feature (453)..(453): n is a, c, t, g, unknown, or other
gcggtggcggccgctctagaactagtggatcccccgggctgcaggaattcgcacgagaccattacctagaacatcctaatcgaaaagtcctccgcgctccgtgcctgccagcctgccactgctcggttctagaatccactccctgacctgtgcggcgctccgtgcctggctgccagcctgccactgctcggttctagaatccactccctgacctgtgcggcgttcccgtgcccggccggagtatcgatcgcatggcctgcgccggcgccgcgcagaaggtctcagcggtgctctaccactacccgtgcccggacggcgcgttcgcagcgctcgccgctcacctctatttttccggcgccgcccacccggtccgattcttccccaataccgtctacgaccccatcaagagtgattcacttccactgggaagaaaataaaatgtttacctccctngaacttgactggaccccctgtttttggttgagaatatagccccctaaagtcaaaaagaaatacaaccctggaccactcataaaaccgctttttgaaagtttggtgtgtgaatgcccccattgggccaaaatgtggacccaggggagaaaaaatgccacggtaaaggggggcgaacaattgccttttgaattccttttaaaaaaaagcctcctctaaaaaaatttaagcccccccccggggtaaataaaaagggggaacaaatgtgccctcagcggt

SEQ ID NO: 42279 - protein, 61 aa, Zea mays
  misc_feature: Ceres CLONE 1439858-F
MACAGAAQKVSAVLYHYPCPDGAFAALAAHLYFSGAAHPVRFFPNTVYDPIKSDSLPLGRK

SEQ ID NO: 42280 - DNA, 732 bp, Zea mays
  misc_feature: Ceres CLONE 1439865-F
  misc_feature: Encodes the peptide sequence at SEQ ID NO. 42281
aaaactggagctcaccgcggtggcggccgctctagaactagtggatcccccgggctgcaggaattcgcaccagaccattacctagaacatcctaatcgaaaagtctttgggtgagcacaccgcgcagcaacgagaggggcaaacaagcttgctactgtgatttctcgtccgaacagcggcggaagaaaaaaaaagaacatggccgaccacaaggaggagcctgtgccggaatctgtgatggacaagatcaccgagaaattccacggcggggactcgtcgtcgtcgtcgtctgactcggacgacgagaaaaaggggtcctcgttggcgtcggcggcggaagccatgaaggccaagatctaccgccttttcggccgggagaagcccgtccactccgtcctcggcggcggcaagcctgccgatcttatcctatggaggaacaggaagatctctggcggggtacttgctggtgccacggccatctggctcctattcgaggtcatggagtaccatctcctcaccttggtgtgccactgtctcatcctctcgctggccatcctcttcctgtggtccaatgcctccactttcatcaacaagtccccaccgaacattcctgaggtcaaaatccccgaggatgtggctgttaatgttgccctgtcactgagatatgagatcaaacagggctttgctaccttaagggagattgggcatggccgtgatctgaagaaattctaa

SEQ ID NO: 42281 - protein, 177 aa, Zea mays
  misc_feature: Ceres CLONE 1439865-F
  misc_feature (72)..(177): Pfam Name: Reticulon Pfam Description: Reticulon
MADHKEEPVPESVMDKITEKFHGGDSSSSSSDSDDEKKGSSLASAAEAMKAKIYRLFGREKPVHSVLGGGKPADLILWRNRKISGGVLAGATAIWLLFEVMEYHLLTLVCHCLILSLAILFLWSNASTFINKSPPNIPEVKIPEDVAVNVALSLRYEIKQGFATLREIGHGRDLKKF

SEQ ID NO: 42282 - DNA, 711 bp, Zea mays
  misc_feature: Ceres CLONE 1439867-F
  misc_feature: Encodes the peptide sequence at SEQ ID NO. 42283
tccccgcggtggcggccgctctagaactagtggatcccccgggctgcaggaattcgcacgagaccattacctagaacatcctaatcgaaaaatcaaccatattattgagaccaacaagcaacatagaatgtggaatccaatagcaacaatagaacaacaatgacgaccaagatattttccctccttatgctccatgctctttctgcatgtgttgctaatgcgaccattttccctcaacgctcacaagctcctatagctgcccttcttcacccatacctcccatcaatgatagattcagtatgtgaaaacccagctcttcaaccctataggctccaacaagcaaatgcagcaagcaacttacctttatcaccctcgttgtttcaacaaatcgccatccctatctttggtgcagtctttggtacaaacatcggggcaacacagctgcagcaactcttgctacttgggatcaacaaatagctttggaaaacttttttccctaatttaagaaaaaaattttttttcatttaaacaaatggctaaattgaaacccttttgttattttgcaaatacaaaacttattccatttccccccgggtggtctgggctaattcaagaaaaaaaattttttttatttaaccaatttggccccccaaaaccccccgttttttttggcaaaaaaaaatcaacctcttttttccggtttggtgggaa

SEQ ID NO: 42283 - protein, 105 aa, Zea mays
  misc_feature: Ceres CLONE 1439867-F
MTTKIFSLLMLHALSACVANATIFPQRSQAPIAALLHPYLPSMIDSVCENPALQPYRLQQANAASNLPLSPSLFQQIAIPIFGAVFGTNIGATQLQQLLLLGINK

SEQ ID NO: 42284 - DNA, 690 bp, Zea mays
  misc_feature: Ceres CLONE 1439868-F
  misc_feature (259)..(259): n is a, c, t, g, unknown, or other
  misc_feature (281)..(281): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacacacatggggaagggtagtgtgggtgcatcatggtgggcgttcctcctgctncgcggcgtgctgctggtcctancaccccacgcccgggcggaggacggattggtcaaacggcccccaggaggacccgccggggtggcaacccgctttgcaattggattaccaaaggcaccccccccaaaaagaaattcaaaaaaatttcccaaccgcccccaaaattaaccgggggaaaaagggaaaacggggggggacccccctctctcctctccccgggggggggagggggggccccccttttctccccccccccaggggcgctcccgtgggagacaccacaaaattgaaggggggggggccccccccccccgggatttgttctctatataaagaaaaaaaaaaaaaaaatcttctcncccccaaaaaaacgcgcccctaattcccgcgagaagagagggggcgccccccccccccgccgcggggggggg

SEQ ID NO: 42285 - DNA, 586 bp, Zea mays
  misc_feature: Ceres CLONE 1439869-F
  misc_feature: Encodes the peptide sequence at SEQ ID NO. 42286
  misc_feature (342)..(342): n is a, c, t, g, unknown, or other
aaagctggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggttcgagaaggaggctgctgaaatgaaacagcgtcctcaagntacgcgtggtgctcgacagctcaggctgagcgtgaagagtatcaccatgaatcgctctgtgaagttgagacacagtactctgccggcatgatgccctgaaccctgacttctcaaaaatgatcctggaactccccaggggaatgggggccttaaaatgaaccccccaggggggttttaggggggggttccccaaggaggggccaaccccggaaaattctccccctgggttccccccgtgggggga

SEQ ID NO: 42286 - protein, 84 aa, Zea mays
  misc_feature: Ceres CLONE 1439869-F
  misc_feature (55)..(55): Xaa is any aa, unknown, or other
MGKEKSHINIVVIGHVDSGKSTTTGHLIYKLGGIDKRVIERFEKEAAEMKQRPQXTRGARQLRLSVKSITMNRSVKLRHSTLPA

SEQ ID NO: 42287 - DNA, 725 bp, Zea mays
  misc_feature: Ceres CLONE 1439880-F
  misc_feature: Encodes the peptide sequence at SEQ ID NO. 42288
ctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcaccgtcgcagcttccgctggcagcagctgcagctcccaaccgtgccgcggcagccagctcgcgctgccgcacaag

SEQ ID NO: 42288 - protein, 108 aa, Zea mays; identical to SEQ ID NO: 16131
  misc_feature: Ceres CLONE 1439880-F

SEQ ID NO: 42289 - DNA, 699 bp, Zea mays
  misc_feature: Ceres CLONE 1439883-F
  misc_feature: Translation starting site: 126
gaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcaccccggtgctggtgccggccgccatcgcgctggcgctcatggcgggcgggtttcgtccacctccggcggcctccgcgtccctgccctggccctgttcctcctggatgtacaagtacctgaccggccaaccacccgccgggggccccaacaggctgggaccaccccaaggggaaggttggcggcccaggggccccgaacctcctagggatgccgcccgtccccgttgtcttcgcaggcccagggggtcctgcgagaaagacccccccccctagcgggaccgcgccggcgcaacccccctttaaatcactgcccggcttccccgtgcctacgggcccttta

SEQ ID NO: 42290 - DNA, 641 bp, Zea mays
  misc_feature: Ceres CLONE 1439885-F
  misc_feature (217)..(217): n is a, c, t, g, unknown, or other
  misc_feature (218)..(218): n is a, c, t, g, unknown, or other
  misc_feature (225)..(225): n is a, c, t, g, unknown, or other
  misc_feature (228)..(228): n is a, c, t, g, unknown, or other
  misc_feature (231)..(231): n is a, c, t, g, unknown, or other
  misc_feature (235)..(235): n is a, c, t, g, unknown, or other
  misc_feature (240)..(240): n is a, c, t, g, unknown, or other
  misc_feature (242)..(242): n is a, c, t, g, unknown, or other
  misc_feature (243)..(243): n is a, c, t, g, unknown, or other
  misc_feature (245)..(245): n is a, c, t, g, unknown, or other
  misc_feature (247)..(247): n is a, c, t, g, unknown, or other
  misc_feature (250)..(250): n is a, c, t, g, unknown, or other
  misc_feature (263)..(263): n is a, c, t, g, unknown, or other
  misc_feature (264)..(264): n is a, c, t, g, unknown, or other
tggcggccgctctagaactagtggatcccccgggctgcaggaattcgcacgagaccattacctagaacatcctaatcgaaaaaataaaagtgaaattccattaccttgctgtctcggtctgtcggccatcgccggttgcgcagcgggcagcggctcacgtcgacggggaagactccggaggccacgggcgttacattctcctgccgtatttttgcgnnggattgnaanagntggnaccangnncncnagngggaattccactnntcatcccccctgggggtgggaaaaaaaattcaagggtttggtgggaattgggaatttgccttagcctaacccgaaacaaagcccccttccgccggtggcttaatttttcccgggggggaatcccttgggaaaaaccccccccctgaaactttcctgggggtttcccaaatttagaattttccaagacaaaataaaaaaaatttttttttttccttccaaccctgggatttggccccgtgttttatttccccaagaggggcccctttcacaaagccaaaaaaatttcctcaaaaaaaaagggggcgcaaaaagggcgcgccaagtggggggagaaatatttcccgtgtggtgttctcccccccaccaagaaagagaac

SEQ ID NO: 42291 - DNA, 696 bp, Zea mays
  misc_feature: Ceres CLONE 1439893-F
  misc_feature: Translation starting site: 354
  misc_feature: SWISSPROT Homolog: EC 2.7.11.1 Non-specific serine/threonine protein kinase
  misc_feature (639)..(639): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaagagcgctctaagccgtttttcctcgtcctcgatccagccccctgccgcttccagctccgatcgatgtgatccctccccaccaccacgccgatgggggaccaactcaccgacgaccagatcgccgagttcagggaggccttcagcctcttcgacaaggacggggatggttgcatcacgaccaaggagctgggaactgtcatgcgtacgctggggcaaaaccctacagaggctgagactccaggacatgatcaatgaggtcgatgccgacggcaacgagcaccatcgattttccagagtttctcaaccttatggctcgcaagatgaaggacaccgactcagacgaagagctcaaggaggcctttcgtgtgtttgacaaggaccagaacggcttcgtctcagccgccgagctccgccatgtcatgacaaatcttgcggagaagctagctgatgaggaggtagacgagatgatccgtcaggctaatgtccatcgagatggccagattaactactaggagtttgtacaggtcatgatggccnagtgagacacacaaccataagctcanggcggagcagtgcatattacatcacatgcaa

SEQ ID NO: 42292 - DNA, 637 bp, Zea mays
  misc_feature: Ceres CLONE 1439906-F
  misc_feature: Translation starting site: 166
  misc_feature (330)..(330): n is a, c, t, g, unknown, or other
  misc_feature (360)..(360): n is a, c, t, g, unknown, or other
  misc_feature (363)..(363): n is a, c, t, g, unknown, or other
  misc_feature (391)..(391): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctcccggtcacctgccaccctcggtgcatctcccnacgccggtccacctgccgcccgccgtccanccntgcacgccggtcccatgtgccgccgccnnggttcatctgccgccgccaccatgccactaccctactcaaccggccccgggcttcagccttcatcccccagcccacaccccatgccccgtggcaaaaagccccaattcaaacccccttgcccactttgcagggaacccttgcgggggttggcagccaccccaatcctggggcccaggggcgtcaaagttcctaaggcattaattgggaaccccaagggggaaacccctttatggttcccccaaag

SEQ ID NO: 42293 - DNA, 680 bp, Zea mays
  misc_feature: Ceres CLONE 1439916-F
aaagctggagctccccgcggtggcggccgctctagaactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagcttgaagagatgcgtactgctcatgttgtctcaattggctcagaatcattctgtgacttgaatcctcattacaaagcaggaagaaaaactgagtttaccttggatactcgaacaagtttggcactttttgggtctttcactgcaactgattatgtggcttctcaaagtataaggaggaggataatgcattatcacatggaagctttcaagaaggtcaatgtcatagcaactcctacaactggcattactgctccaaaaatacctccaagtgctctgaagtcaggagagtcagattatgttgtgtcaa

SEQ ID NO: 42294 - DNA, 630 bp, Zea mays
  misc_feature: Ceres CLONE 1439925-F
  misc_feature: Encodes the peptide sequence at SEQ ID NO. 42295
gctcgatcactacatgcatcccccgggctgcaggatcccccacgagaccattgcctagaacatcctaatcgaaaaccgttacgctgtcactgtccccctcaccgccgccatcctcgtcaccacacctcacccgttgctcccactccttccagaaccacctcctcgccaccgtggctgcctgtcctgcccgctataacactcttcactcccgctgcgacgcagtcctcacaagcaccataccaattaactagcttcttctaactctagctatgctcgtctgctgcaagaaggtaacagcccaggcatggaggggaaggaggaggacctccgcctgatcgccaataagttctgagagcgccagcccatagccactgcggtgcatggcacacacccccacgactacaaggagcccccgccggcgccgatcttcgatcccgggtacctcaagtactggtccttctaccgcgccggcatccacgagttcgtcgccgccttcctcttcctctacatcgccatcctcaccgtcatgggagtctccaagtccacctccaagtgcgccaccctcggcatccagggcattacagggtcctttcgggggatgatcttccttctcatctactggcaccccgg

SEQ ID NO: 42295 - protein, 34 aa, Zea mays
  misc_feature: Ceres CLONE 1439925-F
MGVSKSTSKCATLGIQGITGSFRGMIFLLIYWHP

SEQ ID NO: 42296 - DNA, 672 bp, Zea mays
  misc_feature: Ceres CLONE 1439944-F
  misc_feature: Encodes the peptide sequence at SEQ ID NO. 42297
aaagctggagctccccgcggtggcggccgctctagaactagtggatcccccgggctgcaggaattcgcacgagaccattacctagaacatcctaatcgaaaaatgtagctctttctggtcccaggagaacgagccgctcgctgatgtgggagcttgtcagcaccgtggatcgcccaaacggccagacgtgatgtctcgcccacgtgtcccttgcccctgtccacctgtcccctccggagcctgcaaagaactcccctccccgctatcatttccggcgcagaaaaggagagtaacactcaacactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgccgcatctccttcgggc

SEQ ID NO: 42297 - protein, 104 aa, Zea mays
  misc_feature: Ceres CLONE 1439944-F
MLPGRHPARRADATGTGPLLPDATRAVVAEFVATAMFVFAAEGSVYGLWKLYKDTATPGGLLAVAIAHTLALVAAVAVASNASGGHVNPAVTFGLLVGRRISFG

SEQ ID NO: 42298 - DNA, 632 bp, Zea mays
  misc_feature: Ceres CLONE 1439950-F
  misc_feature: Encodes the peptide sequence at SEQ ID NO. 42299
  misc_feature (52)..(52): n is a, c, t, g, unknown, or other
  misc_feature (478)..(478): n is a, c, t, g, unknown, or other
aaagctggagctccccgcggtggcggccgctctagaactagtggatcccccngggctgcaggaattcgcacgagaccattacctagaacatcctaatcgaaaaagtccaaacctttcgatccgtggtgtgttggatctgaacccaagctccgagtcgctttcggggtgggcattctcctcttcgtcttcggttgcaagaaagaaaaagcatcatggacggcttccccaagagcgtcggcggtgacggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtgtggaacgcatttaagcagttggcaagcatagcatctttggagncagcggagagttcagtgacttccaggagattttgcgctattttgatgaactaactctggctgatcttatgtgggatgatggaaaatcgctgggcccccaagaaaatccccgctaattgacaagaggggatgaaaacccggggcaaaaagtttga

SEQ ID NO: 42299 - protein, 78 aa, Zea mays
  misc_feature: Ceres CLONE 1439950-F
  misc_feature: SWISSPROT Homolog: EC 3.4.25.1 Proteasome endopeptidase complex
MDGFPKSVGGDGPNIPAGSHPAGGSQAAAGGGATQRTQYPYVTGNSVIALKYKDGVIMACDTGASYGSTLRYKSVERI

SEQ ID NO: 42300 - DNA, 673 bp, Zea mays
  misc_feature: Ceres CLONE 1439951-F
  misc_feature: Encodes the peptide sequence at SEQ ID NO. 42301
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaactcctctcgcgtctcgtaccaggtcaggagggagggagggagacgggagaaccagggagcggaggcgtgcgtgctgcggcctgcggcctgcacgaccagagatcggggactgagctagggtctgggactgggaggcggagatgtccacgccggcgaggaagcgcctgatgcgggacttcaagcggttgcagcaggacccgcccgccggcatcagcggcgcgccgcacgacaacaacatcatgctctggaacgccgtcatattcgggccggatgacacgccgtgggacggatgcacgttcaagctgactctgcaatttacagaagattaccccaacaaacctccgactgttcggtttgtttcgaggatgtttcacccgaacatttatgcggatggaagcctctgtttggacatcctacaacagcagtggagtcctctgtacgatgttgcggcgatgttgacctctattcagtcgctgctgtgtgacccanaccaaattctcctgccaactctgaagcagccagaatgttcagcgagaacaagcgtgagtacagctgcaaagttcgtgaggttg

SEQ ID NO: 42301 - protein, 144 aa, Zea mays
  misc_feature: Ceres CLONE 1439951-F
  misc_feature (8)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature (117)..(117): Xaa is any aa, unknown, or other
MSTPARKRLMRDFKRLQQDPPAGISGAPHDNNIMLWNAVIFGPDDTPWDGCTFKLTLQFTEDYPNKPPTVRFVSRMFHPNIYADGSLCLDILQQQWSPLYDVAAMLTSIQSLLCDPXQILLPTLKQPECSARTSVSTAAKFVRL

SEQ ID NO: 42302 - DNA, 685 bp, Zea mays
  misc_feature: Ceres CLONE 1439960-F
  misc_feature: Encodes the peptide sequence at SEQ ID NO. 42303
  misc_feature (307)..(307): n is a, c, t, g, unknown, or other
  misc_feature (418)..(418): n is a, c, t, g, unknown, or other
  misc_feature (454)..(454): n is a, c, t, g, unknown, or other
  misc_feature (555)..(555): n is a, c, t, g, unknown, or other
aaagctggagctccccgcggtggcggccgctctacaactagtggatcccccgggctgcaggaattcgcacgagaccattacctagaacatcctaatcgaaaaatgcgcggaggcggttctcacagcacggaggcgctcatcagtcatcactagtacttcactagttagctagcaatattcctactcgctaagtagtggagaactggagatcgacatgagccaggggcagcccaggacgcgacgggcgaagagggaatgcacgcgcacgacaagcccgtccagttcagcgacgtgctcgagctctcangccaggtgggctaccaccacatggctccgaaggacggcgcgcggctgggggtcggggagcagtacgtgctcggcgggacggagaagggaggggcggttttggtgccccacncccccacgacggtacagtcaccagcggagcaggtangcagggctcagaccacatggcctggccccaaagcgggggcgaccgtgccggacacaaacctagctggccgccccgtcgtctcctactccgtccgccggcangcaggtcgggaaaaaggagagcccggcctccccgtgggagtaatgacccacctgagcgggctggagaaggaccccgtcccgacacggacgcccgcttgaaggatgctggcggccattggcgggtgggcgg

SEQ ID NO: 42303 - protein, 132 aa, Zea mays
  misc_feature: Ceres CLONE 1439960-F
  misc_feature (18)..(18): Xaa is any aa, unknown, or other
  misc_feature (55)..(55): Xaa is any aa, unknown, or other
  misc_feature (67)..(67): Xaa is any aa, unknown, or other
  misc_feature (100)..(100): Xaa is any aa, unknown, or other
MHAHDKPVQFSDVLELSXQVGYHHMAPKDGARLGVGEQYVLGGTEKGGAVLVPHXPTTVQSPAEQVXRAQTTWPGPKAGATVPDTNLAGRPVVSYSVRRXAGREKGEPGLPVGVMTHLSGLEKDPVPTRTPA

SEQ ID NO: 42304 - DNA, 679 bp, Zea mays
  misc_feature: Ceres CLONE 1439963-F
  misc_feature: Encodes the peptide sequence at SEQ ID NO. 42305
aaaactggagctccccgcggtggcggccgctctagaactagtggatcccccgggctgcaggaattcgcacgagaccattacctagaacatcctaatcgaaaacgaaaagcggttttgcacttctcgccttctctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctagttgcagttcatagtgatgcatggctcctgtctgttgcattctactttggagctcgttttggatttgacaaagatgccaggagaaggctcttcaccatgattaacaacctgcccactgtttatgaagttgtgacgggggttgctaaaa

SEQ ID NO: 42305 - protein, 148 aa, Zea mays
  misc_feature: Ceres CLONE 1439963-F
MDGDGGGAGALHHHTRSPEDVFRDFRARRAGIVKALTTDVEKFYQQCDPEKENLCLYGLPNETWEVTLPAEEVPPELPEPALGINFARDGMVEKDWLSLVAVHSDAWLLSVAFYFGARFGFDKDARRRLFTMINNLPTVYEVVTGVAK

SEQ ID NO: 42306 - DNA, 652 bp, Zea mays
  misc_feature: Ceres CLONE 1439970-F
ggagctccccgcggtggcggccgctctagaactagtggatcccccgggctgcaggaattcgcacgagaccattacctagaacatcctaatcgaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataacttgccctcccccggatccgccattgccccggtggcctctctgcgtgccctacaccttgctgcctctttcttggctgccttcgacatcgccaaataacagcactagctgcagcggtagaggatcttttcgaggtaagctaggccggcccggttcc

SEQ ID NO: 42307 - DNA, 861 bp, Zea mays
  misc_feature: Ceres CLONE 1439976-F
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
tgggggggggctttctccttgtggggtggagggggggggggttaccaatcccctctctgtcggtnnntgggggnngngtatagtggcgctccccgcggtggcggccgctctagtactaaggatcccccgggctgcaggaatttgtccgagaccattacctagaacatcctaatcgaaaaagttcgttcgcgttggccgtgactctctccgtcctcctactggccacccgagtcacacgcttggcacgcgcgggcgctcacccgtccgtcgccgctggctcggctgcctgattgatttgggtgccccggttccaggagtgggggaccaggcgcattatccccaccgcctacaccgggagtgccctgctcgtggtagggacagggcgcgggccgcggggcatcatgctgttcggcctcatccgcgggccgtccgggggcgcgggtggagtcggactccggaaggggggggggcggggggcgggggggggggggggccaccgggcggccgcccgggggggcagcccgggtttggcccggcggggtattgggccctggccgtccacgcggggcggcgggaaagggggggggccgtcgggcgggatgggaggaacccgcccgcggggctcgcccccccccccgtgcctcgggaactctgttcgcgggggggggtgccaggcagcaccccctacgaggagcggcgcgacccccggggggtcccctccgggcgggatacccgcgccccgccagcgggggggcgagggagggcgcgcccccttgttgggtcccgcgcaccccgggtacggggggaaaaggggctgcgcgggggggcattttagactgtcgggggtcggtggtgcggggg

SEQ ID NO: 42308 - DNA, 659 bp, Zea mays
  misc_feature: Ceres CLONE 1439980-F
  misc_feature: Encodes the peptide sequence at SEQ ID NO. 42309
  misc_feature (496)..(496): n is a, c, t, g, unknown, or other
aaagctggagctccccgcggtggcggccgctctagaactagtggatcccccgggctgcaggaattcgcacgagaccattacctagagcatcctaatcgaaaaaaaaacctatcagttattcggtaccattgccatcactctctagtacgccgcaaaagacatcagccagacttcccaatttccggccacaaccatacctgctacgcttgcgccgccgcctccccccttgtcttcgcttcccgtgcaagcttcaccgccgccgtctccgactcccttcgcgatgcgaccgctttcgcgccacgattcctctatccccgccttccccgcccgcgccggttcttgcacttgaccgacccaatccgcctatctgttcccctcttccgtgcgagaggtactatcgccggccgtttcgtttcgaagctgatcggatcggcggcagatgggccgcgacgctgaggatacttcgtctccggtgtcctcgtcggaatttgagcangaagacgacgacgattgctacctgagcgatcagggggacgatgccctagaagagtctgttctccatgttctcgaggacgagcacctcgaggactgccattggtctgcctcatctgtgatcaccaaggaatcccttttggtggcgcaggtgactgcgggggctc

SEQ ID NO: 42309 - protein, 73 aa, Zea mays
  misc_feature: Ceres CLONE 1439980-F
  misc_feature (19)..(19): Xaa is any aa, unknown, or other
MGRDAEDTSSPVSSSEFEXEDDDDCYLSDQGDDALEESVLHVLEDEHLEDCHWSASSVITKESLLVAQVTAGA

SEQ ID NO: 42310 - DNA, 625 bp, Zea mays
  misc_feature: Ceres CLONE 1439994-F
  misc_feature: Encodes the peptide sequence at SEQ ID NO. 42311
  misc_feature (120)..(120): n is a, c, t, g, unknown, or other
  misc_feature (569)..(569): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaaaaagcaaattgacaccnttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgttcagtttctctcccaccccaagggcaggggctcccccgtcgtctacaggcgatccttcctcgagaagaaaggccttagcaccgaagagatcgacgaaggcttccgaaggggtcctgatcctctacccagcactaccggtaccacttctccgcagcagcaggtcaacagccagaatcaatccggtcggggtgcagcttatgcgccagcacaacctgtgcaccagcaaacgctggccctgtcgtccttccaacgcagcccangtttagctggtacccagcattcctggctgcnagggctctgcttgggtttggtgcta

SEQ ID NO: 42311 - protein, 151 aa, Zea mays
  misc_feature: Ceres CLONE 1439994-F
  misc_feature (37)..(134): Pfam Name: Pex14_N Pfam Description: Peroxisomal membrane anchor protein (Pex14p) conserved region
  misc_feature (133)..(133): Xaa is any aa, unknown, or other
  misc_feature (143)..(143): Xaa is any aa, unknown, or other
MASGIGSGQQQPPAPAADADPGAVGDKLVFEAPPQPVREDYVQNAVQFLSHPKGRGSPVVYRRSFLEKKGLSTEEIDEGFRRGPDPLPSTTGTTSPQQQVNSQNQSGRGAAYAPAQPVHQQTLALSSFQRSPXLAGTQHSWLXGLCLGLVL

SEQ ID NO: 42312 - DNA, 660 bp, Zea mays
  misc_feature: Ceres CLONE 1440000-F
  misc_feature: Encodes the peptide sequence at SEQ ID NO. 42313
ggagctccccgcggtggcggccgctctagaactagtggatcccccgggctgcaggaattcgcacgagaccattacctagaacatcctaatcgaaaaactcgcactcgcactcgcacctgcacctcgcactagctagtcttgccaattaagctaggtatagaccagcatggcttctgctctcaagatgacggccatctgcatgctgatcctgaccacgggccagctgatggcaactgccggtgcaaaggcgccgctggtgcaggcggacgccgcgcctacggctcgccgtctgctctcggcggaccatgagcgctcagcctccgggaggacgagcaactgcccctgcaccgccatgactccgtggtgttgcttcggtttgcagaggacggcgacggagaactgcccctgcaccggcaggactccgtggtgttgctccggtttgcagatgacggcgctagaggactgcccctgcagcccatttacaccatggtgctgctccgggttgcagaagaccgcgctggaggactgcccctgcacccccatgactccattcctgttgcttttgcggccgcagtgctgccacaactgaaatcttcctgagaagaacatgcatgcagattgatgtggcctcctaaagtgggccggatggggcttgcctat

SEQ ID NO: 42313 - protein, 140 aa, Zea mays
  misc_feature: Ceres CLONE 1440000-F
MASALKMTAICMLILTTGQLMATAGAKAPLVQADAAPTARRLLSADHERSASGRTSNCPCTAMTPWCCFGLQRTATENCPCTGRTPWCCSGLQMTALEDCPCSPFTPWCCSGLQKTALEDCPCTPMTPFLLLLRPQCCHN

SEQ ID NO: 42314 - DNA, 648 bp, Zea mays
  misc_feature: Ceres CLONE 1440003-F
  misc_feature: Encodes the peptide sequence at SEQ ID NO. 42315
  misc_feature (420)..(420): n is a, c, t, g, unknown, or other
gctccccgcggtggcggccgctctagaactagtggatcccccgggctgcaggaattcgcacgagaccattacctagaacatcctaatcgaaaaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgcccgcaccatgccactaccctactcanccgccccggcctcaggctcatccccagcacaccccatgccgtgccaacagccgcattaagccccgtgccagctgcagggaacctgcggcgtttggcagcacccccatcctgggccagtgcgtcgagtccctgaggcttcattggagcccgaggggaaccccctaattgtccccctaaggccaattctttcgcgcccagttttcccccccccccagcgggggggacccc

SEQ ID NO: 42315 - protein, 142 aa, Zea mays
  misc_feature: Ceres CLONE 1440003-F
  misc_feature (88)..(88): Xaa is any aa, unknown, or other
MRVLLVALALLALAASATSTHTSGGCGCQPPPPVHLPPPVHLPPPVHLPPPVHLPPPVHLPPPVHLPPPVHVPPPVHLPPAPCHYPTXPPRPQAHPQHTPCRANSRIKPRASCREPAAFGSTPILGQCVESLRLHWSPRGTP

SEQ ID NO: 42316 - DNA, 600 bp, Zea mays
  misc_feature: Ceres CLONE 1440006-F
  misc_feature: Encodes the peptide sequence at SEQ ID NO. 42317
  misc_feature (551)..(551): n is a, c, t, g, unknown, or other
ggagctccccgcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtcttcccatccccacaccaccaccaccaccatcttccggtcttcccctccccacacccggcgggatccccaccatccccgccccccgatggagctgttcgcgcgcgccaaggtggtgcggctcaagagccaccacgacaagttcctgtacgctgacgagacgaggctcacctgacgggggagcgggacgggtcgtctgctaacgcgcggtgggccgtggagccggcgccgcacaacccgggcgccatccgcctgcggagcctgtactgccactacctcaccgcctccggggagccgttcctgctggggatgacgggccggaaggtgacgcaaacggtgcccgcctgcgcccgncccggcaacgcgtccgtggactgggagcccgtgcgggaccgcttccagt

SEQ ID NO: 42317 - protein, 31 aa, Zea mays
  misc_feature: Ceres CLONE 1440006-F
MTGRKVTQTVPACARPGNASVDWEPVRDRFQ

SEQ ID NO: 42318 - DNA, 670 bp, Zea mays
  misc_feature: Ceres CLONE 1440016-F
  misc_feature: Encodes the peptide sequence at SEQ ID NO. 42319
aagctggagctccccgcggtggcggccgctctagaactagtggatcccccgggctgcaggaattcgcacgagaccattacctagaacatcctaatcgaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggccggcaggctcaagggctccacgctccttaccgaaggagtggtgacggatggatcagatgaatgggcaatctacggcgggaccggagagtttgctatggcgagaggtgtcgtcaaaagaaggactccagcatctctgtcaccaagattgggttatggggtggcgaaggagggtcggcgcaggacatcacgacgacggagccaccgcagcgcctgcacagcctcacc

SEQ ID NO: 42319 - protein, 173 aa, Zea mays
  misc_feature: Ceres CLONE 1440016-F
  misc_feature (7)..(156): Pfam Name: Dirigent Pfam Description: Dirigent-like protein
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWAIYGGTGEFAMARGVVKRRTPASLSPRLGYGVAKEGRRRTSRRRSHRSACTAS

SEQ ID NO: 42320 - DNA, 643 bp, Zea mays
  misc_feature: Ceres CLONE 1440019-F
  misc_feature: Encodes the peptide sequence at SEQ ID NO. 42321
  misc_feature (503)..(503): n is a, c, t, g, unknown, or other
ggagctccccgcggtggcggccgctctagaactagtggatcccccgggctgcaggaattcgcacgagaccattgcctagaacatcctaatcgaaaaattttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctanggaacaaccggttcgcggaggtcccagagctcgcgccactcgccggggtccgggtcgagtcgctcgacctgttccagtgccccgtcaccaaggtcaaggggtacagggatgaggtcttcgcgctgattcccagcctcaag

SEQ ID NO: 42321 - protein, 157 aa, Zea mays
  misc_feature: Ceres CLONE 1440019-F
  misc_feature (111)..(111): Xaa is any aa, unknown, or other
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLXNNRFAEVPELAPLAGVRVESLDLFQCPVTKVKGYRDEVFALIPSLK

SEQ ID NO: 42322 - DNA, 646 bp, Zea mays
  misc_feature: Ceres CLONE 1440022-F
  misc_feature: Encodes the peptide sequence at SEQ ID NO. 42323
  misc_feature (38)..(38): n is a, c, t, g, unknown, or other
  misc_feature (626)..(626): n is a, c, t, g, unknown, or other
gcgtacataaaaggagctgcggggctgcaggattacanacaagacgattagcggagaacatcctaatcgaaaaagactcaagggccaatgtagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgacgctggtgggcaagcgacgccgacggcagtgatggcagatgacaagaaagcaggcggcggcgacgacgacnagaagaagaagccgtggaaa

SEQ ID NO: 42323 - protein, 163 aa, Zea mays
  misc_feature: Ceres CLONE 1440022-F
  misc_feature (157)..(157): Xaa is any aa, unknown, or other
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDAGGQATPTAVMADDKKAGGGDDDXKKKPWK

SEQ ID NO: 42324 - DNA, 638 bp, Zea mays
  misc_feature: Ceres CLONE 1440024-F
  misc_feature: Translation starting site: 257
aaagctggagctccccgcggtggcggccgctctagaactagtggatcccccgggctgcaggaattcgcacgagaccattacctagaacatcctaatcgaaaagcttcagctcggcgtcttcacaaacgtcggtgcaaactctcgcccgagcccgacagatcttcaattccacattccgcccaccgatcgaccttcacgccagtatcggtctcttccgaaggcgtcccgcgcggttgtttgagaagagaggaggaatatgaaggagtgcatctccctcgacatcggggagggctggctcctcatccgcaacacgtgctgggaagtttactgtgtcgagcacggcactccatcctgatggcccaatgcctgaagataagaccgcgcgacatgcacgatgatgccttcagcacacttcttcggccatcactggtgctgggaagcacgttccccgtgcaatcttcattgatctagacccactgtccatcgaagaagtgcgcactgtaccataccgccagctcttctctgctgagcagctcatcggtggcaaggaggatgccactaacgatttcgcccgtgggcgctacacaattggacaggagattgttgatctgtgacttgaccgcatccggatggttgat

SEQ ID NO: 42325 - DNA, 687 bp, Zea mays
  misc_feature: Ceres CLONE 1440037-F
caaactggagctccccgcggtggcggccgctctagattcgtggatcccccgggctgcaggaatttttaccagaccattacctagaacatcctaatcgaaaaatccattggtgtggacgtgtcacgtgtggtggttgcgttgcggggccccgatttcgagcgggtgttcaattttggtgccggatttttaaggaggatccaatttaggaagaattttggttttggggacaatggttttggactgcctgatattcgattcataggttggtcaaacgctttggagtagagaatttttttcccggaaaagaagagccatttttctagttgtgctactcgtcaatcaatccagtgaagctgaactctggaagaagaaactttcctaattagacccggtatttcgtggttggccgttggcgtcctaagtctaatttatttgtcgcgttttaatttaaaaatgaacatatttttcctggttactccggccaaaatcctttccgctggaatcacttgtgaatccgggtttgtttgttttttatctgaactattcttggtgaattaagaatttccattccgcaaattccaagggaaccccccaatttttgcccgaattctttcccaattttttggcccccaacaaagagggccccacagcccttttttttttttccccccccccagaaaggaaggg

SEQ ID NO: 42326 - DNA, 647 bp, Zea mays
  misc_feature: Ceres CLONE 1440051-F
  misc_feature: Encodes the peptide sequence at SEQ ID NO. 42327
  misc_feature (108)..(108): n is a, c, t, g, unknown, or other
  misc_feature (337)..(337): n is a, c, t, g, unknown, or other
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaaactatntctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggtttgccacttgctagcgtgggcgaacctgatgctgcagcaactgttggncctcacgcttcagcccgtgcagatgccaatgatgatgccaggtatgatgccaccgagacnatgatgccgatgccgaatatgatgccatcgatgatggtgcgaatatgatgtcacccataacgatacctagtttgatgcccccgaatgagatgccaaacatggtttccaccatggatgatgcccaaaaagaagccctccaacaaagacccccaagattaatgccccccaaaaggaagcccagtatggaacccccccaataaaaatccccagaatgggggccccccagggaaaggcccaaaactgggggccg

SEQ ID NO: 42327 - protein, 86 aa, Zea mays
  misc_feature: Ceres CLONE 1440051-F
  misc_feature (67)..(67): Xaa is any aa, unknown, or other
MAAKMFALFALLALCATATSATHIPGHLSPLLMPLATMNPWMQYCMKQQGVCHLLAWANLMLQQLLXLTLQPVQMPMMMPGMMPPR

SEQ ID NO: 42328 - DNA, 621 bp, Zea mays
  misc_feature: Ceres CLONE 1440053-F
  misc_feature: Encodes the peptide sequence at SEQ ID NO. 42329
ggagctccccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatc

SEQ ID NO: 42329 - protein, 113 aa, Zea mays
  misc_feature: Ceres CLONE 1440053-F
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGI

SEQ ID NO: 42330 - DNA, 649 bp, Zea mays
  misc_feature: Ceres CLONE 1440057-F
  misc_feature: SWISSPROT Homolog: EC 2.6.1.1 Aspartate transaminase
  misc_feature (332)..(332): n is a, c, t, g, unknown, or other
  misc_feature (334)..(334): n is a, c, t, g, unknown, or other
  misc_feature (380)..(380): n is a, c, t, g, unknown, or other
tcccccgggctgcaggaattcacacgagagagttatctacaactttttagtccaaaaagccctgctattcatgagaatagggttgctaccgtgcagagcctatcgtgtactggttctttaagaatcagaggtgaatttcttgcaaggcactatcgcaagcgcactatctacatcccacaaccaacctggggaaatcacccaaaattcttcaccctatctggcttgcacgttacgagctaccgctattatgatcctgctacatggagccttcacttcgaaggactcctggaagacctcggttctgctccttcacgttctattgttgtggtgcntncctgtgctcacaactctcctgtagtagatccccccccccccccccncggcacccacgaggccgttgacgagatctgagtcgctgcttccgttctttaaccgtcccctgcaaggttttccaggtggaggtcttggcatgcatgctcaattagcgcagtaggtgcgtggttaagggtggtgaagttctcctggttcccagcttcgtttaaaaacactgggattggattcgaaaaggttattgcgcggattaaagaaattgtaacgaaaacgtagaccgaattacaccttttgggggtgaaaagtccaccccagcaca

SEQ ID NO: 42331 - DNA, 683 bp, Zea mays
  misc_feature: Ceres CLONE 1440064-F
  misc_feature: Encodes the peptide sequence at SEQ ID NO. 42332
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (404)..(404): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctggggctccccgcggtggcggccgctctagaactagtggatcccccgggctgcaggaattcgcacgagaccattacctagaacatcctaatcgaaaaaatctagcaaacggaaatcccatctcgccgccgccgcgatgtctcgccgctatgacagtcgcacgacgatcttctcgccggaagggcgtctctacccagtggagtacgcgatggaaggcgaatcgcaacccggggtcagccctcgggatccttggcggcccgacggcgtaatcctgntcgggcaaaaaaaaagggaccttccaggtccctccaaaactccccttcccccccaaaaaatgccaaaaatcccttccccccctggggtgggcctttgggcagggaatttttgtggaagggcgaaatctccttaaaaacccccccgcccccccaccccgggggtaaaacccctttcccaaaaagggaagcccatcccctgaaaaaaaaattttcaaaaccccccttgggaaaaacaaaaaggggggggaccccccctcttttgggggccccccccccccc

SEQ ID NO: 42332 - protein, 90 aa, Zea mays
  misc_feature: Ceres CLONE 1440064-F
  misc_feature: SWISSPROT Homolog: EC 3.4.25.1 Proteasome endopeptidase complex
  misc_feature (47)..(47): Xaa is any aa, unknown, or other
MSRRYDSRTTIFSPEGRLYPVEYAMEGESQPGVSPRDPWRPDGVILXGQKKRDLPGPSKTPLPPQKMPKIPSPPGVGLWAGNFCGRAKSP

SEQ ID NO: 42333 - DNA, 668 bp, Zea mays
  misc_feature: Ceres CLONE 1440067-F
  misc_feature: Translation starting site: 214
  misc_feature (510)..(510): n is a, c, t, g, unknown, or other
aagctggagctccccgcggtggcggccgctctagaactagtggatcccccgggctgcaggaattcgcacgagaccattacctagaacatcctaatcgaaaaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctctgactcggcggagtccatcgagaagacctcccaggcgctcaagatcctcaagcaggtcggcgcctacaccgacgccgagaaggccaaggactccgtcggcatccgccccggcaagggtaagatgcgcaaccgccgctacatcaaccgcaagggccccgctcgtcgtctacggcaccgagggctccaagggcgtcaagggcttccgcaaccttcccggcgtggacgtcgcccacgtcgagcggctcaaactgctcgacctcgccccccggtggacacctcnggcgctttttgatctggaacgaaagccgcgtcaaaaaactccaggaagtgtattggaagctttgacccgccgtcccaaaaaaagaaagggctttgtcctgcccaaggcccagaatggcaaagcttgacctgggcaggaatatcaactcctgaagaggg

SEQ ID NO: 42334 - DNA, 669 bp, Zea mays
  misc_feature: Ceres CLONE 1440068-F
  misc_feature: Encodes the peptide sequence at SEQ ID NO. 42335
  misc_feature (636)..(636): n is a, c, t, g, unknown, or other
aagctggagctccccgcggtggcggccgctctagtactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgacgctggtgggcaagcgacgccgacggcagtgatggcagatgacaagaaagcangcggcggcgacgacgacaagaagaagaggccgt

SEQ ID NO: 42335 - protein, 161 aa, Zea mays
  misc_feature: Ceres CLONE 1440068-F
  misc_feature (151)..(151): Xaa is any aa, unknown, or other
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDAGGQATPTAVMADDKKAXGGDDDKKKRP

SEQ ID NO: 42336 - DNA, 632 bp, Zea mays
  misc_feature: Ceres CLONE 1440071-F
  misc_feature: Encodes the peptide sequence at SEQ ID NO. 42337
aagctggagctccccgcggtggcggccgctctagaactagtggatcccccgggctgcaggaattcgcacgagaccattacctagaacatcctaatcgaaaacactggaatgatcttgtaattattattgcagtggtcagttcaaagcagaaggaaaccagtagcaccagtgggatgcgagatagtgttgaaacaagtcctctcttgcagtacagggcccagacagtggtgccaggtcgggtgttgaaaatggaagaagctatcaagaaccgtgactttgaatcctttgccaaattaacttgtgcggatagcaaccagtttcatgctgtatgcttagacacgagccctcctatcttctatatgaatgacacgtcacacccgataattagccttgtggaaaaatggaaccactcagaaggtaccccacaggtcgcttacaccctcgatgctgggccaaacgctgttctaatcgcacaaacccgtaaactgcagcacatctccttcaggagctcctatactatttccctccacaggaatatgatttgaacagctatctgggttgcgataaatcgattctaggtgtcgccggaatgcattccatgaaagacgtcgaggctccttcaacacctcaag

SEQ ID NO: 42337 - protein, 180 aa, Zea mays
  misc_feature: Ceres CLONE 1440071-F
  misc_feature: SWISSPROT Homolog: EC 4.1.1.33 Diphosphomevalonate decarboxylase
AGAPRGGGRSRTSGSPGLQEFARDHYLEHPNRKHWNDLVIIIAVVSSKQKETSSTSGMRDSVETSPLLQYRAQTVVPGRVLKMEEAIKNRDFESFAKLTCADSNQFHAVCLDTSPPIFYMNDTSHPIISLVEKWNHSEGTPQVAYTLDAGPNAVLIAQTRKLQHISFRSSYTISLHRNMI

SEQ ID NO: 42338 - DNA, 646 bp, Zea mays
  misc_feature: Ceres CLONE 1440073-F
  misc_feature: Translation starting site: 155
tggagctccccgcggtggcggccgctctataactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacacaacaactaccattcagccagctacctgctgcctacccccagcaatttctttcatttcaccaactggcagcattgaactctcctgctttattac

SEQ ID NO: 42339 - DNA, 666 bp, Zea mays
  misc_feature: Ceres CLONE 1440075-F
caagtggagctcccgcggtggggcgctctagaatagtggatcccccgggctgcaggaattcgcacgagaccattacctagaacatcctaatcgaaaaaaccaatgggttcatgcacaaccccagccatggtctccatacgcactcctacgagactgctctcaggagtctgcaacctctgctggccccaaaggagctacctaatcgtccctcctcctcctccttccttcctcgaccacgaagactcctccatctccctccaggcttctaccctctcctcatcgtccttatcgtgactctcctcaccccattaatcctcgtgcgctactaacactctcgtctttcttatcgccgccgcccccgccaccaaaacttctcctcacaactttcccgtagctatccacctccagtcattgccgggtggacatggtctccacaccctctcattaaatcgattaccgcgttatctgtatcgcccggcacatggacacctctacgggacagatctctccgcttggatgaccgatttcaaaaacaactacagcttcatgcttttgcccaaccgtcaccacgcctttcactcttccgtgtatcgacacttggttgaagtctacactctaactgccctctctgcctggctttcctcaccgaaatcgatatcacgaacc

SEQ ID NO: 42340 - DNA, 633 bp, Zea mays
  misc_feature: Ceres CLONE 1440087-F
  misc_feature: Encodes the peptide sequence at SEQ ID NO. 42341
  misc_feature (412)..(412): n is a, c, t, g, unknown, or other
  misc_feature (483)..(483): n is a, c, t, g, unknown, or other
  misc_feature (497)..(497): n is a, c, t, g, unknown, or other
aagctggagctccccgcggtggcggccgctctagaactagtggatcccccgggctgcaggaattcgcacgagaccattacctagaacatcctaatcgaaaaattctgtggtccgccgcgccctccatacccccgcccctgtggcgcactcatctctctcgccgcggcaaaatcgtttagccgtcccaatccgaccacttttctccgatcgagcatgagcatggcgttctcctgcgcgggcgcgcgcctccacggtcgcaccggcgtcggcggcgccaaatgccgtcccggcgcggctctgctcgggcggcggggcacctgcttccgtccgaccgcctggaggtggagcaccgccaggggaatcgcgctgaactcccgcagcgcgcgggcgaacgcgatgggccgcaccctcngccggacgtcgtcgtcccgaagcggggacgctactgaggaggtgcccgcgttggtcacctgttgggctccngaaaacttgatgcnatgatgtgggaatgaaagtccctcccgcccccgcggcggtggggaccgcaaaaatgccgcgtaaccccgccggggtaacggtacaaaaagaggaaaagtttgaaccttctcttttaaaacagggccccgagggggg

SEQ ID NO: 42341 - protein, 94 aa, Zea mays
  misc_feature: Ceres CLONE 1440087-F
  misc_feature (67)..(67): Xaa is any aa, unknown, or other
MSMAFSCAGARLHGRTGVGGAKCRPGAALLGRRGTCFRPTAWRWSTARGIALNSRSARANAMGRTLXRTSSSRSGDATEEVPALVTCWAPENLM

SEQ ID NO: 42342 - DNA, 692 bp, Zea mays
  misc_feature: Ceres CLONE 1440090-F
  misc_feature (569)..(569): n is a, c, t, g, unknown, or other
  misc_feature (692)..(692): n is a, c, t, g, unknown, or other
agagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacattttcttcccattcaccaactgtctacactggaccctgctgcnttattgcagcaacaactattaccatttagccagctagctactggctactctcagcaacaacaacttctccattaaaccaatggcccgcactgaacccccctgcttttttgcagcagcaaacan

SEQ ID NO: 42343 - DNA, 716 bp, Zea mays
  misc_feature: Ceres CLONE 1440095-F
  misc_feature: Encodes the peptide sequence at SEQ ID NO. 42344
aaagctggagctcccagcggtggcggccgctctagaactagtggatcccccgggctgcaggaattcgcacgagaccattacctagaacatcctaatcgaaaaattctgcagtatggctcgccgactctgccgtctccctcgcctctttcccctcgtctcgtctgcatccgcctccgccgccccaagacctcatcacctccccttcgccgtgaaccctaaccccgcgcccctcgccccctcctcctcgtcgtcatcgccgcccgcttttccgggcccccatcgcctcttctcttccacgagtggttcaagcatggtggtcgtgggctccgcggactccttcaacagcatcttttccaaggtgcaagatgaaaagctaccagctgtcttttactacacggcggtgtggtgtggaccatgtagggcgatcgcacctttagtatcaaagctgagcagccagtatcccaagataccggtgtacaaagttgacattgaattggaaggactgggaaacaaactccgtgatctaaacatatgttcagtgccgacgttccacttctatcacagggggcagagaattagtgaaatcgtgggtgctgatgcaaagaaaatgaagctacccatggaaagtctcccacagcagcagtagaaattttcagagaagaaccctcaacatcacacaaaggaaatgcgttaatctgacctcgccaagagaaggg

SEQ ID NO: 42344 - protein, 111 aa, Zea mays
  misc_feature: Ceres CLONE 1440095-F
  misc_feature (1)..(107): Pfam Name: Thioredoxin Pfam Description: Thioredoxin
  misc_feature: SWISSPROT Homolog: EC 1.8.1.9 Thioredoxin-disulfide reductase
MVVVGSADSFNSIFSKVQDEKLPAVFYYTAVWCGPCRAIAPLVSKLSSQYPKIPVYKVDIELEGLGNKLRDLNICSVPTFHFYHRGQRISEIVGADAKKMKLPMESLPQQQ

SEQ ID NO: 42345 - DNA, 696 bp, Zea mays
  misc_feature: Ceres CLONE 1440101-F
  misc_feature: Encodes the peptide sequence at SEQ ID NO. 42346
tccccgcggtggcggccgctctagaactagtggatcccccgggctgcaggaattcgcacgagaccattacctagaacatcctaatcgaaaagcacacgcacagtccgtctcgtctgccaacgccgctactcggcgcaccttggcttgctatttcgccaacaacctcctccctctttaccgcggcgtgccgcgtgcggcgggcgcggatggcaacggccacctccgcctccgcctccgcctccgcctcccccggcgcgttcggcgccaaaaccccagccccagcccgtgggctgagcacgcacccggtcatgaccccgagccccgcattcgcgaggccttcgccgcgcacccccgcctgcagcaggtcccgcgccagcctccacctcggcggcctgggctcgaccaccagcagcagcgccaccgccgcccgaaacggaaccgggctccacgtgccccccacggtcgcgccgctcgccgtgtctacaatggtcggctccatgaagactcataagaacgccctgcccctctacgaccaggagatgccgcacctccctcagaatgtgggctctccggaccgatgacctcgaacttccatccatcccctggaggacatttccagaccgaaacctgaaactgtaccatctcaatgtccataaccttcgcgggacacatgatgcccttttggcttatcatcaa

SEQ ID NO: 42346 - protein, 124 aa, Zea mays
  misc_feature: Ceres CLONE 1440101-F
  misc_feature: SWISSPROT Homolog: EC 2.7.6.1 Ribose-phosphate diphosphokinase
MATATSASASASASPGAFGAKTPAPARGLSTHPVMTPSPAFARPSPRTPACSRSRASLHLGGLGSTTSSSATAARNGTGLHVPPTVAPLAVSTMVGSMKTHKNALPLYDQEMPHLPQNVGSPDR

SEQ ID NO: 42347 - DNA, 800 bp, Zea mays
  misc_feature: Ceres CLONE 1440111-F
aaaactggagctccccgcggtggcggccgctctagaactagtggatcccccgggctgcaggaattcgcacgagaccattacctagaacatcctaatcgaaaaagctacaaccgaagccaccaccagcagtccagcacgactagcggaataatatccaccggcgacgggaacgggaggcggcgcggtccgagattcgaagcgatggcgttcacgatgcgggcagtgaaggtgcctccgaactcggcctcgctggaggaggccggcaccgcctcttcgattttcttccaggaggcatgccccttttatcccccccggcatggaaaatctacaacccccgacccagcttgtccccccccccccagttcccgctcggaccacccttaaaggaaaacccggtaaaaaaccatgaacggttccccaaacccccaaaggggcactggcctttttttttcttgttacaacacccccccgcgcgggggtttcatctaccacctagttctaaacccatttttaatgtcccctccccccttccaccgttatttgtgggtgaacttttttgtcaacctgcgcgcacccagggggcctttcgcgcgcccataacctcccggggtttcccacaaagaatttcacgcgcccccccctccgtatttttcttccgagaaagcaccccccccccacagggaacaaaatctggggggcaacccccgtgttttctcctaaaatctttaacacctcttttgtggataccctccgcccgggggggggggctctttatgacataaactctccctcccccccgg

SEQ ID NO: 42348 - DNA, 732 bp, Zea mays
  misc_feature: Ceres CLONE 1440115-F
  misc_feature: Encodes the peptide sequence at SEQ ID NO. 42349
  misc_feature (271)..(271): n is a, c, t, g, unknown, or other
  misc_feature (283)..(283): n is a, c, t, g, unknown, or other
  misc_feature (385)..(385): n is a, c, t, g, unknown, or other
  misc_feature (425)..(425): n is a, c, t, g, unknown, or other
  misc_feature (496)..(496): n is a, c, t, g, unknown, or other
  misc_feature (538)..(538): n is a, c, t, g, unknown, or other
  misc_feature (598)..(598): n is a, c, t, g, unknown, or other
  misc_feature (609)..(609): n is a, c, t, g, unknown, or other
  misc_feature (610)..(610): n is a, c, t, g, unknown, or other
aagctggagctccccgcggtggcggccgctctagaactagtggatcccccgggctgcaggaattcgcacgagaccattacctagaacatcctaatcgaaaaatcccacaccaaccctctgtgcctcggtccctccgcccgtacgcgcgacgagagacacgatgcggcggtccctaccccttctcctcgcgcggcaggtggcgcggcggcggcggctgagcaacgtgccggagtccaccgtctacgggggcccacgcccgcaggagtcctcnggcggcgcggcngcgtgacggtgaccacactccgtgggaagcaccgccgcggggagccccatcacgtcgtcaccgcctacgactacccctcggcgggtcacgtcgactccgccngcatcgacgtctgcctcgtcggggactccgcccgcatggntcgtcacggccacgacaccacgcttcccatcacgctcgacatcatgctcgagcactgccgcgccgtggccngggggggcgcgcgcccgctcctcgtgggggatctcccattcngctgctacgagtcctccgccgccccagctgtgattcagcgtgagggtcctcaggaaggtngaaatgatgcnnatcagcttgaaggggggtgcccatcgaggatcactgcagcccaggctattgtggaggctggaatcgctgtcatggggcatggtggcctcacaccgcaagctattagtgttctcggtggaatt

SEQ ID NO: 42349 - protein, 104 aa, Zea mays
  misc_feature: Ceres CLONE 1440115-F
  misc_feature (1)..(103): Pfam Name: Pantoate_transf Pfam Description: Ketopantoate hydroxymethyltransferase
  misc_feature: SWISSPROT Homolog: EC 2.1.2.11 3-methyl-2-oxobutanoate hydroxymethyltransferase
  misc_feature (2)..(2): Xaa is any aa, unknown, or other
  misc_feature (26)..(26): Xaa is any aa, unknown, or other
  misc_feature (40)..(40): Xaa is any aa, unknown, or other
  misc_feature (60)..(60): Xaa is any aa, unknown, or other
  misc_feature (64)..(64): Xaa is any aa, unknown, or other
MXRHGHDTTLPITLDIMLEHCRAVAXGGARPLLVGDLPFXCYESSAAPAVIQREGPQEGXNDAXQLEGGCPSRITAAQAIVEAGIAVMGHGGLTPQAISVLGGI

SEQ ID NO: 42350 - DNA, 695 bp, Zea mays
  misc_feature: Ceres CLONE 1440116-F
  misc_feature: Translation starting site: 236
aagctggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaggacaaggtggtgtacggcaccgcggacctcgggcggccgtgcgcgccgttcgccaagaacgcgtcggagatgcacggcttcacgcagggctgcctgaccctgcgcaggtgggacgagctcaacgccttcttccagaaatctgggtttttagatcagcttgggatgtcagcaaagtatgacacgaagagctactgcaga

SEQ ID NO: 42351 - DNA, 696 bp, Zea mays
  misc_feature: Ceres CLONE 1440118-F
  misc_feature: Encodes the peptide sequence at SEQ ID NO. 42352
aaagctggagctccccgcggtggcggccgctctagaactagtggatcccccgggctgcaggaattcgcacgagaccattacctagaacatcctaatcgaaaagagaactagacgccactcctacagttttacgtttacccatcaccaccagtccaggaccgagcaccgaccagatcaaccaggtccgccccgacccgaagatgcagcggtggctcccggcgctcctccgccgcgccgcgcccggcggcggggcggcgcgggtcttcgcctcgtcctccctcctcttcgacaacacgcaggagcagttcaaggagagcgtgcgcaagttcgcgcaggagaacatcgcgccgcgcgccgcggccatcgacgcctccaaccacttcccgcgggacgtggacctgtggaggctcatgggggacttcaacctccacggactcaccgcgccggaggagtaccgcggcatgggcctcggctacatgtaccactgcatctccatggaggagatcaccagggcctccggcgccgtctgcctctcctacggcgcgcactccaacctctgcatcaaccagcttgtccggcacggcagtcccgagcagatgctcaagtatctgcccaagctcatcagtggcgagcatatcggggcactggcaatgagtcgactcgactgtcagtatcatatcatttcgcttccgttgc

SEQ ID NO: 42352 - protein, 165 aa, Zea mays
  misc_feature: Ceres CLONE 1440118-F
  misc_feature (30)..(144): Pfam Name: Acyl-CoA_dh_N Pfam Description: Acyl-CoA dehydrogenase, N-terminal domain
  misc_feature: SWISSPROT Homolog: EC 1.3.99.10 Isovaleryl-CoA dehydrogenase
MQRWLPALLRRAAPGGGAARVFASSSLLFDNTQEQFKESVRKFAQENIAPRAAAIDASNHFPRDVDLWRLMGDFNLHGLTAPEEYRGMGLGYMYHCISMEEITRASGAVCLSYGAHSNLCINQLVRHGSPEQMLKYLPKLISGEHIGALAMSRLDCQYHIISLPL

SEQ ID NO: 42353 - DNA, 731 bp, Zea mays
  misc_feature: Ceres CLONE 1440122-F
  misc_feature: Encodes the peptide sequence at SEQ ID NO. 42354
  misc_feature (410)..(410): n is a, c, t, g, unknown, or other
  misc_feature (420)..(420): n is a, c, t, g, unknown, or other
  misc_feature (464)..(464): n is a, c, t, g, unknown, or other
  misc_feature (476)..(476): n is a, c, t, g, unknown, or other
  misc_feature (491)..(491): n is a, c, t, g, unknown, or other
  misc_feature (499)..(499): n is a, c, t, g, unknown, or other
  misc_feature (527)..(527): n is a, c, t, g, unknown, or other
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaaaaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcgactccgtcaggaacacgcagaagatcacggaggccatgaagctggtggccgccgccaaggtccggcgcgcgcangaagccgtcntctcctctcgccctttctcggaggcgctggtggaggtgctctancacatgaaccangagatccagacggangacatcgnactgcccctcacccgcacccgccccgtnaagaaggtggccctcgtggtcctgaccggctagcgcggcctctgcgggagcttcaacaaacacgtgctcaagaaagcggaaacccgcatcgatgagctcaagcagctgggcctccagtacaccgtcgtcagcgtggggaagaaggggcaacgctacttncagggccgcccctacatcccgttggagcgcgatctagaagggagc

SEQ ID NO: 42354 - protein, 119 aa, Zea mays
  misc_feature: Ceres CLONE 1440122-F
  misc_feature: SWISSPROT Homolog: EC 3.6.3.14 H(+)-transporting two-sector ATPase
  misc_feature (70)..(70): Xaa is any aa, unknown, or other
  misc_feature (74)..(74): Xaa is any aa, unknown, or other
  misc_feature (88)..(88): Xaa is any aa, unknown, or other
  misc_feature (92)..(92): Xaa is any aa, unknown, or other
  misc_feature (97)..(97): Xaa is any aa, unknown, or other
  misc_feature (100)..(100): Xaa is any aa, unknown, or other
MSCSHLSTAWSSSALASSASTTRRRSPPRSGLLVRCSLRELRTRIDSVRNTQKITEAMKLVAAAKVRRAXEAVXSSRPFSEALVEVLXHMNXEIQTXDIXLPLTRTRPVKKVALVVLTG

SEQ ID NO: 42355 - DNA, 726 bp, Zea mays
  misc_feature: Ceres CLONE 1440127-F
  misc_feature (726)..(726): n is a, c, t, g, unknown, or other
aagctggagctccccgcggtggcggccgctctagaactagtggatcccccgggctgcaggaattcgcacgagaccattacctagaacatcctaatcgaaaaatttttttggttggatctaccgtgacggcaaagacggtgtatcgaagggtcgacaatggttaccaccatcggtagtccatagcagcggcgggcgcaacttctacccggttttcttcccatatatctgtcaaatccttctccggttgccctccatcagcagcaatttccgccatagataccggcgatcgacggcctcggacaacccaatcgacggaacatcgcgtccgcaggagagggcaaacccttttcttctcagtactctacttgtctgcgcctggatcccctccgcacgaagataagacatgcgtcaagcactctgcttgattcaagtggatcaatccacagtagacatcaaggaaacttttgtgaagtttgacgaagtcctatagcctggatgccacttcttgccatggagcatacggaagcaaattgctgggcatctgtcactgcgtgtgcagcatcttgatgtccgctgcgaaactagactaaggataatgtcttcgccaatgttgtggcatctgtgcaatatcgtgaccttgccgagtaggcatctgatgcattttacggcttagtaactccacgcacaaatgcagtcatatgtttttgatgtcttcacggccagtgn

SEQ ID NO: 42356 - DNA, 660 bp, Zea mays
  misc_feature: Ceres CLONE 1440131-F
  misc_feature: Encodes the peptide sequence at SEQ ID NO. 42357
  misc_feature (328)..(328): n is a, c, t, g, unknown, or other
  misc_feature (352)..(352): n is a, c, t, g, unknown, or other
  misc_feature (475)..(475): n is a, c, t, g, unknown, or other
  misc_feature (572)..(572): n is a, c, t, g, unknown, or other
  misc_feature (645)..(645): n is a, c, t, g, unknown, or other
  misc_feature (651)..(651): n is a, c, t, g, unknown, or other
ggagctccccgcggtggcggccgctctagaactagtggatcccccgggctgcaggaattcgcacgagaccattacctagaacatcctaatcgaaaaaaaaaggagccgatctcaaaaacagaacagtgtccgcatttcaaactgggctccataaagttctgtcgcctcgcctgtgacctgtagggtagcagcaggcagcggagggggagagagagagagaggggatggattctcaagcgccgcttcgtcctcctctagctttcgcctgcttcatcttcctttgctcatccttctgcgcagcaaatgagatgtacgacagggttggtgncgcggcgtcagatggggagagcangaggatgcggctgcacaccgacgggagcccgcgcgacgcgcacgcgtggcctgggtacctctacacccgagcagttgggagatgcacaccccaattctggagcagcggaagctgagcccctgncccaacatcggtcccacaggaaagcgggcggtggcgaaagtgtttcgggtctagggtccgtgaagcgctacggggcggcgcttcaccgtgctggaangctaccatgaggaaccgacgatgcccggtggccaacgcgtttcctgaagctcgtggaaacaagggaagcgcgnccctcntcaacggcc

SEQ ID NO: 42357 - protein, 80 aa, Zea mays
  misc_feature: Ceres CLONE 1440131-F
  misc_feature (35)..(35): Xaa is any aa, unknown, or other
  misc_feature (43)..(43): Xaa is any aa, unknown, or other
MDSQAPLRPPLAFACFIFLCSSFCAANEMYDRVGXAASDGESXRMRLHTDGSPRDAHAWPGYLYTRAVGRCTPQFWSSGS

SEQ ID NO: 42358 - DNA, 691 bp, Zea mays
  misc_feature: Ceres CLONE 1440138-F
  misc_feature (394)..(394): n is a, c, t, g, unknown, or other
  misc_feature (396)..(396): n is a, c, t, g, unknown, or other
  misc_feature (423)..(423): n is a, c, t, g, unknown, or other
aaagctggagctccaccgcggtggcggccgctctagaactagtggatcccccgggctgcaggaattcgcacgagaccattacctagaacatcctaatcaaaaaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccncntgttccctgcggcccagggccacgaanaggaggtcagggtggacgccaccttggtcgacggggcggctccctccctcccgctcgggcgcggacacggggggcccccccaaaatgcctctccttgttaagggtgaggtcccccagggccccccgccctgaaatggcccctcaccttccagtgcccccccggggcctggaccaaagggagggggccgaggggcccttccccccccgccgcggcggggccctccccccctgccaccaatccccccgggcccccaattccgggcttccg

SEQ ID NO: 42359 - DNA, 644 bp, Zea mays
  misc_feature: Ceres CLONE 1440142-F
  misc_feature (210)..(210): n is a, c, t, g, unknown, or other
  misc_feature (211)..(211): n is a, c, t, g, unknown, or other
  misc_feature (267)..(267): n is a, c, t, g, unknown, or other
  misc_feature (271)..(271): n is a, c, t, g, unknown, or other
  misc_feature (274)..(274): n is a, c, t, g, unknown, or other
  misc_feature (286)..(286): n is a, c, t, g, unknown, or other
  misc_feature (486)..(486): n is a, c, t, g, unknown, or other
  misc_feature (504)..(504): n is a, c, t, g, unknown, or other
  misc_feature (632)..(632): n is a, c, t, g, unknown, or other
  misc_feature (635)..(635): n is a, c, t, g, unknown, or other
agagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctnnctttctggcatggtgggttgctaaaacagcgaaacccaaattttttcccctcaaantggnctnccacaaaggccntccccttattagggcctttccccccttttctttcccccccccattaacccttttccccaatttcaaaaatgggaaattaaggccctttccccggggtttatgggggggaaaaaaaaaccccaagggtttttcttttttgagggcccccttataatagggggccctcccccaaaaaaaaaagaggggcaaaattttccccncgcgggcgaaaggggcgnaaaaaccaaataccccccccttttttttacccccccccctgtgtgggggggtttttacaaaaaaaaaaatttcgcccccacccggccccccatttatatttttttttgtgggggggggggcggggcancanttctttctt

SEQ ID NO: 42360 - DNA, 818 bp, Zea mays
  misc_feature: Ceres CLONE 1440153-F
  misc_feature: Encodes the peptide sequence at SEQ ID NO. 42361
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (19)..(19): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (152)..(152): n is a, c, t, g, unknown, or other
  misc_feature (488)..(488): n is a, c, t, g, unknown, or other
  misc_feature (548)..(548): n is a, c, t, g, unknown, or other
tttgggttggnntnncntncccccccccccaccccccccctaannnanannnnaaaaaatggggctcccctcggtggcgggcgctctagaactagtggatcccccgggctgcaggaattcgcacgagaccattacctagaacatcctaatcnaaaaaacctcactcgtagctcaagcatcatcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcaccagcagcagaagcagggcgccatgatgacggccctcaagggcgcgacggccgcgaccttcggcggggcgatgctggtgctgtccgggctggagctggggggggagggggacccccctcccgggggggggggggggggggggggcggaggcgcgggccgncggggtccggcgaggggggggcggcggtgcgggggcgtcgggggggcgcgggcgcgggcncgcggcccgcctgagcgggcggcgggtgctggcgggccgcctccgctggtcgccgccgggcggggtgacggcggggggcgggaggcggtggggcgtggccgagcggggggcgcgccgtggtcgatttcgggggcccgagccggaggcgcgggggcaagggggggcccggacgcccggcgggcgtcggggcgggttgcgcagcagtcggccccgcgggatggggagcgcgccgggaggggggccttgcgtacgggggaggacgggcggggg

SEQ ID NO: 42361 - protein, 192 aa, Zea mays
  misc_feature: Ceres CLONE 1440153-F
MADHHRGATGGGGGYGDLQRGGGMHGEAHQQQKQGAMMTALKGATAATFGGAMLVLSGLELGGEGDPPPGGGGGGGGGGAGRRGPARGGRRCGGVGGARARARGPPERAAGAGGPPPLVAAGRGDGGGREAVGRGRAGGAPWSISGARAGGAGARGGPDARRASGRVAQQSAPRDGERAGRGALRTGEDGRG

SEQ ID NO: 42362 - DNA, 710 bp, Zea mays
  misc_feature: Ceres CLONE 1440156-F
  misc_feature: Encodes the peptide sequence at SEQ ID NO. 42363
ggagctccccgcggtggcggccgctctagaactagtggatcccccgggctgcaggaattcgcacgagaccattacctagaacatcctaatcgaaaaaagaaaataggagcagcttcacctcggaagctcagactcaatggttggtgcgaaggggtgtgagagatgcagggactggcaggagcactactactgggagcatatggatgcgagcaagatccgcttcttcaggtgcatgacaggagactttgctcatcgcattagcgtgccagagaagttcgcaaagaacttcaaggggcagatcaccgaagagtttcacctgaaatcacctagcagcgctgagacatggcacgtcggtgtagagaagcatggcgacaaactattcctcgtgtcagggtgggagaatttcgccaaggctcatgagctggaggagaacgatctcctgctcttcgcttgctctggaaactcttcctttgaggtcctagtcttcggagcaagtggctgtgagaaagtgtcatccctgtttggcagtggacttggtccggacatgggcaaacaattcaatgatgtggtgcgtcgacatggtgtgcatcactctgtgactgtgagtgattctgaggataccgttgcgccgtcccagctggttcgatcccctcgtaacgccttgcctttgaaggaacccagtgggaaggctagaccaagtaaatatgaat

SEQ ID NO: 42363 - protein, 191 aa, Zea mays
  misc_feature: Ceres CLONE 1440156-F
  misc_feature (28)..(122): Pfam Name: B3 Pfam Description: B3 DNA binding domain
MVGAKGCERCRDWQEHYYWEHMDASKIRFFRCMTGDFAHRISVPEKFAKNFKGQITEEFHLKSPSSAETWHVGVEKHGDKLFLVSGWENFAKAHELEENDLLLFACSGNSSFEVLVFGASGCEKVSSLFGSGLGPDMGKQFNDVVRRHGVHHSVTVSDSEDTVAPSQLVRSPRNALPLKEPSGKARPSKYE

SEQ ID NO: 42364 - DNA, 715 bp, Zea mays
  misc_feature: Ceres CLONE 1440163-F
  misc_feature: Encodes the peptide sequence at SEQ ID NO. 42365
  misc_feature (239)..(239): n is a, c, t, g, unknown, or other
  misc_feature (240)..(240): n is a, c, t, g, unknown, or other
  misc_feature (281)..(281): n is a, c, t, g, unknown, or other
  misc_feature (299)..(299): n is a, c, t, g, unknown, or other
  misc_feature (315)..(315): n is a, c, t, g, unknown, or other
  misc_feature (661)..(661): n is a, c, t, g, unknown, or other
aagctggagctccccgcggtggcggccgctctagaactagtggatcccccgggctgcaggaattcgcacgagaccattacctagaacatcctaatcgaaaagaaagcctcgccccccgccgctctcgcatcgtctccggagcgcacgtcagatcaggtgcgccgcgcccccctcgcctaagctgcgacgaccatccatcgaacaggaaggatgacgggctccatggatctcccggccanngcgggtttcagcttcgacctgtgccgcccggacaacatgcntgagaagaacgggctcanggtccccgggattcanggaggacggggacaaccatcgtcggcctcctctttcagggatgggggttgttcctgggggagaaaacaagggccaattgaagggcccccaaattttgctgtataaaaactggtgaaaaaacccccttttattggcccccaaaatttaactctgtttgggaaaaaggaaatttttttggaaaaaccaaacccccttccccaaatatggggggagccccccaacaaaaaatttttcccctttttttacaaaggggcgccccaaaataagagaagggggaaacccgcccctcccccccccctctggaagcccccccccctttttttataattataagggcgcccttttnggggcgcccccccccttttttctttgtggggaaagagaaattatttcccgcccc

SEQ ID NO: 42365 - protein, 69 aa, Zea mays
  misc_feature: Ceres CLONE 1440163-F
  misc_feature (10)..(10): Xaa is any aa, unknown, or other
  misc_feature (24)..(24): Xaa is any aa, unknown, or other
  misc_feature (30)..(30): Xaa is any aa, unknown, or other
  misc_feature (35)..(35): Xaa is any aa, unknown, or other
MTGSMDLPAXAGFSFDLCRPDNMXEKNGLXVPGIXGGRGQPSSASSFRDGGCSWGRKQGPIEGPPNFAV

SEQ ID NO: 42366 - DNA, 723 bp, Zea mays
  misc_feature: Ceres CLONE 1440165-F
  misc_feature: Encodes the peptide sequence at SEQ ID NO. 42367
  misc_feature (258)..(258): n is a, c, t, g, unknown, or other
  misc_feature (267)..(267): n is a, c, t, g, unknown, or other
  misc_feature (270)..(270): n is a, c, t, g, unknown, or other
  misc_feature (271)..(271): n is a, c, t, g, unknown, or other
  misc_feature (406)..(406): n is a, c, t, g, unknown, or other
  misc_feature (537)..(537): n is a, c, t, g, unknown, or other
  misc_feature (538)..(538): n is a, c, t, g, unknown, or other
  misc_feature (546)..(546): n is a, c, t, g, unknown, or other
  misc_feature (547)..(547): n is a, c, t, g, unknown, or other
  misc_feature (552)..(552): n is a, c, t, g, unknown, or other
  misc_feature (593)..(593): n is a, c, t, g, unknown, or other
  misc_feature (610)..(610): n is a, c, t, g, unknown, or other
  misc_feature (647)..(647): n is a, c, t, g, unknown, or other
  misc_feature (680)..(680): n is a, c, t, g, unknown, or other
aagctggagctccccgcggtggcggccgctctagaactagtggatcccccgggctgcaggaattcgcacgagaccattacctagaacatcctaatcgaaaaactcaatctctctcctctcctcgcctctccttggtgtccgtgttcacgccgtcgctagcgcctgccgcggcgaagcttctgccctccccggcgccgggctcgggtcgtcgtcggccaggcagctgctacgcgtgaacacggtcacaccagtaccacngtgacgtgnaanncggtgaactcgtgaagaacagagccgccactgaggaaccctagcgacggcggcgtgctaccggtgacattgtccccctcggtccctcctccatccccgacgcagcggcgccagcctgcaggaagcctattcgagnacaggtcgatctttgctgccttggcgagcttcagccgaaatcaggtcgagcatggcggcaggccagtaaatagagcaacacaaaacccccttcaatcatggagacctctgcagcaaccccgaccccggccnngcacacanngcggncacttccccatcgccatcgccctcgtcgtcgttgaggctgntgagggcagcggcgcancgcaacatgcgcaatcagtggtcccatctgagcgccngccaagagcagtggctggccgcccgtgctgacngtcgtgcccacccttcgggctcgttaacgtccacctctcctgg

SEQ ID NO: 42367 - protein, 35 aa, Zea mays
  misc_feature: Ceres CLONE 1440165-F
  misc_feature (11)..(11): Xaa is any aa, unknown, or other
  misc_feature (22)..(22): Xaa is any aa, unknown, or other
MRNQWSHLSAXQEQWLAARADXRAHPSGSLTSTSP

SEQ ID NO: 42368 - DNA, 731 bp, Zea mays
  misc_feature: Ceres CLONE 1440168-F
  misc_feature: Encodes the peptide sequence at SEQ ID NO. 42369
aaagctggagctccccgcggtggcggccgctctagaactagtggatcccccgggctgcaggaattcgcacgagaccattacctagaacatcctaatcgaaaaactcctcatcgccacaagtgaagtcaccgacgcacgcacggctgcagcgcgctcctactctcccgcgaccgccaccggggaggggcaatagaatatagcgaggacagccaatgcaggccgccgtcaacaccaccactgtcggcgctcacccgcacccaacaaagtcctcgttcctccgtccatcccctccttgccgcgtctacttccacgcttctccacgcccgaaccatagggcgatcgccatggccagcaagtcgcagctgcaggagcaactgatcatcactcgccccaacgactggcacctccatcttcgcgaaggcggtgtcctcgaggctgtagtgccacacagcgcgaggcattttgggagggccatcatcatgcccaacctgaagccgccggtgaccacaacggcgcgggccatggagtacagggaggagataatgagggcgctgccgccagggagtagcttcgagccgctcatgacactatacctcacagacaacacaagcccagaggagatcaagctcgcaagaaagagtggtataatcttttgctgtgaagttgtatcccgctggagcaactaccaattccccaagatggtgtcactgatatattttgggaagtgcttg

SEQ ID NO: 42369 - protein, 129 aa, Zea mays
  misc_feature: Ceres CLONE 1440168-F
  misc_feature: SWISSPROT Homolog: EC 3.5.2.3 Dihydroorotase
MASKSQLQEQLIITRPNDWHLHLREGGVLEAVVPHSARHFGRAIIMPNLKPPVTTTARAMEYREEIMRALPPGSSFEPLMTLYLTDNTSPEEIKLARKSGIIFCCEVVSRWSNYQFPKMVSLIYFGKCL

SEQ ID NO: 42370 - DNA, 703 bp, Zea mays
  misc_feature: Ceres CLONE 1440185-F
  misc_feature: Translation starting site: 323
  misc_feature (263)..(263): n is a, c, t, g, unknown, or other
  misc_feature (492)..(492): n is a, c, t, g, unknown, or other
  misc_feature (516)..(516): n is a, c, t, g, unknown, or other
  misc_feature (554)..(554): n is a, c, t, g, unknown, or other
  misc_feature (575)..(575): n is a, c, t, g, unknown, or other
  misc_feature (591)..(591): n is a, c, t, g, unknown, or other
  misc_feature (649)..(649): n is a, c, t, g, unknown, or other
  misc_feature (658)..(658): n is a, c, t, g, unknown, or other
aagctggagctccccgcggtggcggccgctctagaactagtggatcccccgggctgcaggaattcgcacgagaccattacctagaacatcctaatctaaaactagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcngcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaaagcgatccatgtccgcgtggagcatgtgcagccctccccgtgcacggaggagttccgcttgangaaagccaagaatgaccagctcanggcggatgcctaggccccgcgtgaggtgatcagcaccnagaggcagcctgtgggatctnaacctggcttcatggntgagggtgctacactcgagacagtcactcctattccttatgatgtgggtcacgatctncagggcggntactagagagaatttttgtaccttcagcagtttcaacgagctggc

SEQ ID NO: 42371 - DNA, 725 bp, Zea mays
  misc_feature: Ceres CLONE 1440186-F
  misc_feature: Translation starting site: 233
  misc_feature (260)..(260): n is a, c, t, g, unknown, or other
  misc_feature (275)..(275): n is a, c, t, g, unknown, or other
  misc_feature (381)..(381): n is a, c, t, g, unknown, or other
  misc_feature (382)..(382): n is a, c, t, g, unknown, or other
  misc_feature (429)..(429): n is a, c, t, g, unknown, or other
ggagctccccgcggtggcggccgctctagaactagtggatcccccgggctgcaggaattcgcacgagaccattacctagaacatcctaatcgaaaaatatcacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttccctntcttcccccgtaccntctcaccaacggtgtcttcggtatgtgaaaacccaattcttcaaccctacaggatccaacaggcaatcgcagctggcatcttacccttatcacccttgttcctccnnacatcatcagccctattacagcagttacctttggtgcatttattggncacaaacatcagggcacaacaactacaacaacttgtgctagcaaaccttgctgcctactctcagcaacagcagtttcttccattcaacaactagctgcattgaactctgcttcttatttgcaacaacaacactaccattcagccagttatctgctgcctacccccagcaatttcttcccttcaaccactggacagcattgaactctcctgcttattttacagagcaacaactactacccatccgccagctagctggggggaagccctgctacctccttaaccaaacccagttgttg

SEQ ID NO: 42372 - DNA, 717 bp, Zea mays
  misc_feature: Ceres CLONE 1440189-F
  misc_feature (221)..(221): n is a, c, t, g, unknown, or other
  misc_feature (385)..(385): n is a, c, t, g, unknown, or other
  misc_feature (402)..(402): n is a, c, t, g, unknown, or other
  misc_feature (430)..(430): n is a, c, t, g, unknown, or other
  misc_feature (454)..(454): n is a, c, t, g, unknown, or other
aagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgntgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactancacatccagaaggagtncacccctccacttggtgctgcgccttangggaggcatgcagatctttgtcangaccttgactggcaagaacatcacccttggaggtggagtcctcagaaccccttgacaatggtcaggcaaagatccgggaaagggagggtttcctcactggaccagaagtgttcattttttgccggaaaaatttgggaggaggggaggaccctttgtgaacccacttccaaaggggagaccccccccccttgggggcgcccctagggggggtgaggaaaatttttgggaaaccccttttggggaaaaccccccctttggggggg

SEQ ID NO: 42373 - DNA, 743 bp, Zea mays
  misc_feature: Ceres CLONE 1440191-F
agctccccgcggtggcggccgctctagaactagtggatcccccgggctgcaggaattcgcacgagaccattacctagaacatcctaatcgaaaaaattcgccttcacctcgccgcttcctccttgaccgccaccgttgacatcgtcttccggcgaggtagctcgccggaagacctcacctggacttttcctgacacaccctccacacactctttaaccctccggaatgggccgcctgcttctagctcgtcgacgccccaatctccgcttgcttcgtcgacagccccatccggctcttgtcgctctcgctacggtgtctctgcctgttcgccatggcgatccggatgacccgtcgcctactccggctacttggcgcagaaggggggcggcttcacatcggccaccgcgttctcctcccccgagcggttcggggaagccccctccgcgcttggaggggccccggggctccccctttttgcttctttacaccgccccgccggcggggagcggaatggtgtacggctccccgcgggcgcgtcttcctccttttgattgattgtgtttacatttaagctccgcggaaccgcctatgctgcttcgccctctctgggctctccgctgttttggtggctgcccgcgtggggggtgtttagcgggcaagagtaggcgccccaccgcgggtttttgtgggagggtggggtctccccgcgagtttgcttaccaaacactttgctcgccctgttg

SEQ ID NO: 42374 - DNA, 707 bp, Zea mays
  misc_feature: Ceres CLONE 1440192-F
  misc_feature: Encodes the peptide sequence at SEQ ID NO. 42375
  misc_feature (617)..(617): n is a, c, t, g, unknown, or other
  misc_feature (618)..(618): n is a, c, t, g, unknown, or other
  misc_feature (623)..(623): n is a, c, t, g, unknown, or other
  misc_feature (624)..(624): n is a, c, t, g, unknown, or other
  misc_feature (627)..(627): n is a, c, t, g, unknown, or other
aagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagaccaaagaggtggggggnnggggnnttntctacggaggaagaaggaggaggcacccccgtgctgttgctgccactcctgaggtcgcagcgaccgagggaggaagcggc

SEQ ID NO: 42375 - protein, 156 aa, Zea mays
  misc_feature: Ceres CLONE 1440192-F
  misc_feature (127)..(127): Xaa is any aa, unknown, or other
  misc_feature (129)..(129): Xaa is any aa, unknown, or other
  misc_feature (130)..(130): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVGGXGXXYGGRRRRHPRAVAATPEVAATEGGSG

SEQ ID NO: 42376 - DNA, 701 bp, Zea mays
  misc_feature: Ceres CLONE 1440194-F
  misc_feature: Encodes the peptide sequence at SEQ ID NO. 42377
  misc_feature (456)..(456): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaattagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcgccgactggcgaccctgcccttgaaggggctggcaagatgatcggcgtagggaaggcgaagcagtacgccaacgtccttgacaagcccctcagccgtggcaggcaggaggtcagtttgagtgcatttgcattcttgttctctgaggtgggtcagtacaaccagactcaagttgacaacattactgagctggaacggaggctggaggatgctggntatgctgttggtgcaagggtgcttgaactactctgtcacagggagaagggaaatagacgagagacacgacttctggggcttttatcattcatcccacgtactggtttggaaagtgttgttgggaaaggtggctgactcactttgaaagggaaccgaacccgaggatgaattcntgatcagtgaaaaggagcttcctggtaaaccgtttcatttctgggccaaaagacctgggagcattcaactgg

SEQ ID NO: 42377 - protein, 103 aa, Zea mays
  misc_feature: Ceres CLONE 1440194-F
MIGVGKAKQYANVLDKPLSRGRQEVSLSAFAFLFSEVGQYNQTQVDNITELERRLEDAGYAVGARVLELLCHREKGNRRETRLLGLLSFIPRTGLESVVGKGG

SEQ ID NO: 42378 - DNA, 627 bp, Zea mays
  misc_feature: Ceres CLONE 1440204-F
  misc_feature: Encodes the peptide sequence at SEQ ID NO. 42379
  misc_feature (325)..(325): n is a, c, t, g, unknown, or other
  misc_feature (349)..(349): n is a, c, t, g, unknown, or other
  misc_feature (350)..(350): n is a, c, t, g, unknown, or other
tggagctccccgcggtggcggccgctctagtactagtggatcccccgggctgcaggaattcgcacgagaccattacctagaacatcctaatcgaaaactcttccggcactccactgctccgtctcccggcctctcgcctctcggcctctccatcgttcgacctcgcgacgcgtcaagtaggggggcggcggccttcgcggaagatgaaccactctttcctgatcaccggaggcgatttcccgcgacactcctcccccctccccgtgctctgctagacagatagatccgggctcttccttgatttgttcggtgaggacatcatgtnggagttttcgcatcaaactgccanntagctgggaagcttaaaagaaaaaagcacaaccctcaaaatgcagcatatccgatgcagattattctgatgatgaaagtttcttcatggacgagcagagaggaaggccctgattgtccaatatgctgggaatccctccacctcggtggagaatggtcccctatggcctggtgtggggggcaccccatggggcaaaactgcatccttgggctccctggggattggtaagttgccgccccttccaaccagggggccttttttacttccctgccccaagg

SEQ ID NO: 42379 - protein, 57 aa, Zea mays
  misc_feature: Ceres CLONE 1440204-F
MQIILMMKVSSWTSREEGPDCPICWESLHLGGEWSPMAWCGGHPMGQNCILGLPGDW

SEQ ID NO: 42380 - DNA, 681 bp, Zea mays
  misc_feature: Ceres CLONE 1440207-F
  misc_feature: Encodes the peptide sequence at SEQ ID NO. 42381
acccgcggtggcggccgctctagaactagtggatcccccgggctgcaggaattcgcacgagaccattacctagaacatcctaatcgaaaaaagatggccttttgccttagctgacacgccggtgacacgctggactgcctatttgacacaccaggcatggcaatgtatgcctgacagggcattttcttggaatgtattgtcactgttcacaaaatcaggaatgttattcttggaagtcagtttgatagcctttctacttcaaggaaatgatgccagtggttttgaatctttggcacgaacctttgttatctctggagctgtagttgcagctgacgcattgctcaagactatatatgtttttggcttcggcgttcctttgttcattgatgctgatcaaggaaactgttggaaatggggctattgattctcacaaacttgtgcttactggagtctatgggttgaattgtttcatgcctcattcaaatggaaaaacaggctgtctgcaaaacccgcaatctacacctttgttgggcaaagttccctattgaagggggaaccctgtttgaaatgttcccttgttccaagggaacccggatttgggttagggtaaaaaacccccaaaaggaagggaactttcccttttcccccccccccaaaaggagatttctcaaggaatttttc

SEQ ID NO: 42381 - protein, 85 aa, Zea mays
  misc_feature: Ceres CLONE 1440207-F
MPDRAFSWNVLSLFTKSGMLFLEVSLIAFLLQGNDASGFESLARTFVISGAVVAADALLKTIYVFGFGVPLFIDADQGNCWKWGY

SEQ ID NO: 42382 - DNA, 652 bp, Zea mays
  misc_feature: Ceres CLONE 1440229-F
  misc_feature: Encodes the peptide sequence at SEQ ID NO. 42383
ggcggccgctcttaactagtggatcccccgggctgcaggaattcgcacgagaccattacctagaacatcctaatcgaaaaaatcttgccgctccaaccaattcgtcttggttgccgacacggcacctcgtcggaatcaggtggcgcgacctcctcgccggccggcgcgacaccaccatgggcccggaagcagtgcggaaaagcctggagcccaccgcaaccgccgaggaaatcactggctccacccctgcgcggctccacttctacgaccccttcgtcctcagcggcgtccgtatcgaagccgccgagcacggccgcctcctctgctctttcgtcgtcacccctcgcctcgcgagtcccgtgggatacctccgcagcggtgtcacagcgacgctcgccgaccagctgggatcggctgtgttcttctgcagtgggatccccagcagcggggtctccatcgagatcagcgtctcctttgtcgactcggctgccgtcggggtaagaccctctctcttggatcacatttcatgttgtcctcgattatggtataaaaaaagtagctccagtggagatcggaatctatgattgaactggatcgattttgcacttgctagcgctagagctaggcaattggggaaaatccctttttttct

SEQ ID NO: 42383 - protein, 135 aa, Zea mays
  misc_feature: Ceres CLONE 1440229-F
MGPEAVRKSLEPTATAEEITGSTPARLHFYDPFVLSGVRIEAAEHGRLLCSFVVTPRLASPVGYLRSGVTATLADQLGSAVFFCSGIPSSGVSIEISVSFVDSAAVGVRPSLLDHISCCPRLWYKKSSSSGDRNL

SEQ ID NO: 42384 - DNA, 1379 bp, Zea mays
  misc_feature: Ceres CLONE 1440251
  misc_feature: Encodes the peptide sequence at SEQ ID NO. 42385
ttctcttcctcccaagcaaccgcttctagccgggcgccggcggcagctaccacgtgccgccaccgtctcatcgcctcgccgtactagccccgcggcttcgtcgtccgatgagccgctgccctgtgagctatcctctcctggtcggccgctcccccctcctctcttctcgtctttttccgtgacccgcccgttcattcgcttcgtgcgtgcgtggcgcaagtcggtccctgtgcggtgatcgttgtgttgccaacggaaccaaatttagtagagtgccccccttgtgcgatagcgtctgctaattgctcgtgttggcgcgcctcgacatgttggcgttggcccccaaagttcactcgagtttatttttaaaaaataaataggggataccatattagtcgattttgtttcgttgctttttgtatcgtgcgcccgcgtgtctgagaattggatttgcccgcgagtcttggtaattcctataacagttattgtcatgagtctcatgaccatggaccatacacttccacttcagtagttcagttgcctgtggtggggaaatctcaagtactgattggaatagcatcgaaggggctaatcttgttcttgtatgtagcgcattgaaacaagtactaaaggaaaggtcgtgatttggtttgcgtaccttttattcacttctctatattatttttaaaagcacttcgtaattttcagatgaatagtgatgtctgcatactagtgcgttcattgatgaatttgtttctaggtttcctctcatacaatataatggtgtcaaagcctgtagtgcttgtcttcctgttggtggtactcataatcacgtcccagtttgaatggaagcaacagcttgtaaacgagttggaatctacggctcgcaaccagaaacatgtttcaagtagagaagagcttgtcaaggatcagataatcttcactcaagaaaagatgattcaaagattgaataattttgtccagaatcttcagcaacagttggtgcagtgtcgtggcaacaacaggacagttaatcattctggaacttctttgacatcttatattagtgagatccagatgccgcagatgatggatgactgacaatgtcgcgcggcatgaactatacggataaaaagataggatattcacagagtcatgtggacagcgaagttctcccagtaaaagcagtcataatgtagtattagcctggacagaacaatattcgatcagttccagagagaaaggaacgctgatcctttgaaaacccgtgtaattttatttcccttttcctcttttcccccctaagagaactgaaaattctttgttttatgataggcatctatatatacttattatcctctacaaaaaaaaaaaaaaaa

SEQ ID NO: 42385 - protein, 130 aa, Zea mays
  misc_feature: Ceres CLONE 1440251
MNSDVCILVRSLMNLFLGFLSYNIMVSKPVVLVFLLVVLIITSQFEWKQQLVNELESTARNQKHVSSREELVKDQIIFTQEKMIQRLNNFVQNLQQQLVQCRGNNRTVNHSGTSLTSYISEIQMPQMMDD

SEQ ID NO: 42386 - DNA, 714 bp, Zea mays
  misc_feature: Ceres CLONE 1440266-F
  misc_feature: Encodes the peptide sequence at SEQ ID NO. 42387
  misc_feature (344)..(344): n is a, c, t, g, unknown, or other
  misc_feature (697)..(697): n is a, c, t, g, unknown, or other
gctctagatctagtggatcccccgggctgcaggaattcgcacgagaccattacctagaacatcctaatcgaaaaattcattaccggaagagattaaaatgcctcggaaaagaaggagacgtcgaatattcgaaaggggaggggaaagccaagctgatggcggaggaccaggggaaagcaaagcaaatggtcgacgccccgatcaagatcgaatccatgaggaagtgggtcgtcaagcacaagttccgagccgtaggttgcctctggctacgtgggatcagcatgtcgatcgcctacaagtggtcgcggtccattatgaagcctatcgtcaaaatcctccacacnaggtttgcatgctcaacctctaagcctggctgcatgatttggtttctgggggcccgccacacccatgatccgaaagaattgtttcttcctgggccataagggggaccaatccgcaagcacaattcctgggccccattcctataaaaattaaaaggcgcaccaaggcttgctccctggcaagcacaaattaatttttgggggtcatcccctggttggccctttttacccgccccagggaagggtcggaaagtttaaatcttttttctttcgctccaacattaaaaaaaaaaaggtgtttctcgccttggccccctttatgttttaaaggggggttaaaatggcaaaaaactaanggggactctctcttctt

SEQ ID NO: 42387 - protein, 95 aa, Zea mays
  misc_feature: Ceres CLONE 1440266-F
MAEDQGKAKQMVDAPIKIESMRKWVVKHKFRAVGCLWLRGISMSIAYKWSRSIMKPIVKILHTRFACSTSKPGCMIWFLGARHTHDPKELFLPGP

SEQ ID NO: 42388 - DNA, 607 bp, Zea mays
  misc_feature: Ceres CLONE 1440283-F
  misc_feature (211)..(211): n is a, c, t, g, unknown, or other
  misc_feature (409)..(409): n is a, c, t, g, unknown, or other
  misc_feature (412)..(412): n is a, c, t, g, unknown, or other
cgcggtggcggccgctctataactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccnggcctcaggattgaagtttcgtcgcccgtcgcccgccattgggccggccgcgcctcgtgggcgtccccgcccgaaaaccccgcaccaagggcccccccgcccccgggtttcccggggtctcaaaaagcccgggggcccccctaaaccccctcgagggcgggggggctccttcctctctgcctgccatttgccgcgggnagntggctccttcttcgagggggggacccgctcctcctgatctggggctaagaaaaacccccacccccctgagaaaaaaaaaatggttgcccccccccccccaaaaaaaaaaaacaaagggttagtatatttcccgtctcctttgtatcctcccccctgcctgattaacaaccctccccccagctgggggggtgtggg

SEQ ID NO: 42389 - DNA, 666 bp, Zea mays
  misc_feature: Ceres CLONE 1440308-F
  misc_feature: Encodes the peptide sequence at SEQ ID NO. 42390
ggagctccccgcggtggcggccgctctagaactagtggatcccccgggctgcaggaattcgcacgagaccattacctagaacatcctaatcgaaaaccacacactccctcccgccgcaaaaccctagccgccgccgccccaggtaagggagagagcccaccccacgccgccgccatgaagcgcaacccccgcgtcacgagctcccgccggaagtgccgcaaggcgcacttcacggcgccgtcctccgtccgccgcgtgctcatgtccgcggccctctcctctgagctccgccacaaatacaatgtccggtccatccccatccgcaaggatgacgaggtgcaggtcgtgcgcggcaccttcaagggccgcgagggaaaggtggtgcaggtctaccgccgccgctgggtcatccacgtggagcggatcaccagggagaaggtcaatggatccacggtgaacgttggcatccaccccagcaaggtgatcgtcaccaagctcaagctcgacaaggaccgcaaggccctcctcgaccgcaaggctcgcggccgcgctgctgacaaggccaagggcaagttcacggccgaggacgtcgccgccgccgctgggggtgccacggccaccggcgcctcgctccaggagatcgattaagctcggtggatctgccgg

SEQ ID NO: 42390 - protein, 157 aa, Zea mays
  misc_feature: Ceres CLONE 1440308-F
  misc_feature (51)..(82): Pfam Name: KOW Pfam Description: KOW motif
MKRNPRVTSSRRKCRKAHFTAPSSVRRVLMSAALSSELRHKYNVRSIPIRKDDEVQVVRGTFKGREGKVVQVYRRRWVIHVERITREKVNGSTVNVGIHPSKVIVTKLKLDKDRKALLDRKARGRAADKAKGKFTAEDVAAAAGGATATGASLQEID

SEQ ID NO: 42391 - DNA, 652 bp, Zea mays
  misc_feature: Ceres CLONE 1440312-F
  misc_feature (349)..(349): n is a, c, t, g, unknown, or other
  misc_feature (350)..(350): n is a, c, t, g, unknown, or other
  misc_feature (369)..(369): n is a, c, t, g, unknown, or other
ggagctccccgcggtggcggccgctctagaactagtggatcccccgggctgcaggaattcgcacgagaccattacctagaacatcctaatcgaaaaattcgagacggcctactgttgtggtccagtgatccagtctgcgtctctttccccgtcgtggtgggttccgatccaatcgacgtcgacgactccgcagccaccgctcctctcctctcgtcgcttcttctatctctcggcgtcgaatctcatccggccagtgaccacactctactagccgcccggaaggagttcttccgggattcgagccgttgctgccctcacctctgcaggcccagcgtcgagcggagatccnnatcgaaatttgactgaccncatcttttgtcggtgtgagtcagatgtcatcctcggcgcaaacactgccagtggggtcctggctgtctatcaggtaatctatgatcggctttacatattccgggcgaagaagggaacatccccccccagaacccaagcccgatccccccttcccgggaaaaagccaaagcgaggtttaacccggcaaaattccctttcggggggggggagattccccagggggaagggaaaagggccaaaaaacccggaaacggtgggccctaaagcccccgggaatttaaag

SEQ ID NO: 42392 - DNA, 676 bp, Zea mays
  misc_feature: Ceres CLONE 1440322-F
  misc_feature: Encodes the peptide sequence at SEQ ID NO. 42393
  misc_feature (676)..(676): n is a, c, t, g, unknown, or other
aagctggagctccccgcggtggcggccgctctagaactagtggatcccccgggctgcaggaattcgcacgagaccattacctagaacatcctaatcgaaaaaaaaatatttgtttggtgagccacgctcccgtccggatccgcgggggaggacggcgatttcgtccccagcctcacgaggtcgggaaggggttcccgcacccacatttgtgaacctcgccgccgcccgtcccctgccttcacgaacccgtcgccgcccgtcccctactcttcctcgtgcacccaccgtcgctcgtcccctcgtcttccttgcgctctcgccgtcgccgcctcctcaccctcacgcacttgaggccagctgcggaacgaggtcggacggcggagacgaggtcgaggtctgtgacctcctcaacttgcgcaagactgccgagactgcagggacaagctctttgctgcctcgtcagctgcttctcggatactaacaaatgggttctataattgagttgataaggaaacatttgaagcaggtgatacacaagggattttcatcaacaagtggccgccagaagaactgaaacatcaagatggcgtttgcttttaggtcatgccattcaggagtacactgagactgttttattatgagactatgttttattatgatgcactgagactatgtn

SEQ ID NO: 42393 - protein, 29 aa, Zea mays
  misc_feature: Ceres CLONE 1440322-F
MGSIIELIRKHLKQVIHKGFSSTSGRQKN

SEQ ID NO: 42394 - DNA, 684 bp, Zea mays
  misc_feature: Ceres CLONE 1440341-F
  misc_feature: Encodes the peptide sequence at SEQ ID NO. 42395
ctggagctccccgcggtggcggccgctctagaactagtggatcccccgggctgcaggaattcgcacgagaccattacctagaacatcctaatcgaaaaaaaaaaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcgcataatgagctcgccagtggagaggtgattcgtcaggctggtatcaagttcctagtccatggtgcctggatgagcagtagagatgctactggccgtggaaggaggagggttcttctcgtcttcagctacaggttacagccatggcctcgccctcttgctgctcggacgcaaagctgaggagaagcccgtaaaggtctcgccgtggaaccagtaccggctagtcgaccgggagaccgagcaggtgtaccacctgccctccgccaaggaccaggctcctgggaaatgtgctccctttgtctgcttcggatgcacggctaatggcctcgaggtggcgtctcctccaaaagcgacctccagcaatgcgcttggtaccggtacct

SEQ ID NO: 42395 - protein, 99 aa, Zea mays
  misc_feature: Ceres CLONE 1440341-F
MLLAVEGGGFFSSSATGYSHGLALLLLGRKAEEKPVKVSPWNQYRLVDRETEQVYHLPSAKDQAPGKCAPFVCFGCTANGLEVASPPKATSSNALGTGT

SEQ ID NO: 42396 - DNA, 666 bp, Zea mays
  misc_feature: Ceres CLONE 1440394-F
  misc_feature: Encodes the peptide sequence at SEQ ID NO. 42397
aagctggagctccccgcggtggcggccgctctagaactagtggatcccccgggctgcaggaattcgcacgagaccattacctagaacatcctaatcgaaaaacccaagcgcttgcaatccacttgacttttctcctcctcgtctccttgtcctcacctctccgccgccatgtccatccccggtaacgggcaccttcccgcgtccgcttccctcccggaccactcctccgcctctgactccgacgccgatccggaatccgactaccggccaatcaccaccgccgactccgactccgaccccgacttcgacgccgccttgccccaccaccgcatcgaggagacagaaaacggcatctccgcgctggatctcgcgtccgacgaggacgaagcggcagaaggcgcggaggaagacgatggggacggagacccgaggcccggggaggcggcggcgcgggccttctcggaggacgagcgtcgccgccgcgccccgctgcccgcgggcgccgcggcgcggatcgtggacgcgatgcgcggcgtcgagttccccggcgcgccgccggcgtgggcgggcagcgtccccgaggaccagtggctcgaccgcctccagtctctccgtgccggtcgtcccaactgatgtgatgagcagaacacaatgggtcttctttcg

SEQ ID NO: 42397 - protein, 154 aa, Zea mays
  misc_feature: Ceres CLONE 1440394-F
MSIPGNGHLPASASLPDHSSASDSDADPESDYRPITTADSDSDPDFDAALPHHRIEETENGISALDLASDEDEAAEGAEEDDGDGDPRPGEAAARAFSEDERRRRAPLPAGAAARIVDAMRGVEFPGAPPAWAGSVPEDQWLDRLQSLRAGRPN

SEQ ID NO: 42398 - DNA, 662 bp, Zea mays
  misc_feature: Ceres CLONE 1440414-F
  misc_feature: Encodes the peptide sequence at SEQ ID NO. 42399
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (520)..(520): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (590)..(590): n is a, c, t, g, unknown, or other
  misc_feature (591)..(591): n is a, c, t, g, unknown, or other
  misc_feature (621)..(621): n is a, c, t, g, unknown, or other
  misc_feature (622)..(622): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
ctccccgcggtggcggccgctctagaactagtggatcccccgggctgcaggaattcgcacgagaccattacctagaacatcctaatcgaaaagaaccttccctttccccaggcacagatccgggtctccgccgccgctatggccgctcgccgcctcctccttctcctcggcgttgtcgccgcgtccctcctggatgccgacgcgcggccgtgccacagcttcctcgtcgccatctcgtacgatccaacctcgaccccaacagaggcgagggaccgtcaaccgcaactcggcgcttcccagatggcgggggatcacgtttagcgcgcccccccgggggccacccccgggnnnnnccccgggnnnnnnnnnnnnnnggcnnnnnnnnnnnnnnnnnnnnnnnncccggnnnnnnnnnnnnnnnnnnnnnnnnnnnnnnnnnnnnnnnccccgggcgccggnnnnnnnnnnnnnnnnnnnnnnnnnaannnnnnncgtcccccnnnnnntcccggcccagggngnnnnnnannnnnnnnnnnnnnnnnnnnnnnnnnnnnnnnnnnnnnnncnnnnnnnnnnnnnnnnnnncnngcccccggggaggaggggggtgtgggtttnntnnnnnnnngggnnnnnnccgtgttgggggggggcgnnnt

SEQ ID NO: 42399 - protein, 60 aa, Zea mays
  misc_feature: Ceres CLONE 1440414-F
MAARRLLLLLGVVAASLLDADARPCHSFLVAISYDPTSTPTEARDRQPQLGASQMAGDHV

SEQ ID NO: 42400 - DNA, 672 bp, Zea mays
  misc_feature: Ceres CLONE 1440416-F
ggcggccgctctagatcccgtggatcccccgggctgcaggaattcgcacgagaccattacctagaacatcctaatcgaaaatattggtgatcgacttggtcagctggaaatttatgatggtgacaccggtgctgaagtagagaaagtggaggtgcaagtaaccaagaaggcatctgccagcaccaactcacgtgccaacaagcgcaagaaaacgaaggatgtttctgaatctgaatccgaagaggatgatgatgaagaggatgaaagcggagacgatgaaaatggtggtgtagaagagtcaaagggcaggcgtggccgtaaaccttctaatagagggagaggcaggggaggcaaaaaggcgacccctgaggcaaagccatctggaaggggcagagggcgccccaagaaaaccgagggtgctgctcagaaagccggaggaacctcgggcagaggaaaaagaggacggccacgcaagatgtgatcccattgacatggaggattcatgttggtagcaatgcccgttgcactctgcccgttttctcactctgattgcagctatccaaagacattattagtctcttccccctccccccacccaatttccgaatggggtttgccatcccattgtaagtctagaaatacatctgtgttcttcattgacgatgatttctt

SEQ ID NO: 42401 - DNA, 657 bp, Zea mays
  misc_feature: Ceres CLONE 1440428-F
  misc_feature: Encodes the peptide sequence at SEQ ID NO. 42402
tggagctccccgcggtggcggccgctctagtactagtggatcccccgggctgcaggaattcccacgagaccattacctagaacatcctaatcgaaaaacctcacctcgtcctcctccgactctccgaccacccgcaggccgcagcagcaacagcccaacaggcaaagctttgcttagctcctcaactgctcaaggcatcaggccgtccttcctagcctagccagtaagccagaggacacaacagccacacccaggcctatatatacacgcgcgccatggcctccgccttcttcttcgacgccgagccggactgcgagcgcagcctgctgccgacgctggacggctgcgcgctctgcgccaagccgctgggaggcgactgcgacatcttcatgtacagagaggacacgcccttctgcagcgaggagtgccgcgacgagcagatgcagctggaggccatccgcgccaggcagcaggccgccaggtccgccgcacggaggcagcagcagcactcctccagaacggagtccaggcaccaggagtccatgaaggtatccgtggcgacctgaacggagtcctgatgactagtacaagacatcctcttgtgcagttgtgtgtcaacaagatttctgcacatgaagaaacgtcgatggagccggg

SEQ ID NO: 42402 - protein, 96 aa, Zea mays
  misc_feature: Ceres CLONE 1440428-F
  misc_feature (8)..(63): Pfam Name: DUF581 Pfam Description: Protein of unknown function (DUF581)
MASAFFFDAEPDCERSLLPTLDGCALCAKPLGGDCDIFMYREDTPFCSEECRDEQMQLEAIRARQQAARSAARRQQQHSSRTESRHQESMKVSVAT

SEQ ID NO: 42403 - DNA, 694 bp, Zea mays
  misc_feature: Ceres CLONE 1440429-F
  misc_feature: Encodes the peptide sequence at SEQ ID NO. 42404
  misc_feature (406)..(406): n is a, c, t, g, unknown, or other
  misc_feature (414)..(414): n is a, c, t, g, unknown, or other
ggagctccccgcggtggcggccgctctagaactagtggatcccccgggctgcaggaattcgcacgagaccattacctagaacatcctaatcgaaaaatcacccataatattttgagcattcagaaacacaccaagcgaagcgcactagcaacgacctaacaacaatggctaccaagatattagccctccttgcgcgtcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgctttgcgcgagcgtcttacaaacaccaattgcccagttttgcacaacatcctttgcacatcntacaatancagccatcacaacgcaacagcaaacacagtttctaccagcactgagccaccttaccatggtaaaccctgcccgcctacttgaagaaacagctgcttgcattcaaacccactggccccggggaaacgtattttgaaaacaagaaaaaaaaaaagttaaaaaatttttcggcccaacctcaataaaaataacccgggggaaacccctgggcccaaaataaaaaaaaaaaaaaaatggttttttttttaccccccccctctggggggaaaaaccccccaaacc

SEQ ID NO: 42404 - protein, 127 aa, Zea mays
  misc_feature: Ceres CLONE 1440429-F
  misc_feature (1)..(127): Pfam Name: Zein Pfam Description: Zein seed storage protein
  misc_feature (81)..(81): Xaa is any aa, unknown, or other
  misc_feature (84)..(84): Xaa is any aa, unknown, or other
MATKILALLARLALFVSATNAFIIPQCSLAPSAIIPQFLPPVTSMGFEHLAVQANMQQQALCASVLQTPIAQFCTTSFAHXTIXAITTQQQTQFLPALSHLTMVNPARLLEETAACIQTHWPRGNVF

SEQ ID NO: 42405 - DNA, 673 bp, Zea mays
  misc_feature: Ceres CLONE 1440448-F
  misc_feature: Encodes the peptide sequence at SEQ ID NO. 42406
  misc_feature (124)..(124): n is a, c, t, g, unknown, or other
ctccccgcggtggcggccgctctagaactagtggatcccccgggctgcaggaattcgcacgagaccattacctagaacatcctaatcgaaaaattcctcctgcaacactcgtcgacgtacgtancctaccaagcacctgcaagctcgcgacgcagacagcagctcggtcgcgcggtcaccatgctgggcctgctcgcgcacctccacgcggcgctcgtgttcctccccaacaacgggggcccggcctgggccgggccaggcggcggcgcgggggcggtgtacaacgtggtgcgctacggcgcccgccccgacggcatgacggacgcgacgctgccgttcctgcgcgcgtgggccgacgcgtgccgctcgcccgcgcccgggcacggtgcttggtgccgccggttgttgttcctggtggggagccccccgttcatgggcccgtggcgcccacccggcccttactttttcgccgggcccggaaccctgctcccccccctcgggttaaggttgggaaaagcccccccccgggggcgggggggccaaatttcaaatcccggggaagggcccccccgtttccggggggacaccttaaagagggggggggccccccctttggggcttgaaaaaaaaaaaaaacccgcccccccagtggcccggggggggcgcccttttc

SEQ ID NO: 42406 - protein, 164 aa, Zea mays
  misc_feature: Ceres CLONE 1440448-F
MLGLLAHLHAALVFLPNNGGPAWAGPGGGAGAVYNVVRYGARPDGMTDATLPFLRAWADACRSPAPGHGAWCRRLLFLVGSPPFMGPWRPPGPYFFAGPGTLLPPLGLRLGKAPPRGRGGQISNPGEGPPRFRGDTLKRGGAPPLGLEKKKKPAPPVARGGRPF

SEQ ID NO: 42407 - DNA, 640 bp, Zea mays
  misc_feature: Ceres CLONE 1440455-F
  misc_feature: Encodes the peptide sequence at SEQ ID NO. 42408
  misc_feature (331)..(331): n is a, c, t, g, unknown, or other
ctgaactagtggatcccccgggctgcaggaattcgcacgagaccattacctagaacatcctaatcgaaaaatgccttcatcttcgtcgtcttgcagccccgcaacagtcgttagcttagagcatcgcacctcatcgttccaccgtccgtccgtccgctcgttcgcgtgatctgtttgagagttggggaatggaggcctacgtcctgttcgcgcccgccaaggaggtgatcaggttcgaggagcaggaggaggacatcggctgcccgtccgagtcgtccgcggcgcgttcaacgtcgtcctcctcgtcgtcgtcagacggggtggacctcgncgacgaacgcagctcgtccgggtgcagctgtcactttcgagatgggctccctcatgacgcagctcccgatcaagagggggctattccagtttcttcgacggcaaggcgcaatccttccccgtcgcttggggggggggggcgggctccaagggacttgcccaagcccggcgggaaaaccggctcaaaaagttccggaaacttcgggcttccggcctcaaggaaaccccccccgccccttggcccttccccccccccaaaccgggaaagaaaaacaaggcggtcccgggggtttcgggtttaaaacccccc

SEQ ID NO: 42408 - protein, 147 aa, Zea mays
  misc_feature: Ceres CLONE 1440455-F
  misc_feature (48)..(48): Xaa is any aa, unknown, or other
MEAYVLFAPAKEVIRFEEQEEDIGCPSESSAARSTSSSSSSSDGVDLXDERSSSGCSCHFRDGLPHDAAPDQEGAIPVSSTARRNPSPSLGGGGRAPRDLPKPGGKTGSKSSGNFGLPASRKPPPPLGPSPPPNRERKTRRSRGFRV

SEQ ID NO: 42409 - DNA, 675 bp, Zea mays
  misc_feature: Ceres CLONE 1440457-F
  misc_feature: Translation starting site: 198
  misc_feature: SWISSPROT Homolog: EC 4.4.1.5 Lactoylglutathione lyase
  misc_feature (4)..(4): n is a, c, t, g, unknown, or other
aaanctggagctccccgcggtggcggccgctctagatactagtggatcccccgggctgcaggaattcgcacgagaccattacctagaacatcctaatcgaaaaaagaacaagcgcaagcacaagcagctaaagcaatctcagtggtcttcaaaacacacacacacacactgacacacatcgatcgaggtagttagagatggccggaggagatgacctgaagctgctcggcgcatggccaagcccatttgttaccagggtgaagctggcgctcgccctgaagggcctgagctacgaggacgtggaggaggacctgtacaagaagagtgagcttctcctcaagtccaacccggtgcacaagaagatacccgtgctcatccacaacggagccccggtctgcgagtccgtgagcattctccagtacatcgacaaagtgttcgccagcaccggcccgtcccttcttccagcgggcccctacgagcgcacgcattgctcgcttctgggtggcttacgttgacgacaagctggtagccccatggaggcaggggttgaggggcaagacagaggaggagaaatccgagggaaagaagcaggcgttcgccgcgtggggggtcctcgaaagggccctgagggagtgctccaagggagggggcttcttcggtggcaacagcgttcga

SEQ ID NO: 42410 - DNA, 647 bp, Zea mays
  misc_feature: Ceres CLONE 1440460-F
  misc_feature: Translation starting site: 135
  misc_feature (356)..(356): n is a, c, t, g, unknown, or other
  misc_feature (373)..(373): n is a, c, t, g, unknown, or other
  misc_feature (413)..(413): n is a, c, t, g, unknown, or other
cgctctaaactagtggatcccccgggctgcaggaattcgcacgagaccattacctagaacatcctaatcgaaaaacaaagtctaattgagagagagagaagtagagaagtcgtcggaggagaaagaagaagaagatgtcgtggcaatcgtacgttgacgaccaccttatgtgcgatgtcgaaggcaaccacctcaccgccgccgccattctcggtcaagacggcagtgtctgggctcagagcgccgctttccctcaggtttcctctcttctcttctcttctctgatcggatctgaggaatctcggatctgtatgttctgaatcagtcgagttgaacccaggggctctagatcttangttgaagactgaagagnatcatgggatcaccaaggacttcgaggagccctggtttcnttgccccgacggtttgtttctcggtggagctaaatacctggttattcaagggtgaccaggagctgtcctccgagggaaaaggggacctggaggattacttatcagagaagacccaggccctggtctttgggtcaacaaggaaacctagaaggggggcaatgcatttggtttggggaaggccccgggaatccccccccgggcgaacctcgatttttcggtttgagaccctctttg

SEQ ID NO: 42411 - DNA, 609 bp, Zea mays
  misc_feature: Ceres CLONE 1440461-F
  misc_feature: Encodes the peptide sequence at SEQ ID NO. 42412
  misc_feature (415)..(415): n is a, c, t, g, unknown, or other
  misc_feature (459)..(459): n is a, c, t, g, unknown, or other
  misc_feature (467)..(467): n is a, c, t, g, unknown, or other
  misc_feature (472)..(472): n is a, c, t, g, unknown, or other
  misc_feature (487)..(487): n is a, c, t, g, unknown, or other
cgcggtggcggccgctctagaactagtggatcccccgggctgcaggaattcgcacgagaccattacctagaacatcctaatcgaaaacttagactatctgccgctccagcctttcgctagggtttaaccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctgggactgcangtagagaaaggatcatccgtgctttcctggttgaagagcagaangattgtcnagaanggtgttgaattaacngaagacccaagaccagacttcctccaaaaattaactctgaaacagaggtgagccactcgtctgcagcaggggaaaaattttttttccgacagttattatcaatgggcttaatctccttcagc

SEQ ID NO: 42412 - protein, 107 aa, Zea mays
  misc_feature: Ceres CLONE 1440461-F
  misc_feature (5)..(103): Pfam Name: Ribosomal_L34e Pfam Description: Ribosomal protein L34e
  misc_feature (87)..(87): Xaa is any aa, unknown, or other
  misc_feature (101)..(101): Xaa is any aa, unknown, or other
  misc_feature (104)..(104): Xaa is any aa, unknown, or other
  misc_feature (106)..(106): Xaa is any aa, unknown, or other
MVQRLTYRKRHSYATKSNQTRVVKTPGGKLVYQYTKKRASGPKCPVTGKKIQGIPHLRPAEYKRSRLSRNRRTVNRPYGGVLSGTAXRERIIRAFLVEEQXDCXEXC

SEQ ID NO: 42413 - DNA, 798 bp, Zea mays
  misc_feature: Ceres CLONE 1440576-F
  misc_feature: Encodes the peptide sequence at SEQ ID NO. 42414
  misc_feature (749)..(749): n is a, c, t, g, unknown, or other
gctgacatccctccccctttcttatttttactcccaatatggatccgaccttcatactggaccccccgcggtggcggccgctctataaaagaggatcccccgggctgtaggatttcccacgagaccattacctagaacatcctaatcgaaaaacaagatgatggtataatacaacagcgcatgtggagtgtggagtgatgcagtcgagggggccagaccttacgaaggtacggcggagaggtggtaaggcgcagagagcaggttcgcttggcggacgcaccgagggaggcgtgtgggagccatgcttattatctcttcgtcttcgtcttccgcttccgcttccaaaggtaattcctttgggaaaaccgttaacgatcatctgacgtcaactttgatttccgataaccagcaacttttatttgcacgtcaaaactttgactacgggcaaacaatatttcattccccaatctgctcgcggtggtacatcccccagaattcccttgcctttggcattatcccacaatgaacccttatatgtgactctcataccccatcctcgggatacctcctcacaaaacagtcacgttgccaactttacaggggtcagaacaatgcttattcaaaaccctccacatcccttaaccttctctggagtcgcactcattctgtccttgtccatgcaagaaggggaacctaagttacccggtggccctgagttctctcaataatcttacgccaatctttctggnaaagactccagcgcctgacatcatcaatcacgtttcctcacacaccaac

SEQ ID NO: 42414 - protein, 74 aa, Zea mays
  misc_feature: Ceres CLONE 1440576-F
MLIISSSSSSASASKGNSFGKTVNDHLTSTLISDNQQLLFARQNFDYGQTIFHSPICSRWYIPQNSLAFGIIPQ

SEQ ID NO: 42415 - DNA, 699 bp, Zea mays
  misc_feature: Ceres CLONE 1440587-F
  misc_feature: Encodes the peptide sequence at SEQ ID NO. 42416
ggagctccccgcggtggcggccgctctataactagtggatcccccgggctgcaggaattcgcacgagaccattacctagaacatcctaatcgaaaactcgcgccgccacttccctcccgacccactagcccaaaaccgtagcgcccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagaggttcaacttccccgagaacggcgtcgagctctacgccgagaaggtcgtcaaccgcggcctctgcgccatcgcgcaggctgagtccctccgctacaagctcctcggaggtcttgccgtccggagggcctgctatggcgttcttcgctttgttatggagagtggtgccaagggttgtgaggtcattgtgagtggaaagctcagggctcaaagagccaagtccatgaagttcaaggatggctacatgatctcatctggtcagccagtgaatgagtacatcgactcagct

SEQ ID NO: 42416 - protein, 171 aa, Zea mays
  misc_feature: Ceres CLONE 1440587-F
  misc_feature (104)..(171): Pfam Name: Ribosomal_S3_C Pfam Description: Ribosomal protein S3, C-terminal domain
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDSA

SEQ ID NO: 42417 - DNA, 854 bp, Zea mays
  misc_feature: Ceres CLONE 1440590-F
  misc_feature (28)..(28): n is a, c, t, g, unknown, or other
  misc_feature (29)..(29): n is a, c, t, g, unknown, or other
  misc_feature (746)..(746): n is a, c, t, g, unknown, or other
  misc_feature (807)..(807): n is a, c, t, g, unknown, or other
  misc_feature (854)..(854): n is a, c, t, g, unknown, or other
gttgtccccccctactcccccttccctnncctccgccccccaccacctccagtacctccgctctctgtggtggcggccgctccttccctagtggatcccccgggctgcaggttttcgcacgagaccattacctagaacatcctaatcgaaaagctaaaccggagtccgtcgcagagacaaacaaaacaaccctcgattccactgtgctacatcgtataatcgccgcgcataaactagtagtgacccgcgcggcgcgatcgcaatcacgcgcaaacccaatcgtggagacacagcacacaagcaaaagcaaccccgcgggtcgcgctatcactactagcccaattaggaggagcctcgaatccagccaggccaggctcctcccattcctcctctcccacgagctctcaccgcgtccttgcgggggctaaaccccccttgaattccctaatcgggtcgccttccaattaccgccagtcctggctggcgaccccagggaaaccatgggaaaggtgactacactgctccaagcgacctcggccccctggcaaacttcccgcgctgcgcgccgtttttaatgcctgaaacccgtgaccccccatgaaaacttcttgctgctctttaaattttggtccctgaagggcggcgtcccagcattggccccagcatcggccgcgttccgaggagatccatcaaatccattcgcatttgccggtcggggttacctaaaacacccctcccgctctaanaggggccggttctctcccctccctctctctgccccaaccccgcctctatttttcctattcnaccacccgcccaaccccgcgatactccccgccttcttatcaagccan

SEQ ID NO: 42418 - DNA, 872 bp, Zea mays
  misc_feature: Ceres CLONE 1440595-F
  misc_feature (844)..(844): n is a, c, t, g, unknown, or other
ttcttccccctcacttcgcgcgatctcttacctcgcagagacgcttcctaatattggagctccccgcggtggcggccgctctacaatagtggatcccccgggctgcatgtattcgcacgagaccattacctagaacatcctaatcgaaaaaagggatagcagggtgcagcggctcggagctggaagaagcggacgggttcgccatggggtccgagggatcctcgggtccagtgtgtccttgagagatgttttaggctgctagaagaactagaacggggtgataagggtactggggatggaaccgggcccccagggatgcgacgacgctgaccacctacttatgggtgttctggcccggaactatccgttggtgcgtccaccactgcgtgccgcgggacgaatcgaccaggctaaggtggtttggggcgtcagatggtcgcaggtggccctttggcgggacggggaggggggcccccccaaccccaaagcgactggcggtgaacccccgaaaagtaggcatctggctgaactcccgggtcggggtttcccaaagggtggcgcgatacttggcttggcgggaccacctacccgagtgggagggaattgttatcgaggcccggcggcttaaacgggaggagggggtccgccgcctagtaaagcctaaaaggctggttccgcccccttctctgggtgggaatggggagtcgtaaaatgagtccacattacccaggcggggtggctcctcctgtaaattgggggccgcgtggggttgtcgatggccgaatgctccgcggcttggcttatcgccgttaccggcaagttttcgcgaaccccccagggcaancccgcttccttctcgccataattggggc

SEQ ID NO: 42419 - DNA, 672 bp, Zea mays
  misc_feature: Ceres CLONE 1440600-F
  misc_feature: Encodes the peptide sequence at SEQ ID NO. 42420
  misc_feature (562)..(562): n is a, c, t, g, unknown, or other
  misc_feature (646)..(646): n is a, c, t, g, unknown, or other
  misc_feature (655)..(655): n is a, c, t, g, unknown, or other
tccccgcggtggcggccgctctagaactagtggatcccccgggctgcaggaattcgcacgagaccattacctagaacatcctaatcgaaaaataactttctgggtctgcgtgtgagcagcgggtttctatatagttgagtcctttccctagtcgtctaatccccatcagtctcccctcccaaaaccggatttgcgaaccacacctagcagccgaggttagcacgcggcgcgtcctgcggccatggaggacgaggagcacgaggtgtacggccaggagattcccgttgacggcgaggacgtcgacatggctgccggcgacgatgccaccaagctgcaggaacttgacgatatgaagcgccggctcaaggaaatggaggaggaggccgccgcgctccgcgagatgcaggccaaggttgccaaggagatgcaaggtgtagatcccaatgcaaccacatctgaaaacaaagaggagatggattctcggtcagtattcattggaaatgttgactatgcgtgcactccagaagaagtgcagcagcacttcaattcttgtgggactgtncacagagttacaatcctgactgacaagtttgggcaacccaaaggttttgcttacgtggaatttgttgaagtttgagcttgtcangaagctatncagttgaacgagtcaga

SEQ ID NO: 42420 - protein, 131 aa, Zea mays
  misc_feature: Ceres CLONE 1440600-F
MEDEEHEVYGQEIPVDGEDVDMAAGDDATKLQELDDMKRRLKEMEEEAAALREMQAKVAKEMQGVDPNATTSENKEEMDSRSVFIGNVDYACTPEEVQQHFNSCGTVHRVTILTDKFGQPKGFAYVEFVEV

SEQ ID NO: 42421 - DNA, 694 bp, Zea mays
  misc_feature: Ceres CLONE 1440603-F
  misc_feature: Encodes the peptide sequence at SEQ ID NO. 42422
ccgcggtggcggccgctctagaactagtggatcccccgggctgcaggaattcgcacgagaccattacctagaacatcctaatcgaaaaaaaccctagtgcttcccaccgatccacttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcccatcatcaggaagcgtatccatgtccgcgtggagcatgtgcagccgtcccgctgcacagaagagttccgcctgaggaaagtgaagaatgaccagctgaaggcggatgcaaaggagcgcggcgaggtcatcagcacccagaggcagccgtttggcccccaagcctggcttcatgggttgaggggactaccatcgagacccgcactccccatccgtacaatgtggtcaatgatctttagggcggatactaagttgttggttggcccttctacctgttctaactcggtgtacacc

SEQ ID NO: 42422 - protein, 180 aa, Zea mays
  misc_feature: Ceres CLONE 1440603-F
  misc_feature (2)..(100): Pfam Name: Ribosomal_L21e Pfam Description: Ribosomal protein L21e
MPAGHGLRSRTRDLFARPFRKKGYIPLTTYLRTYKIGDYVDVKVNGAVHKGMPHKFYHGRTGRVWNVTKRAIGVEINKQVNGPIIRKRIHVRVEHVQPSRCTEEFRLRKVKNDQLKADAKERGEVISTQRQPFGPQAWLHGLRGLPSRPALPIRTMWSMIFRADTKLLVGPSTCSNSVYT

SEQ ID NO: 42423 - DNA, 640 bp, Zea mays
  misc_feature: Ceres CLONE 1440610-F
  misc_feature (498)..(498): n is a, c, t, g, unknown, or other
  misc_feature (514)..(514): n is a, c, t, g, unknown, or other
  misc_feature (515)..(515): n is a, c, t, g, unknown, or other
  misc_feature (535)..(535): n is a, c, t, g, unknown, or other
  misc_feature (576)..(576): n is a, c, t, g, unknown, or other
  misc_feature (615)..(615): n is a, c, t, g, unknown, or other
  misc_feature (619)..(619): n is a, c, t, g, unknown, or other
ccccgcggtggcggccgctctagaactagtggatcccccgggctgcaggaattcgcacgagaccattacctagaacatcctaatcgaaaaatccgcctcgtctaaccaccaccacgagggagagttaaagtcgccagtacagaagagtgaaggggagagggttgctgggtccgattcggtgggctcatcgccgtcgggtccacgaattggtgcctaggagtctcgcgtgcttcggggacataatcgatggtctcgctgcggtgggttggtggctggagacctcagaattcgtcgtcatagtgcgagctcctccgcgtgtgcaccgtgcgccgtggccaggggtgtctgcgctgcaattgccaggcatacaagatgacgatggtatgaagactatctcatttccaaaaagctttgtgcagagcaactagtgcaatgcaagtgtttggtgcttttggttgatagaagctgctggatgcttttggtatttttgaaagatgncagtcgtgcttctggnntgatactagaggttggtggntcaaaactgaaaaacctgtcaggctgtcacttgcttttggnaatggtatgcctaaatatgaaggtatgcccttatgcagntcancatgtttgctgcctgcctgct

SEQ ID NO: 42424 - DNA, 740 bp, Zea mays
  misc_feature: Ceres CLONE 1440616-F
  misc_feature: Encodes the peptide sequence at SEQ ID NO. 42425
  misc_feature (427)..(427): n is a, c, t, g, unknown, or other
  misc_feature (512)..(512): n is a, c, t, g, unknown, or other
  misc_feature (513)..(513): n is a, c, t, g, unknown, or other
ggagctccccgcggtggcggccgctctagaactagtggatcccccgggctgcaggaattcgcacgagaccattacctagaacatcctaatcgaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaaagtcaaggagctcgcancagcctatgaggttttgagtgatccagaagaacgtgagatttatgatcagtatggtgaagatgccctttaagaaaggaatgggcnngtgaggatcccatggtgatccatttgacaccttctcatcatttttttggacccttctttggaaggagggggttgaagccatccggggaagaaggccaaaggagggaaaagaagttatttccccccactaaaggttccccgggaaaaactttaacagggccactccaaaaaagcttctctttttcggcgcaagggcctttgggtctaaggggaaggggcaaggggctc

SEQ ID NO: 42425 - protein, 78 aa, Zea mays
  misc_feature: Ceres CLONE 1440616-F
  misc_feature (13)..(71): Pfam Name: DnaJ Pfam Description: DnaJ domain
  misc_feature (56)..(56): Xaa is any aa, unknown, or other
MFGRAPKKSDNTKYYEILGVPKSASQDDLKKAYRKAAIKNHPDKGGDPEKVKELAXAYEVLSDPEEREIYDQYGEDAL

SEQ ID NO: 42426 - DNA, 620 bp, Zea mays
  misc_feature: Ceres CLONE 1440617-F
  misc_feature: Encodes the peptide sequence at SEQ ID NO. 42427
  misc_feature (420)..(420): n is a, c, t, g, unknown, or other
  misc_feature (423)..(423): n is a, c, t, g, unknown, or other
ggagctccccgcggtggcggccgctctagaactagtggatcccccgggctgcaggaattcgcacgagaccattacctagaacatcctaatcgaaaaaccgattgggtccaacaccagccgccgccatgtcgaagcgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgtccgccagcgcaagccgtggcgcccgcaggacggggtctacatgtacttcnaangataatgcttgaatggattgtgaatccccaagggtgaaaaagaaaaaggttcccccttattccccgggggcccttattttcccaaagggaagggggggttaattttttgtgggccccaaaagagtgtgtttggccccgagaaaaaaaaccccccctttttttttttttataaaaaaacctttttttggggaaaaaaa

SEQ ID NO: 42427 - protein, 98 aa, Zea mays
  misc_feature: Ceres CLONE 1440617-F
  misc_feature (19)..(101): Pfam Name: Ribosomal_L14 Pfam Description: Ribosomal protein L14p/L23e
MSKRGRGGSAGNKFRMSLGLPVAATVNCADNTGAKNLYIISVKGIKGRLNRLPSACVGDMVMATVKKGKPDLRKKVMPAVIVRQRKPWRPQDGVYMYF

SEQ ID NO: 42428 - DNA, 718 bp, Zea mays
  misc_feature: Ceres CLONE 1440620-F
  misc_feature (289)..(289): n is a, c, t, g, unknown, or other
tggagctccccgcggtggcggccgctctagaactagtggatcccccgggctgcaggaattcgcacgagaccattacctagaacatcctaatcgaaaagagttcctgacgacctcgttcccctccgctgtctcgcctctcccttggttcctcgcggcgacgactgggcgagcgcctcctcccctccctcactccctccgtgagctcctcgccggcggcgcgcgccgccgcccgtcgccacgtcttctccgctgacgtgggctcaccaggttcaagggcatatctgtgttnatcttggggaccttcagtagattgctgagagttctccttgatacaggggaataagatcccaaatagtttttgacattgatctgtagccagtactggcatggctaacaagccttggggttctccgatcccccggggaggttgacctggagggggtaccaaaatacttggcccaatttggacccccttaacaatttggtccccttgaaaggagggttttttgggggaaaccccgggggtgggctttgaaaatttccccccccccgaaaaagaaaaaatttttctttttttgcgaattttttttggggcccccttttttaagagggggggtctcctccccaggagaaaaaattattcccccggtaaaaaaaccccccggggttttttttccctttccccccccccgggggggaaattatttttttttaaatt

SEQ ID NO: 42429 - DNA, 694 bp, Zea mays
  misc_feature: Ceres CLONE 1440623-F
  misc_feature: Encodes the peptide sequence at SEQ ID NO. 42430
tccccgcggtggcggccgctctatactagtggatcccccgggctgcaggaattcgcacgagaccattacctagaacatcctaatcgaaaaagaaaattgcccaccaaaatctcctccccctgaagtcccgaagctcgcggaagcgccgagatgtaccatcccacgagaggcggcgtccgcggcggcagacatcaattcgaatgggacgatgagaaggttgacgagcagtctgcagaattaccttggtcatatcgtaaaggctcccgttggtatatgggataaaggaaaggatctttactggtatactcgggataagaaatccgactctgaagatgctcttactgaagaaatcacgcacactgaaggaacagaaggaacacgctatgcgtgacgctcgttggcttatctcctaaccacagcaatcaaactcagggtaatcgcttgtataagcctgactatgctgagctgattcctagatgatcaactgcatatgacttggaatcaggacacgcttaagcatcacaagtgcacggtctaggattgtacgacgcccctcgcgatgagggtggatcaagttctttgagccttgacccacagatggagcctgagcatgctgaagcactactatcactcaagcaggaggatgatttgactgataatatgcaggggtaaaacgcacctggacgtgacaaga

SEQ ID NO: 42430 - protein, 60 aa, Zea mays
  misc_feature: Ceres CLONE 1440623-F
MRRLTSSLQNYLGHIVKAPVGIWDKGKDLYWYTRDKKSDSEDALTEEITHTEGTEGTRYA

SEQ ID NO: 42431 - DNA, 725 bp, Zea mays
  misc_feature: Ceres CLONE 1440624-F
  misc_feature: Encodes the peptide sequence at SEQ ID NO. 42432
agctccccgcggtggcggccgctctataactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggccctcctcggcgcccgcgccttcggctacctcttctgctagatccgcgctggatacctggtttcctgctccaaaatatgattcctccggtcttggccccccggaacccacctccgggggcggggcgttccttggggaagggggccccggccggggtttatttaagaacccccccccccccccccaaaaaaaaaaggggccccccgggggggggaaactcttttcccaccccccttgttgtgccggggaaaaaaaaaacccccgcggcggtttttgggagtacaaggaggggtattttttttttctaaaaaaaaaaaaaaaaaaatttttttcccccccccccccccggggggggggcgcggacaaattttccccttaagag

SEQ ID NO: 42432 - protein, 57 aa, Zea mays
  misc_feature: Ceres CLONE 1440624-F
MAGLRMKFVAVAAMAAALVASAAAAEAPAPAPASDAAAAVPLAAALLGARAFGYLFC

SEQ ID NO: 42433 - DNA, 717 bp, Zea mays
  misc_feature: Ceres CLONE 1440635-F
  misc_feature: Translation starting site: 218
  misc_feature: SWISSPROT Homolog: EC 2.7.1.4 Fructokinase
  misc_feature (350)..(350): n is a, c, t, g, unknown, or other
  misc_feature (383)..(383): n is a, c, t, g, unknown, or other
ggagctccccgcggtggcggccgctctagaactagtggatcccccgggctgcaggaattcgcacgagaccattacctagaacatcctaatcgaaaaaccaccgcagccgcagcacaatcgcctcgccttcccttccccaccagcccgtctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcntcaaggcacccggcggcgcgccccgcaacgtcncctgccccatccccaagctcggcgggatcctccgctttcgtagggcagttcggcgaacgacgagttcggccacttgcttgtgaaactcctgaaccaaacaacttggaacccggaggggtcccttttcaaaaaaccaccgcgaaaggggctgggctttcgagaacctaaagccaaagggggagggcgaatttttgtttttaaagaaaacccaagccgaaattttttttaaaaaaagggggaattttcccctggctttgggggcgccccccaggggtttttcaaaaagggcttcttttcttttttttaagaaaaggggccttttgggaaaatatgc

SEQ ID NO: 42434 - DNA, 730 bp, Zea mays
  misc_feature: Ceres CLONE 1440654-F
  misc_feature: Encodes the peptide sequence at SEQ ID NO. 42435
  misc_feature (409)..(409): n is a, c, t, g, unknown, or other
tccccgcggtggcggccgctctataactagtggatcccccgggctgcaggaattcgcacgagaccattacctagaacatcctaatcgaaaatacggagccaatccctcctgctggttcgatccaaaccctaccaaatcgatggccgacggcggcaactgcgggccgggcggcggcaatgcatcggcgccagtgtgcagtttcgtgaggaaaccacccaagaacatccggaagcgccccaccgcgcccgcggggtctgatgaccacgacgacagcggcggcggcgccctcgccgccgcgcgctccaagaaggggccaccgtcctcaaccgcatggcagctcgttattctcaccgcaggtgcttcctccgaggcgccgcggttccagtacaaatcgtccaggacgatccantccacggacacccccggcatctgccacgtcttcgaaagctgaaaacgaattttgacccctacgcgcgctcccatctcccagagacaccttcaggcaggcggaggatttccctcaaaaaaaaacccccccccctgttgctggtttccccctccccctcccccctttggaagggggaaaaggggaaccacgggttacccgaaataaaaggggtggtttcccagggggacctcccgtttctttggggagaaaagccgcgggttttaaaaagggacacctccggggtccccccacaaatttccctttcccccccggttgttcaac

SEQ ID NO: 42435 - protein, 103 aa, Zea mays
  misc_feature: Ceres CLONE 1440654-F
  misc_feature (90)..(90): Xaa is any aa, unknown, or other
MADGGNCGPGGGNASAPVCSFVRKPPKNIRKRPTAPAGSDDHDDSGGGALAAARSKKGPPSSTAWQLVILTAGASSEAPRFQYKSSRTIXSTDTPGICHVFES

SEQ ID NO: 42436 - DNA, 729 bp, Zea mays
  misc_feature: Ceres CLONE 1440669-F
  misc_feature: Encodes the peptide sequence at SEQ ID NO. 42437
  misc_feature (307)..(307): n is a, c, t, g, unknown, or other
  misc_feature (317)..(317): n is a, c, t, g, unknown, or other
  misc_feature (322)..(322): n is a, c, t, g, unknown, or other
  misc_feature (399)..(399): n is a, c, t, g, unknown, or other
  misc_feature (486)..(486): n is a, c, t, g, unknown, or other
tggagctccccgcggtggcggccgctctagaactagtggatcccccgggctgcaggaattcgcacgagaccattacctagaacatcataatcgaaaaagtgacgaactcgaagcttgcgttcttgtagtagagtcggcagcaagagcggtagagcgagcggtcgagaagatgaagagcagcactctgttggcgatcctagttctccaggcccttctggtctctgcggccgtggccaaaggacctgcagggccgaagaacagtgctggtgcggcgagtgcaccagctggtcgggcgtgtggagctgcnacgacttccntcacnagtgcgccgccacctgcaagaactgcttccccgtgttcccggacagggcgccatcgagtacgggggcttgacttccntcccggaaactggcggctgcaaaatccccttgagatccttccattcaaccttggccggcgcccaagggggcaaaccaaaggattttnatgggcccccgggggggcccccttttaaaggggggggcccccccaaaaacccccccttgggtgtgtttttaaaggtaagagggggcccccccccccccgagggggaaaaaaaaaactccccgcgcccaaaaaaaaaaaaaaattttttttccccccccccccgggggggggcccccccccctctccccccagggggggtattaaccccccccccgcgcgctgttttataacgggggggggggg

SEQ ID NO: 42437 - protein, 114 aa, Zea mays
  misc_feature: Ceres CLONE 1440669-F
  misc_feature (50)..(50): Xaa is any aa, unknown, or other
  misc_feature (77)..(77): Xaa is any aa, unknown, or other
  misc_feature (106)..(106): Xaa is any aa, unknown, or other
MKSSTLLAILVLQALLVSAAVAKGPAGPKNSAGAASAPAGRACGAATTSXTSAPPPARTASPCSRTGRHRVRGLDFXPGNWRLQNPLEILPFNLGRRPRGQTKGFXWAPGGAPF

SEQ ID NO: 42438 - DNA, 744 bp, Zea mays
  misc_feature: Ceres CLONE 1440671-F
  misc_feature: Encodes the peptide sequence at SEQ ID NO. 42439
  misc_feature (330)..(330): n is a, c, t, g, unknown, or other
  misc_feature (331)..(331): n is a, c, t, g, unknown, or other
  misc_feature (366)..(366): n is a, c, t, g, unknown, or other
  misc_feature (370)..(370): n is a, c, t, g, unknown, or other
ctggagctccccgcggtggcggccgctctagaactagtggatcccccgggctgcaggaattcgcacgagaccattacctagaacatcctaatcgagaaatcacccatattattgataccaactagcaacatacatagtgaagtacactagcaacatcttagcaccaatgggagccaagatttttgccctccttgccctccttgctctttcagcaagcgctgctacctcgacttttattccacaatgctcacaacaatacctctctccggtgacagccgcgggatttcaatacccaactatacaatcctacatggtacaagaagccatccnnagcagcatcttacggtcattagcattacccctccnacancatatgctctattgcacagccatccttagtgcatctgtatctccaaaggatcccggcacacaactacaacacggttgctaccaaaaatcaatcaggtagttgcaggaaaccttggtgttaccttcagaaaaaaagttttttccaataaaaacaaaaaggggggggaaccctgttattccttttgggggcaaaaagcttttcccttttaaccccatttgtgggggaccttttttcctttttttttgaaaaaaaaattttttgtcttttctttttggagcgtgggggaaaaattttttttttttttttgaaaaaacaatttttgtggtttttttccccccccgtttggggagaaaaaatttgtctctcttttccaa

SEQ ID NO: 42439 - protein, 100 aa, Zea mays
  misc_feature: Ceres CLONE 1440671-F
  misc_feature (55)..(55): Xaa is any aa, unknown, or other
  misc_feature (67)..(67): Xaa is any aa, unknown, or other
  misc_feature (68)..(68): Xaa is any aa, unknown, or other
MGAKIFALLALLALSASAATSTFIPQCSQQYLSPVTAAGFQYPTIQSYMVQEAIXSSILRSLALPLXXHMLYCTAILSASVSPKDPGTQLQHGCYQKSIR

SEQ ID NO: 42440 - DNA, 706 bp, Zea mays
  misc_feature: Ceres CLONE 1440679-F
  misc_feature: Encodes the peptide sequence at SEQ ID NO. 42441
ggagctccccgcggtggcggccgctctagaactagtggatcccccgggctgcaggaattcgcacgagaccattacctagaacatcctaatcgaaaatcagtggactatattcgattcttttctcctcacaaccaatatttcacttacaacttgcagctttctctctacttctctctgagcccttctgtcaactttcactggttaaaaattattcaatgggagaaagttgctcatctgctcagcaatctggcacaagccaaagtgctgagttgatgccagattcagacaagacagtgcatctaagagaggaactttcagacttaatcgagttcccaacatctgaacttctcaaaactgatctgacagctcgagatagggttgatgtattcattgcctggtcattgttgctgtcccacctgcaaacactaccagcatcttccagtatcaagggagatgtgcttcaatacatacaagaaaaggtcagtccgtgcatattggattgcattttccagcatatcccagtaaaggccgctgcaccgaatgggaagaaaaaggataccgagctagcgcctgaagcagaagctgctgccaaagcttcgaagaatgccatagctacttgttctttgcttccgtacttggagtctctttggcccatcgggactttgcagatggcctcacttgcaggctcactgtacgggatgatgat

SEQ ID NO: 42441 - protein, 163 aa, Zea mays
  misc_feature: Ceres CLONE 1440679-F
MGESCSSAQQSGTSQSAELMPDSDKTVHLREELSDLIEFPTSELLKTDLTARDRVDVFIAWSLLLSHLQTLPASSSIKGDVLQYIQEKVSPCILDCIFQHIPVKAAAPNGKKKDTELAPEAEAAAKASKNAIATCSLLPYLESLWPIGTLQMASLAGSLYGMM

SEQ ID NO: 42442 - DNA, 861 bp, Zea mays
  misc_feature: Ceres CLONE 1440685-R
tgggtaccgggccccccctcgaggtcgacggtatcgataagcttttttttttttttttttgatcgaactgaaatgttgtattccctccattattttttatttatcgtgttttagttaaaaaattaactagcgaatgacaaatattcaaaaagaacggaggtagtatcgtacatacgaccatggatttcacgagttttatttttaaaaaaataagaatccactgcaacaaagtatattcccgcaaaacgtctaggagaaactccctgtaactattctatgcaaagttgtcagcatcacttcagaaaactgcacataatatttcagagaaattcctgctgcagatcctcagcaatcccacgaaggcacatgcaatttccacttcgctaggcctccgtataaattcacttgtgcaagtttttgcaactgcatgattgtaacagttgggtggtcaagggttttcaccacatcctcatggcatttggagggccaaaatccgtataagcatggtccggacaattgaaccacaaaacccctaaaagtcgcgatttgaaaaccctcaaaccttgggagcccgggggatgccaccctgaacaagctccccccaaggttaaatttttccccagggggcttgaaaaaacccccccctaaattcttttggaccatggcattccaggtttgggccataaacaattattttccccacccagggggaggtcggcccccaaaaaattttccccccccccctgttaaaataggggaaaaccccttccccccctaaggggaaaacccccctcacagggcccaaaatgctttttgaaaacaaatttccccccctttaaagaacactccgggggaggtttt

SEQ ID NO: 42443 - DNA, 773 bp, Zea mays
  misc_feature: Ceres CLONE 1440702-F
  misc_feature: Encodes the peptide sequence at SEQ ID NO. 42444
  misc_feature (359)..(359): n is a, c, t, g, unknown, or other
ggagctccccgcggtggcggccgctctagaactagtggatcccccgggctgcaggaattcgcacgagaccattacctagaacatcctaatcgaaaaaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctcccagtacatcgagggcaagtacgacggcgacctgccgcccgcgcacgcgtcgctgctggccgcgcacctggcgcgcatgaaggagtcgggtgagttggtcttcgtcangaacaactactttcgcggcgacgcgcccgaacccgcgccgaaacgcgggccgcgggcggcccccaaagggccgggacccccgcgcgcccgggttcccccccattggggggggggcgggggggcccccccaaccacaggacccttggaacccccctgaaaaaaggccacccggggattcccaggggcccgcggcccccccccccaaaaaagaaaaaaacaagggggggggtcctccgcccccccccgggagagtttcccccccccagaagggggggcggggcgccccccccgagagacccccccgttttcccaaaaaaaaaagccccttttaaaaaaacctcttgtgggggtggttaaaaaagaaatccccccccccccccccccccccggtgggtgtttgtttgttgttttttt

SEQ ID NO: 42444 - protein, 125 aa, Zea mays
  misc_feature: Ceres CLONE 1440702-F
  misc_feature (13)..(81): Pfam Name: Linker_histone Pfam Description: linker histone H1 and H5 family
  misc_feature (74)..(74): Xaa is any aa, unknown, or other
MATEEVAKPSPIPPYPEMILAAIEDLGDKSGSNKSAISQYIEGKYDGDLPPAHASLLAAHLARMKESGELVFVXNNYFRGDAPEPAPKRGPRAAPKGPGPPRARVPPHWGGGGGAPPTTGPLEPP

SEQ ID NO: 42445 - DNA, 697 bp, Zea mays
  misc_feature: Ceres CLONE 1440711-F
  misc_feature: Encodes the peptide sequence at SEQ ID NO. 42446
tccccgcggtggcggccgctctagaactagtggatcccccgggctgcaggaattcgcacgagaccattacctagaacatcctaatcgaaaaaatttctcaggtggcgcactccagtaccagactcctgggagcctaccgcaccgcacctaccattctgggaataggagaggatctcagtcaagatggacgcccggaacatggtctgcgtcgggttcgtcgaagcacatcctgctggctagctgtccggaggaggtgacgcacgagcccctggactatctcatccgctgataccccgcgctcgtcgggatggcccccttccatgaaggtcttcccctgcgaaactgatgtcagtatacaacacatgtctccggggtgcacgacacgtcttcgactccctgtttgaaagcacgcatcgaatcgatgagtacattgagcatcctgcacacctctaattcccaagtgtgttcttgcctgtgctgcagaaagtcctcataatcgactacaaaccgacgtcagccaattagtggtagaacatgatctgtacttgttcctcggaggatccagtttggttctactctttattttgctaaatacacacggtctgctttgtctcttgttaacaaagaactttgagtttactgtagggcagttgttgccgcttcgcatgttttcatatggtaattacgttcctagcca

SEQ ID NO: 42446 - protein, 35 aa, Zea mays
  misc_feature: Ceres CLONE 1440711-F
MSVYNTCLRGARHVFDSLFESTHRIDEYIEHPAHL

SEQ ID NO: 42447 - DNA, 711 bp, Zea mays
  misc_feature: Ceres CLONE 1440712-F
  misc_feature: Encodes the peptide sequence at SEQ ID NO. 42448
aagctggagctccccgcggtggcggccgctctagaactagtggatcccccgggctgcaggaattcgcacgagaccattacctagaacatcctaatcgaaaaatcgacctcctcgatccagacagcaggcagcagccatgtccaaggtcttcaccctcgacgcggtcgccaagcacaactccaaggaggattgctggctcatcatcggcggcaaggtgtatgatgtgacgaagtttttggtagaccacccaggaggtgatgatgttctgttgtcctcaactggcaaggatgcgactgatgatttcgaggatgtcggtcacagcaacactgcccgcgcgatgatggatgagtacttggtgggtgaaatcgacgcgtcgacgatcccttccaggacgaagtatgtccccccgaaacaaccgcactacaaccaggacaagactcccgagtttgtacgagtcgaacttgtcgaataagctagcaagagttttgtgaggttttattacatgtgtaacttgtcacgaaattcatcgaatgttctgagctgctgtgggttctgtggtttaaagtgtgatcggaatgcatcttactggactaaaaaaaaaaaaaaaaaagcttatcgataccgtcgacctcgagggggggcccggtacccaattcgccctatagtgagtcgtattacgcgcgctcactgggcgtcgttttacaacgtcgt

SEQ ID NO: 42448 - protein, 111 aa, Zea mays
  misc_feature: Ceres CLONE 1440712-F
  misc_feature (4)..(78): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSKVFTLDAVAKHNSKEDCWLIIGGKVYDVTKFLVDHPGGDDVLLSSTGKDATDDFEDVGHSNTARAMMDEYLVGEIDASTIPSRTKYVPPKQPHYNQDKTPEFVRVELVE

SEQ ID NO: 42449 - DNA, 850 bp, Zea mays
  misc_feature: Ceres CLONE 1440713-F
  misc_feature: Encodes the peptide sequence at SEQ ID NO. 42450
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tggggtgcccctcccccgttcccccccctgctggcccccncggggnnnnnnnnnaaaactggagctccccgcggtggcggccgctctagaactagtggatcccccgggctgcaggaattctcacgagaccattacctagaacatcctaatcgaaaaaaggaaatccccgtcgttctcgcgtctggagctcggcggcggagcagggcggcagggggagggcgatggaattctgcccggtgtgtgggattctgctgcagatcgatccgggcaccggaagccaccgcctgcgcctcttctgccccggctgcccctacgtctgccccatcctgaacaagatcgtgacgaaggtgaggttggtcaaaaaggaggtggagcccatctcctgcacggcggatgagatgaaattcggcccctaacaccgtagttacatgccaaagaggcgggccgtgggagaagcatacttcccagccagattgcggaattcccatcaccctgacagaacccgatgaacgacaattataagaggtgggttgcaaaagaacgaatgcccggcttcgcctgggagaggagggaccgggaccgattggccattccggcagtgtttgctttaaccggtcccccgcccttgttcgccttctttcacttttttgacgtggctggggcatggttgccggattgacgccgtggtagatggctttttaagggccagcgggtagacttccctgccacccaccttctgttgggacaagggtgcggttcctaaaaccattggggcgttgggctctcatcgggggggccgaaaaagcagaacgtaagttaaccttgtttcggacgtccgttcgagtcgtcg

SEQ ID NO: 42450 - protein, 64 aa, Zea mays
  misc_feature: Ceres CLONE 1440713-F
MEFCPVCGILLQIDPGTGSHRLRLFCPGCPYVCPILNKIVTKVRLVKKEVEPISCTADEMKFGP

SEQ ID NO: 42451 - DNA, 681 bp, Zea mays
  misc_feature: Ceres CLONE 1440719-F
  misc_feature: Encodes the peptide sequence at SEQ ID NO. 42452
  misc_feature (590)..(590): n is a, c, t, g, unknown, or other
gtggcggccgctctagattcagtgcatcccccgggctgcaggaattcgtccgagaccattacctagaacatcctaatcgaaaaatcatccaaagctctctctggtcgcacgtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggccgctcgaggggggcggggaggagttcccaatcctctcttacgccgatttctaccagctcgcgggagttgtggccgtggaggtcaccggtgggcctgagattcccttccacccgggtaggagagaaaacgctcagctcccacttgagggccgcattactggggacgttaagggtactaaccaccagacggcacttcctatgtagccccttggatccgggtttctcgccgcgtgnataacgtatcggggggggccttttagtgcagcgcgcccggagggccggaagaggcccgggacggatttgattatagtaatttccctcgcta

SEQ ID NO: 42452 - protein, 146 aa, Zea mays
  misc_feature: Ceres CLONE 1440719-F
  misc_feature (19)..(147): Pfam Name: peroxidase Pfam Description: Peroxidase
  misc_feature: SWISSPROT Homolog: EC 1.11.1.11 L-ascorbate peroxidase
MAKNYPTVSAEYSEAVDKARRKLRALIAEKSCAPLMLRLAWHSAGTFDVSSRTGGPFGTMKHQSELAHGANAGLDIAVRPLEGGGEEFPILSYADFYQLAGVVAVEVTGGPEIPFHPGRRENAQLPLEGRITGDVKGTNHQTALPM

SEQ ID NO: 42453 - DNA, 643 bp, Zea mays
  misc_feature: Ceres CLONE 1440720-F
  misc_feature: Encodes the peptide sequence at SEQ ID NO. 42454
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaatttgaacctccaggttcagaaactgaccccctcgtccctccccaccatcgcgatggctgacgacgccgcggcggcggcgttcgcgccctctccctcgccaccgtcacccgtagcgcaacctctgcccgacctctccccgccgccgcccttctccccaccagccggcacccctgcttccggggcgcagacgccgagcctcccggacaccccggcctccctagatccggacacccccttctccgacgccaccccgacccccgccgacgcctccgacgccgccctcgcttctgacgacggcatcaccaacccgtcggggggcaccgccggcaagcacatgacgctcgcgccgcccgccccgcccgccaagaaacccgtccaagaagaagggcggcaacagcgtctggacccgcccggcctcccgcagggcaagaaaaatgcgaggcagccgggcggcctctgacactgctccgggcggcccgtcgggggcgccagaagctccgacccgtagccccacgtcgggcggcgagtaggagttcctcn

SEQ ID NO: 42454 - protein, 31 aa, Zea mays
  misc_feature: Ceres CLONE 1440720-F
MRGSRAASDTAPGGPSGAPEAPTRSPTSGGE

SEQ ID NO: 42455 - DNA, 638 bp, Zea mays
  misc_feature: Ceres CLONE 1440721-F
  misc_feature: Encodes the peptide sequence at SEQ ID NO. 42456
aaagctggagctccccgcggtggcggccgctctagaactagtggatcccccgggctgcaggaattcgcacgagaccattacctagaacatcctaatcgaaaaatatgagtcgttgcctcgcagtttatatccctactgtttcggactttcgggttttggccgacacccgacaatcttaacatcaaactcgtcgtccacgcctcctcggcaaggttgcgtacggcgtggccctaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctaccaccaccgccccggccgccctgcaacccacgagggggacccgactgcgccgcccgcaggggctgatagcagcgggggcaccaacgaggatgccgcgcggctgctggaggagaacgccatgctccgcgcccgactcgcagatgacctcgcgctcctgcgtgagctccacggcgcgccctgcgtctccaaggagtgccctcctgatctatacaaccgattgatggcggcggtcaacaatgttagcttccttgctcatctcgaga

SEQ ID NO: 42456 - protein, 116 aa, Zea mays
  misc_feature: Ceres CLONE 1440721-F
MTLGSAAHKIPLEVAHTLVEIAEVARYAYHHRPGRPATHEGDPTAPPAGADSSGGTNEDAARLLEENAMLRARLADDLALLRELHGAPCVSKECPPDLYNRLMAAVNNVSFLAHLE

SEQ ID NO: 42457 - DNA, 617 bp, Zea mays
  misc_feature: Ceres CLONE 1440722-F
  misc_feature: Encodes the peptide sequence at SEQ ID NO. 42458
ggagctccccgcggtggcggccgctctagaactagtggatcccccgggctgcaggaattcgcacgagaccattacctagaacatcctaatcgaaaaatccacacctgagtcccctccgccgcctgccgcactctcccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcagaaagtttcactctagtccccgtgcagagggcacatgaggccaagcagaagggaggcactctggatatgcaagcgcaggggtaccagggaggctaggcttcccaccagattctgtggataagaagatgcctgttctgaggccctgctctgcaatacccgggaggcccaaaagaacccccagcccttgttccttgcctgtaccttgaggggcaagggaaattttttaaaaacaaaagggggcttttggggggttccccag

SEQ ID NO: 42458 - protein, 59 aa, Zea mays
  misc_feature: Ceres CLONE 1440722-F
  misc_feature (2)..(60): Pfam Name: Ribosomal_L19e Pfam Description: Ribosomal protein L19e
MVSLKLQKRLAASVLKCGKGKVWLDPNEVSEISMANSRQNIRKLVKDGFIIRKPQKVSL

SEQ ID NO: 42459 - DNA, 666 bp, Zea mays
  misc_feature: Ceres CLONE 1440729-F
aagctggagctccccgcggtggcggccgctctagaactagtggatcccccgggctgcaggaattcgcacgagaccattacctagaacatcctaatcgaaaagaatttttcgttctatcgaatcctgaaaaaaaaatgacgaggcagttctgaaacagagaagcattgattctgtccgtttgcagatcctccagatcttccacaggaaagtgtaccccgagagcgcggccctggcgcggaacctgaccaagaagagccgcaagcgcggcagcggtgcctaccacaagccggagccggcggcgtccaggctccggtgcctcaaggagcagcgcgcgccggggttcggctgctgcgccagccgggcctcgttcggcggcgccgcctctcccatcgacgacgacgaggaggagctcaacggcagcaagagcggccactggatcaagaccgacgctgaatacttggtgctggagctgtagaatgagaaataacaagagagagagagagagagagatcaggatctgttggctggtcagcatcaagcatatatagtgagtatattgagcataatgcctgcttatgtttctgtgcttgctcttcacagaaaaaaaacccccatcatacatatgtttgttcatgtgattacctgacggatgagttgtacgtgtcc

SEQ ID NO: 42460 - DNA, 665 bp, Zea mays
  misc_feature: Ceres CLONE 1440730-F
  misc_feature: Encodes the peptide sequence at SEQ ID NO. 42461
aaagctggagctccccgcggtggcggccgctctagaactagtggatcccccgggctgcaggaattcgcacgagaccattacctagaacatcctaatcgaaaaaatacgaggcctggcctaccacctgcgacaaaccagtcaccgcctaccaccgttttataatccacccctcccactccccctgttttttcttcttccgctgttctactccggcgtgttggtcgacggcggcgcagatgacgaccctcgatctgatgggagggtacgggcgggtggacgagcaggtggccatccaggaggccgccacggcggggctgcgcgggatggagcgtctcatcttgcagctctcccaggctggcaccggggagcggtcgttgtccccaccggcggtacaggcgcagcgccagcagcagaagcagctggagcagatccagcagcaggttgactgccgggagctcacggacatgacggtgtccaagttcaagaaggtgatctccatcctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcagg

SEQ ID NO: 42461 - protein, 143 aa, Zea mays
  misc_feature: Ceres CLONE 1440730-F
MTTLDLMGGYGRVDEQVAIQEAATAGLRGMERLILQLSQAGTGERSLSPPAVQAQRQQQKQLEQIQQQVDCRELTDMTVSKFKKVISILNRTGHARFRRGPVAARSQSQSQGPASPEPAQSAPAPAARPLTLDFTKSVSGYSR

SEQ ID NO: 42462 - DNA, 669 bp, Zea mays
  misc_feature: Ceres CLONE 1440738-F
  misc_feature: Translation starting site: 244
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctggagctccccgcggtggcggccgctctagaactagtggatcccccgggctgcaggaattcgcacgagaccattacctagaacatcctaatccaaaacacaaacaagaagcttgcattgttcgttgctcgatcgttgcaggtaatggagaaccctgctccgagtatcgtagtgccccccatcgccgcacctgtatcagcgaacttcagcagactcgccttcccgcacctgtacatccgacggacgggtccaaacagcagggagatgttgactgtggaaggaaaaaaaagctctagtgatccaacggcaacatggaggacgggattgacttccccctctaccaagggcctggggtcccaaacccctccctgggggctcccggggaagggggtcccaacacccttttgggaaacccaaaccgtttttttccccgcccccccttttaaggtgggggaacagggtaaaaggggtcccccccccccttacacccaaagagggggggcaccaatgggtcccccaaaaaaaggggggacttcctccgggggagaccgggaaaattttttccttatg

SEQ ID NO: 42463 - DNA, 656 bp, Zea mays
  misc_feature: Ceres CLONE 1440743-F
  misc_feature: Encodes the peptide sequence at SEQ ID NO. 42464
atagctggagctccccgcggtggcggccgctctataactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcagacggagaggtgcaggtgcttgcctggcgccagcatctccaccgcttgccgaagcgtcaagatctccgtcgccagcgcccgcgccgtcggcatcctcagctcgtcggcctccaccagcagccgcgacagcgcggccttgtagctgtccagcgccgcgttcacctcggcgtccgcggctcctagcccggcccgccctgaccgcccgccgg

SEQ ID NO: 42464 - protein, 108 aa, Zea mays
  misc_feature: Ceres CLONE 1440743-F
MLLTSCRQGRGMASLSCARADGVVRSGALPAKLLLCASCCFPTAAPVADGEVQVLAWRQHLHRLPKRQDLRRQRPRRRHPQLVGLHQQPRQRGLVAVQRRVHLGVRGS

SEQ ID NO: 42465 - DNA, 645 bp, Zea mays
  misc_feature: Ceres CLONE 1440746-F
  misc_feature: Translation starting site: 316
aaactggagctccccgcggtggcggccgctctagaactagtggatcccccgggctgcaggaattcgcacgagaccatacctagaacatcctaatcgaaaaacgccttcgctcgcgccgccgccgccgacgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacttaccctgctgggttcatggatgtcatttccatccccaagaccaatgagaactacaggctgctgtacgataccaagggccgcttccgc

SEQ ID NO: 42466 - DNA, 646 bp, Zea mays
  misc_feature: Ceres CLONE 1440752-F
  misc_feature: Encodes the peptide sequence at SEQ ID NO. 42467
tggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggcccccgtggaggcgaagcaggcgctctactcgagggacctcgctcgcaacctgcgcttcgcctccaacttcgacctcttcaaggctgctgcggccgactggcgcgacacgctcttctgcgaggtggctccgaa

SEQ ID NO: 42467 - protein, 168 aa, Zea mays
  misc_feature: Ceres CLONE 1440752-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPRGGEAGALLEGPRSQPALRLQLRPLQGCCGRLARHALLRGGSE

SEQ ID NO: 42468 - DNA, 642 bp, Zea mays
  misc_feature: Ceres CLONE 1440769-F
  misc_feature: Encodes the peptide sequence at SEQ ID NO. 42469
  misc_feature (486)..(486): n is a, c, t, g, unknown, or other
tccccgcggtggcggccgctctagaactagtggatcccccgggctgcaggaattcgcacgagaccattacctagaacatcttaatcgaaaaatgtgtagaactcctagttcgaaatcacgaatcacccacgtgtagctgtgtggcagagtgagcatgtgaggcagctagctcgctctgctcacataacatgtgtgatgaataccggggtggtacgggatgtggcggaggatactgcgacctcccacgcacgggcgggatgcgcgagagagtcgcactaccagacatgtaggacggcatgatgaccgcactcaacgccaacacggtcatggaccttatgatggtcgaagctggtgctgtccggcatgatcctggccggcaccgatgaacgcgctcacggtggccaccctcgtgctggtgatcttcacccccgtgatggtcgcggacgccatcgggttggagctgatggtgctcggcttcgtcaactnctgtctgctcggcgtcgcctgggatgacatggtctgctggatctgctactacctggacaacaaagacccgaccggcgtcgaccacctggaccaaatccaggtcgaggctggcctacaacgcccgcgagatccaggatgcatgccagcatcggatct

SEQ ID NO: 42469 - protein, 86 aa, Zea mays
  misc_feature: Ceres CLONE 1440769-F
  misc_feature (35)..(35): Xaa is any aa, unknown, or other
MNALTVATLVLVIFTPVMVADAIGLELMVLGFVNXCLLGVAWDDMVCWICYYLDNKDPTGVDHLDQIQVEAGLQRPRDPGCMPASD

SEQ ID NO: 42470 - DNA, 654 bp, Zea mays
  misc_feature: Ceres CLONE 1440772-F
  misc_feature (474)..(474): n is a, c, t, g, unknown, or other
  misc_feature (546)..(546): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (565)..(565): n is a, c, t, g, unknown, or other
  misc_feature (567)..(567): n is a, c, t, g, unknown, or other
  misc_feature (568)..(568): n is a, c, t, g, unknown, or other
  misc_feature (570)..(570): n is a, c, t, g, unknown, or other
  misc_feature (574)..(574): n is a, c, t, g, unknown, or other
  misc_feature (575)..(575): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (582)..(582): n is a, c, t, g, unknown, or other
  misc_feature (591)..(591): n is a, c, t, g, unknown, or other
  misc_feature (593)..(593): n is a, c, t, g, unknown, or other
  misc_feature (599)..(599): n is a, c, t, g, unknown, or other
  misc_feature (602)..(602): n is a, c, t, g, unknown, or other
  misc_feature (603)..(603): n is a, c, t, g, unknown, or other
  misc_feature (606)..(606): n is a, c, t, g, unknown, or other
aagctggagctccccgcggtggcggccgctctacaatagtggatcccccgggctgcaggaattcgcacgagaccattacctagaacatcctaatcgaaaaaacactcccgggccaacggatgccctgctttggactggtgccttgatctgaccacgcgcgccaactccactccacaatccggtctggcgatgggcgccacttcactcctactgatgatggtttccctggatgtcctgcttctcgccgccgccccccgtggtggtaccctccgtctgcccaccgatgacggacgcattgctcccgatcctgtcatccccaatcgtcatggcgacggcaacggcaaaccatcacgcttcgcgacgcacacagtgcacgtcgggaatgctctcacttggccctatgcgttccgacctatcctgctacctttgctgccttaactatcgatcggtgatcgaacaccttctcccaacccntggttaaaagaagtccccttgggaaaaaacccgggggaaaaaaacctccccccccccctctctctttgtttnttnnnnnnnnnnnnnnngnanntntatnntnntntntttttctgntntgtgtnttnnttnaaaaacgaaaaacccagactcgacttggggggcgtgtggtgcgatttc

SEQ ID NO: 42471 - DNA, 673 bp, Zea mays
  misc_feature: Ceres CLONE 1440776-F
  misc_feature: Encodes the peptide sequence at SEQ ID NO. 42472
  misc_feature (227)..(227): n is a, c, t, g, unknown, or other
ggagctccccgcggtggcggccgctctagaactagtggatcccccgggctgcaggaattcgcacgagaccattacctagaacatcctaatcgaaaaatcgaaaacccaccgcaccctttcatcagcctgcctgtccactgttggcttggtgacttcctccgctccgctccgctcccctccgctcccgaacggtcgatctttgcatggcagcagcagctggctccaangggcgggcgatcgctggaagcttcgtcagccgcgtcctcgccggcaaggccgcctcgacgaggagggccgtgcacgcctcggcgtacgacagaaccctggaggacccagtgcgccccgcgttcgtgccggacgatgtgaatcggagcgccgggaacccccaaaagtactggacccccccccccaaaaccggggtcttcggcccgcggggggggaccccaacttggcccttgggggccccccaaaccccggccgaattctctcagaggccaggttctgaccaaaaggggggggtcccccccccccaagaactcaaaaaacccccccccccccccgtaacccccggggtcttttttagcccccccccagttgtgttttctcataaaaaaggggggggggaaaaacccttagaagagaaaaatttcttttttttttcccgcggggtggg

SEQ ID NO: 42472 - protein, 156 aa, Zea mays
  misc_feature: Ceres CLONE 1440776-F
  misc_feature (8)..(8): Xaa is any aa, unknown, or other
MAAAAGSXGRAIAGSFVSRVLAGKAASTRRAVHASAYDRTLEDPVRPAFVPDDVNRSAGNPQKYWTPPPKTGVFGPRGGTPTWPLGAPQTPAEFSQRPGSDQKGGVPPPQELKKPPPPPVTPGVFFSPPPVVFSHKKGGGEKPLEEKNFFFFSRGV

SEQ ID NO: 42473 - DNA, 641 bp, Zea mays
  misc_feature: Ceres CLONE 1440780-F
  misc_feature: Encodes the peptide sequence at SEQ ID NO. 42474
aagctggagctccccgcggtggcggccgctctagaactagtggatcccccgggctgcaggaattcgcacgagaccattacctagaacatcctgttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaa

SEQ ID NO: 42474 - protein, 135 aa, Zea mays
  misc_feature: Ceres CLONE 1440780-F
  misc_feature (58)..(135): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVK

SEQ ID NO: 42475 - DNA, 628 bp, Zea mays
  misc_feature: Ceres CLONE 1440795-F
  misc_feature: Encodes the peptide sequence at SEQ ID NO. 42476
  misc_feature (445)..(445): n is a, c, t, g, unknown, or other
  misc_feature (562)..(562): n is a, c, t, g, unknown, or other
ggagctccccgcggtggcggccgctctagaactagtggatcccccgggctgcaggaattcgcacgagaccatacctagaacatcctaatcgaaaaacaaaaaaattcggccgactcacgtgaggccacgacccgtcactacggccgaccccgactcggcggctgcaccgcaatccgaccgaccgccgtccgtccctctccacgccgtctgccgccgcatcaatccagcaggcagcgacctaggggctgtccgtgtccggttgggaggcgccgggcgcactggggtgggcggctgcccgcctggccggccagccgtaagcgccgagcggcgtgccggcatctccgttgcggtgtgggcaaggcaccagcggccagtgctgagcattgtgggcgcaactgttagagatccgactttattcctgaaggcatttgtctgaactttttcngaaatgagtgccggtggtgcttttggtggaaatagggggctgaggcctgtaccccctgaaaaaggtgtattcccattggaccactacatgagtgcgacttgaagaagaaagactatncttgctgcctgaatctaacgggtttcaatctgaaaaatgtcaacgtctccaaaaagtttctggaag

SEQ ID NO: 42476 - protein, 32 aa, Zea mays
  misc_feature: Ceres CLONE 1440795-F
MSAGGAFGGNRGLRPVPPEKGVFPLDHYMSAT

SEQ ID NO: 42477 - DNA, 662 bp, Zea mays
  misc_feature: Ceres CLONE 1440797-F
  misc_feature: Encodes the peptide sequence at SEQ ID NO. 42478
aagctggagctccccgcggtggcggccgctctagaactagtggatcccccgggctgcaggaattcgcacgagaccattacctagaacatcctaatcgaaaaacctccacccgtccagcaccgccactgttcgcgccgccgtagccccccaaacccccacaccctccggagcgtcgcagcgatcccacccctccttctccccttcacacgtccatggcggagcgcggcggcgaacgtggcaggccagcgcggcgggtttggccgtggcttcgggcgcggcgggcgcggcgaccgtggcgggcgccgaggcggccgtcgcggcccgcgtcaggaggaagagaaatgggtccccgttacgaagctcggccgcctcgtcaaggagaacaggatcaccaagatcgaggagatctacctccactcgctccccgtcaaggagcaccagatcatcgagaccctcgtgccggggctcaaggacgaggtgatgaagatcacgcccgttcagaagcagacccgcgccggacagcgcacccgcttcaaagcctttgtcgtcgtgggcgactgcgacggccacgtcggcctgggagtcaagtgcgccaaggaggtggccaccgccatccgcggcgacatcatcctcgccaagctctccgttgttcccgtcaggag

SEQ ID NO: 42478 - protein, 60 aa, Zea mays
  misc_feature: Ceres CLONE 1440797-F
  misc_feature (1)..(60): Pfam Name: Ribosomal_S5 Pfam Description: Ribosomal protein S5, N-terminal domain
MKITPVQKQTRAGQRTRFKAFVVVGDCDGHVGLGVKCAKEVATAIRGDIILAKLSVVPVR

SEQ ID NO: 42479 - DNA, 612 bp, Zea mays
  misc_feature: Ceres CLONE 1440812-F
  misc_feature (440)..(440): n is a, c, t, g, unknown, or other
ctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagaaccccagccgctcgccgccgctacggcggatgattccgcaccccagcatcagctgcngtgaccgccgcgccgcagtcgacccgaggcgctctcggggttttttgcgacggcggacccaaagcagggcgcgacccatgggggccccatcgccccgaaagggcgtccccgggttcccgggtctgggccccaggcccggggggtcaaaaaaataggcccccccccgcccccc

SEQ ID NO: 42480 - DNA, 649 bp, Zea mays
  misc_feature: Ceres CLONE 1440820-F
  misc_feature: Translation starting site: 136
  misc_feature: SWISSPROT Homolog: EC 2.2.1.2 Transaldolase
aaagctggagctccccgcggtggcggccgctctagaactagtggatcccccgggctgcaggaattcgcacgagaccattacctagaacatcctaatcgaaaaacttccattccaccggctccgatcccaactgccatggcgctctccatctacacgcccacctcctcctccctcgtcccgccctccattcaggaggtcaggttgacttcgcgaccgccaaagcccgcgactttcagcctacagaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacggcggccacagtgagctcgtcgctgctgcttgggatcactgggctcccagacactaagttcaagagtgcgatagatactgcactggcattatggtgagtgcaacgcactggacaaagctgaggacaggatgtactgttacctcaccaacgctcttgcatatgttggcgctgaactggctcatcaagcccctgggagagttcgcacgcgaatagatgcccggttagcttatgacacccagggcataagtcacagggga

SEQ ID NO: 42481 - DNA, 634 bp, Zea mays
  misc_feature: Ceres CLONE 1440822-F
  misc_feature: Encodes the peptide sequence at SEQ ID NO. 42482
ggagctccccgcggtggcggccgctctagaactagtggatcccccgggctgcaggaattcgcacgagaccattacctagaacatcctaatcgaaaactcccgtccgtatctctctcttgctcgcactcgcggagatcgaagagaagcgcaggaggccccagcactagcgccgccccgccgccgcatcagacatggcgctgggcgctcgcctcgtctcgcgctcccgtcagctatattcgggtcaagccacttgggggatggaggtgtcacctcagtccctccttttgccaggatgcaccttcagctggacgtcctcttgtcagtggggatgatctcctgaaaggcaatttcttttagggaaaaaaaaatttgaaacccttctttggggtttttaaaaggaaaaaatcctttttgtccccaaacccccccggggtttctcccttttcccccctcctttaaaaccttttagggaaaagggggatttttctctctttttttcccagggtaaaaaaaatcccttaaaaccctccccccagggctccccgggggcgggggtttttttttaaaccccccccccacccccaaaaaaaaaaggggggctttacaacactcctcaaaaatcccccctttaaag

SEQ ID NO: 42482 - protein, 118 aa, Zea mays
  misc_feature: Ceres CLONE 1440822-F
GAPRGGGRSRTSGSPGLQEFARDHYLEHPNRKLPSVSLSCSHSRRSKRSAGGPSTSAAPPPHQTWRWALASSRAPVSYIRVKPLGGWRCHLSPSFCQDAPSAGRPLVSGDDLLKGNFF

SEQ ID NO: 42483 - DNA, 644 bp, Zea mays
  misc_feature: Ceres CLONE 1440823-F
  misc_feature (114)..(114): n is a, c, t, g, unknown, or other
  misc_feature (321)..(321): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (393)..(393): n is a, c, t, g, unknown, or other
ggagctccccgcggtggcggccgctctagaactagtggatcccccgggctgcaggaattcgcacgagaccattacctagaacatcctaatcgaaaacctcccgcccgatacatnttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgnatctgcttttctgctgtattttttatctaccaatcnnnnatataaaaaaaattataaaaactagtactacgncatccagctttctcccttataagaaaatcatggataaatttaaaaaagcaaaacctcaaacccaagagaaaaactgatggcccgaacttgaccgtgactttttcgggaaacaaacaacaaaccctacgacggggcctcgttagggaaacccccgggtaccagagccccaattggggaaaaagggcccccaaggccccctttgggggttttgaaaaaagggggggggaaaattccccccccccctggggggc

SEQ ID NO: 42484 - DNA, 625 bp, Zea mays
  misc_feature: Ceres CLONE 1440826-F
  misc_feature: Encodes the peptide sequence at SEQ ID NO. 42485
ggagctccccgcggtggcggccgctctagaactagtggatcccccgggctgcaggaattcgcacgagaccattacctagaacatcctaatcgaaaaaaccaaacgcaatggtttgttctctcattctcttttgtctcctttctctttgtaatgaagttgtgttatagatatgaatattgtttcttgttatgcttttatttatttgcgttcacataagatcatattggtttattgtcccatttacaatcttggattacggtttatccatatactatgaattggaaaggcgaacgcagcgtcaggaatggcggtggaagacgaatgtaagttgaagtttttggagctaaaagcgaaaagaaactataggttcataatattcaggatagacggacaacaagtggtggttgagaagcttggaagtcctgaggagaactacgacgatttctccaattccttacctgccaatgagtgccgctacgctgtctatgacttcgacttcaccactgctgagaattgccagaaaagcaagatcttcttcatagcatggtcaccggattcttcgagggtaagaatgaagatggtgtatgcgagctcaaaagacaggttcaagagagagttggatggg

SEQ ID NO: 42485 - protein, 107 aa, Zea mays
  misc_feature: Ceres CLONE 1440826-F
  misc_feature (5)..(107): Pfam Name: Cofilin_ADF Pfam Description: Cofilin/tropomyosin-type actin-binding protein
MAVEDECKLKFLELKAKRNYRFIIFRIDGQQVVVEKLGSPEENYDDFSNSLPANECRYAVYDFDFTTAENCQKSKIFFIAWSPDSSRVRMKMVYASSKDRFKRELDG

SEQ ID NO: 42486 - DNA, 654 bp, Zea mays
  misc_feature: Ceres CLONE 1440829-F
  misc_feature: Encodes the peptide sequence at SEQ ID NO. 42487
aagctggagctccccgcggtggcggccgctctagaactagtggatcccccgggctgcaggaattcgcacgagaccattacctagaacatcctaatcaaaagtgatttaactttctccatagaaaccccatgaaaaagcgttctgggggcccccgcgtcgcctccgcctgggcgacacgggcggcgccccgctccccttgccgccgtcgcccgcaaatcctctctccctttcccttgccgccgccggaggggtctgccggaggccggctcggcccctaggatggcgacggcggggtgtttcgcgcggatctggtgggagttagcgcagctcatcggcggtggagcgcgcgcagcacggtacctatgggtggccgtggccgtgctggggcgcgccgtggcacgcgccgcggagctcgccgggcggcggctgaggcccaggcggccaggcgtggcggggcgtcgccgtgaggacgtcgtggcctgcctccgcgcctcgctcgaggatctgctccggtcgccgctgtcgtgcgctgtcggtgggggcttgggcgacgccgagctgtgcttctgcgaggcggaggccgtcgacgtgtgcgtcagcgggcagatctgtgcgggggtcggcgcacggcggcatgggcgactcagcgtagcc

SEQ ID NO: 42487 - protein, 125 aa, Zea mays
  misc_feature: Ceres CLONE 1440829-F
MATAGCFARIWWELAQLIGGGARAARYLWVAVAVLGRAVARAAELAGRRLRPRRPGVAGRRREDVVACLRASLEDLLRSPLSCAVGGGLGDAELCFCEAEAVDVCVSGQICAGVGARRHGRLSVA

SEQ ID NO: 42488 - DNA, 638 bp, Zea mays
  misc_feature: Ceres CLONE 1440830-F
  misc_feature: Encodes the peptide sequence at SEQ ID NO. 42489
tccccgcggtggcggccgctctagaactagtggatcccccgggctgcaggaattcgcacgagaccattacctagaacatcctaatcgaaaaattaacccccactctcccagctaagagcgtgcaagcactccctcgccgcccaccgcgcctcgatgaccgcaactgggcggacgtccctgccgccctacgccaagtgacaaggtgattttccgcccctttgccggcgaccagcaccaccagatactctgagcctggcagcccaaacttccttttggcgtccctgttacattctgtttcgattttgatgacttcatcaagaagcaagagcacgagccacagtcacagcaggagcacgagccgctctcctcagcgaagatatatgttgcgcaacgaacgtgcaccccgacacagactcagatcgcacaggagcctgcatccataccgtcgcatagagacgtgcggatactaggatctcctatgcaagaactgacggagaactgagcactttgctaaggagtggccatctgcgcctcacgggaatgactgggaccttccaggccaccttctcagccttattgcacgtcaccaactggttggctggaaactgcaaaggcctggggcacattgcctagtgggt

SEQ ID NO: 42489 - protein, 54 aa, Zea mays
  misc_feature: Ceres CLONE 1440830-F
MTSSRSKSTSHSHSRSTSRSPQRRYMLRNERAPRHRLRSHRSLHPYRRIETCGY

SEQ ID NO: 42490 - DNA, 642 bp, Zea mays
  misc_feature: Ceres CLONE 1440832-F
  misc_feature: Encodes the peptide sequence at SEQ ID NO. 42491
aagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcagtggcgtcatcgacaatgccctgtaccccgtcctcttcctggactacctcaagtccg

SEQ ID NO: 42491 - protein, 134 aa, Zea mays
  misc_feature: Ceres CLONE 1440832-F
MGECRTEYRGLPDANGEDAGTVPAALRKVSIVPLVFLIFYEVSGGPFGIEDSVGAAGPLLAIVGFLVLPVIWSIPEALITAELGTMFPENGGYVVWVASALGPYWGFQQGWVKWLSGVIDNALYPVLFLDYLKS

SEQ ID NO: 42492 - DNA, 655 bp, Zea mays
  misc_feature: Ceres CLONE 1440835-F
  misc_feature: Translation starting site: 160
  misc_feature (339)..(339): n is a, c, t, g, unknown, or other
  misc_feature (341)..(341): n is a, c, t, g, unknown, or other
  misc_feature (556)..(556): n is a, c, t, g, unknown, or other
  misc_feature (557)..(557): n is a, c, t, g, unknown, or other
aaagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacangnaattgcagctggcatcttacctttatcacccttgttcctccaacaatcatcagccctattacagcagttacctttggtgcatttattggcacaaaaatcagggcacaacaactaccacaacttgggctagcaaaccttgctggccactctcagcaacatcagtttcttccattcaaccaaatagctgcatttgaactctgcttttttatttgcannaacaaaaataccattcagcccggttatttgctggcccaaccccccacaaatttcttccctttcacccaactgaacccctttgaactctcgcggcttaa

SEQ ID NO: 42493 - DNA, 662 bp, Zea mays
  misc_feature: Ceres CLONE 1440836-F
  misc_feature: Encodes the peptide sequence at SEQ ID NO. 42494
aaagctggagctccccgcggtggcggccgctctagaactagtggatcccccgggctgcaggaattcgcacgagaccattacctagaacatcctaatcgaaaaagatcagaccacactcgtagagagaaggaaaaaatatccccaaaccctagctcccgatctcgatggcgaaccctcgcgtcttcttcgacatgaccgtcggcgggcgccccggcgggccggatcgtgatggagctgtacgccaacgaggtgcccaagaccgcggaagaacttccgcgcgctgtgcacgggcgagaagggcgtgggcaagtccggggagccgctccactatcagggctccacctttcaccgcgtcatccccgagttcatgtgcccagggcgcgacttcacccgcggggaacggcacgggcggcgaattccatcttacggggaggaatttccccgacaaagaattcgggggcaagccaacccgccccgggggggtctccatgggcaacccggggcccaaacccaagggccccggtttttaatttggcccggccggacccctgggtcggaggggaaaccttttttttttggcaagtttttaggggagtgggccctttcagggcctcaaaaagggggggcccccaaaggctcccccccagggggggggggggggg

SEQ ID NO: 42494 - protein, 98 aa, Zea mays
  misc_feature: Ceres CLONE 1440836-F
  misc_feature: SWISSPROT Homolog: EC 5.2.1.8 Peptidylprolyl isomerase
MCPGRDFTRGERHGRRIPSYGEEFPRQRIRGQANPPRGGLHGQPGAQTQGPRFLIWPGRTPGSEGKPFFFGKFLGEWALSGPQKGGAPKGSPPGGGGG

SEQ ID NO: 42495 - DNA, 650 bp, Zea mays
  misc_feature: Ceres CLONE 1440840-F
  misc_feature: Encodes the peptide sequence at SEQ ID NO. 42496
aagctggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggcgcagtcggactcccacggcctgggggacttcacgagcgggagcggcgaggcgacgacgacgccggagatgcagaccttcttcaagccccaggccgctgcggcgctcccggaggccctcgacgcctccatgcccgccaagccggaggcggcggcggcggcgctcccggccacgacaagggccgggacggcgccgtcagccacgccgcgcaggcccgtgtccgttgccgccggcgtggcctgccgcgtggcggccctgggcgtggccggcatcgctgccgacctggcctacctggtgcgccgcccgcggcccgggaacgaagtgcagcttcgctcctccccttggaccccgtcccggcgggcccgcctgataggccctcctcc

SEQ ID NO: 42496 - protein, 146 aa, Zea mays
  misc_feature: Ceres CLONE 1440840-F
MACKTKSLLLALSVAALLAAQSDSHGLGDFTSGSGEATTTPEMQTFFKPQAAAALPEALDASMPAKPEAAAAALPATTRAGTAPSATPRRPVSVAAGVACRVAALGVAGIAADLAYLVRRPRPGNEVQLRSSPWTPSRRARLIGPP

SEQ ID NO: 42497 - DNA, 631 bp, Zea mays
  misc_feature: Ceres CLONE 1440848-F
  misc_feature: Translation starting site: 302
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccg

SEQ ID NO: 42498 - DNA, 687 bp, Zea mays
  misc_feature: Ceres CLONE 1440849-F
  misc_feature: Encodes the peptide sequence at SEQ ID NO. 42499
  misc_feature (384)..(384): n is a, c, t, g, unknown, or other
  misc_feature (433)..(433): n is a, c, t, g, unknown, or other
aagctggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccagggtcaggggctcccccgtcgtctacaggcgatccttcctcgagaagaagggccttnagcaccgaggagatcgacgaagcccttccgaagggttcctgatcctcancccaggcctacggctaccacttctccgcagcagcaggtccaacagcccgaatccatcccgtcgggggggcaagctaattgcgcccgcacaaaccggggcacccagcaaaaggcggcccctgtcgttccttccaacgcaacccagggttaagcttgggaccaaggaatccctggggggaggggcccttggctggggtttgggggccagccccggccgtctttttacagaaaaacgggtccctttccaggggccaa

SEQ ID NO: 42499 - protein, 172 aa, Zea mays
  misc_feature: Ceres CLONE 1440849-F
  misc_feature (72)..(72): Xaa is any aa, unknown, or other
  misc_feature (88)..(88): Xaa is any aa, unknown, or other
MASGIGSGQQQPPAPAADADPGAVGDKLVFEAPPQPVREDYVQNAVKFLSHPRVRGSPVVYRRSFLEKKGLXHRGDRRSPSEGFLILXPGLRLPLLRSSRSNSPNPSRRGGKLIAPAQTGAPSKRRPLSFLPTQPRVKLGTKESLGGGALGWGLGASPGRLFTEKRVPFQGP

SEQ ID NO: 42500 - DNA, 623 bp, Zea mays
  misc_feature: Ceres CLONE 1440866-F
  misc_feature: Translation starting site: 169
  misc_feature: Pfam Name: Gln-synt_C Pfam Description: Glutamine synthetase, catalytic domain
  misc_feature: SWISSPROT Homolog: EC 6.3.1.2 Glutamate--ammonia ligase
  misc_feature (416)..(416): n is a, c, t, g, unknown, or other
  misc_feature (478)..(478): n is a, c, t, g, unknown, or other
  misc_feature (479)..(479): n is a, c, t, g, unknown, or other
  misc_feature (482)..(482): n is a, c, t, g, unknown, or other
  misc_feature (578)..(578): n is a, c, t, g, unknown, or other
  misc_feature (623)..(623): n is a, c, t, g, unknown, or other
gagctccccgcggtggcggccgctctagaactagtggatcccccgggctgcaggaattcgcacgagaccattacctagaacatcctaatcgaaaagtcctcaatctcaatcccacaccaccaccacctcctccggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaagacagcgaggtcatcctgtacccgcaggccatcttcaaggacccattcangaggggcaacaacatccttgtgatgtgcgattgctacaccccagccggcgagccaatcccanncancagaggtacaacgccgcccagatcttcagcagccctgaagtcgccgccgaagaagcgtggtatggtattgagcaagagtacaccctccctcagaangacaccaactggcccctttggtgcccatcggtggcttcccccgcn

SEQ ID NO: 42501 - DNA, 667 bp, Zea mays
  misc_feature: Ceres CLONE 1440877-F
  misc_feature: Encodes the peptide sequence at SEQ ID NO. 42502
  misc_feature (366)..(366): n is a, c, t, g, unknown, or other
tctgaactagtggatcccccgggctgcaggaattcgcacgagaccattacctagaacatcctaatcgaaaactagcttcagaacgaactgaaacccgcgatctgaagcgactagtcgaaggcggcggcggcggcgatggggaccgacctggagacggagaagaagaagaccccggtggcgctgatgcccatcgcgaagcctctcgctggaaagaagctctgcaagcggaccctcaagctcgtgcgacgagcctctgaggccaagtgcctcaagcgcggagtcaaaaaggtagtcaagaacattctccgcgggaacaacgggttgtgtgtgattgctggaaatatttcgcccatggatgtgattacnccctttccatttcttatctcacccctccccggttgccttacctgtgtgttgggtcaaaagaggatcttgctaccgcccgaaaccactaagaggccaactttgttgcgtccttggtcctgacacaacccaagggggggggagctccatggaccaaggggaaggattaacttgatgttcggactatgacccactttgtaggcgaagtttgccccacccctccctcctggcactggttctaggggaccctttccgggggaccatcttcatccggaaaaaatcatggcggcttagctttccttgg

SEQ ID NO: 42502 - protein, 116 aa, Zea mays
  misc_feature: Ceres CLONE 1440877-F
MGTDLETEKKKTPVALMPIAKPLAGKKLCKRTLKLVRRASEAKCLKRGVKKVVKNILRGNNGLCVIAGNISPMDVITPFPFLISPLPGCLTCVLGQKRILLPPETTKRPTLLRPWS

SEQ ID NO: 42503 - DNA, 665 bp, Zea mays
  misc_feature: Ceres CLONE 1440888-F
  misc_feature: Encodes the peptide sequence at SEQ ID NO. 42504
aagctggagctccccgcggtggcggccgctctagaactagtggatcccccgggctgcaggaattcgcacgagaccattacctagaacatcctaatcgaaaacaccactgggtcttcatacctttacctttatctactccagatcgcataataacccgatcgacaccatgagggggttgctcgttgccctcgctctgcgtggctctcgttgccagcgctctctccacgaatacaaacggcagctgagaaatgccagacaccgcctccgggtcatctaccgccgcctgcgcatctgccacctccggttcaactgacacctccggtgcatctcccaccgacagtctgactgacttcgccggtccacctgtgaacagcggcccacgcgcggccgccccttcatctggcgacgccaacaccccactcttctactcaaacgcgccggcctcagcctcatcccctgccacgcccatgcgcgtgccaacacccgattgatatgccgtacctcctgctgggaacctgcgtggttagggtgatcaccatcctggccctgtgcctctatttcctgaggaaacagagcggcaccaacgcgtagggctacttctacgctcactgctggtcgtataagaatgtgtgttgccacgaactctagcccgtgtctcccctatc

SEQ ID NO: 42504 - protein, 32 aa, Zea mays
  misc_feature: Ceres CLONE 1440888-F
MPYLLLGTCVVRVITILALCLYFLRKQSGTNA

SEQ ID NO: 42505 - DNA, 806 bp, Zea mays
  misc_feature: Ceres CLONE 1440888-R2
ggaagatttggctagtggaagggggctggactatatattagaattaagtctcttcggacgcacggtaaagtttcttcaaacatcggagacgcgtgcgcttttctatttggagaatttaccgggggaagaaaggcgggatgatctgtccgaccagatcacaaacgcaccctccaaggctccaacacccatgaaaaaagaacgctaacgaaacaatagtgctgctgtactactgtaaaaggaagtagcatgcaatttcgctaaggatcgcactattttgttcgatcgtcgctttaacatcttgtccaatgattgctcggccgaagcgaaggtgaactgggccaagaaaccaaaccaaccaagaacggctagtccatccataacccaccatcatcatcgtaagtgtggcgtcagtgcagtgccatggcaccctgcgccaccacaaggaaagacatcggtacaggacgaccttgccgcgcatgggaggcatgcctactcattgtattttcatgctctcaagcgtgatcccaggcatgtcgaatgagtcgacaaactgtccccacctggaccttgaggttctcgatccccttgctggtcacaaggcccctgtttgaagtcctagaagaggcttgccataacccttctgggaaggtccagcaaaatggtcactgccctggtggaggaacctcccccaatcagcccggaatcccttctcccaaaaggacccctcgaggggtggttacctggggcgcccaatggtgggaaaccacccgggaaaacaaatgccacggctggtccacccaaagaat

SEQ ID NO: 42506 - DNA, 828 bp, Zea mays
  misc_feature: Ceres CLONE 1440888-R
cgattgggtaccgggccccccctcgaggtcgacggtatcgataagcttttttttttttttttttagtcagagaaagttggaaggatttggctagtgaaaggggcactggactatatattacaagtagatctcttcggacgcacggtaaagtttcttcaaacatcggagacccatgcgcttttctatttggagaatttaccgggggaagaaaggcgggatgatctgtccgaccagatcacaaacgcaccctccaaggctccgacacccatgaaaaaagaacgctaacgaaacaatagtgctgctgtactactgtaaaaggaagtagcatgcaattttgctcaggatcgcactattttgttcgatcttcgctttgacatctcgcccaatgattgctccgccgaagcgaatgtgaactgggccaggaaatcaaaccaaccaagaacggctagtgcatccataagccaccatcatcatcgtaagtgtggcggcagtgcagtgccctggcaccctgcgccaccacaaggaaagacatcggtacaagaggacctttgccgctcatggaaggcatgtctagctccttggctttcaagctctcaaggctgaacccagggctgtccaaagaatcggcaaaattcctcccccgggaactttgaggttcccgaaggccatggctggttacccaggccctcgctttaagccccttgaaagagcctggccaaaaacccttccgggaaggttccggcaaaatggttccccggccgcgggggggaggaaccttccccaattgcggacggggaaaacccctcctctcaggagaaaacccccttc

SEQ ID NO: 42507 - DNA, 672 bp, Zea mays
  misc_feature: Ceres CLONE 1440915-F
caagctggagctccccgcggtggcggccgctctagaactagtggatcccccgggctgcaggaattcgcacgagaccattacctagaacatcctaatcgaaaaacaagtcagaaaaaaaaaagaataagaagaaaggaatccctcctacgcggaagcgaagagattcgtcgcctcagccgcctctctgctcagatctgcggcggagcctcgccggcggcctgcgccccgcggcgccgccgatccaagatgccttcgtgcgtgcagggatgctgctgctgctcgtccctgcgccttctcccccgcgacgacgcgctctcgtccccctccgcctgcgcgcaccgcctgaagccttggtcttggcgtgaccaatcccccacctcgacctcctaacgcttgtccccgcccgctctccaccctgatctacctgtctctacccttccctcctccatttctacatctccccgttgctgctctgctcctgctgccacaagagtattcgccttcaatcgttgctcgcgcctgtcatttcgtgccgcacggccgacttgtttgccgatttcgctgccgccttctggtggatcggattcggctggatcggattcatggtctgatcggaaggaggttcgggagacggatgggttgggtccggtgggtgctcgggcgcacctcgcc

SEQ ID NO: 42508 - DNA, 642 bp, Zea mays
  misc_feature: Ceres CLONE 1440921-F
  misc_feature: Encodes the peptide sequence at SEQ ID NO. 42509
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
aagctggagctccccgcggtggcggccgctctagaactagtggatcccccgggctgcaggaattcgcacgagaccattacctagaacatcctaatcgaaaaactcgcactcgcactcgcacctgcacctcgcactagctagtcttgccaattaagctaggtatagaccagcatggcttctgctctcaagatgacggccatctgcatgctgatcctgaccacgggccagctgatggcaactgccggtgcaaaggcgccgctggtgcaggcggacgccgcgcctacggctcgccgtctgctctcggcggaccatgagcgctcagcctccgggaggacgagcaactnnncctgcaccgccatgactccgtggtgttgcttcggtttgcagaggacggcgacggagaactgcccctgcaccgccaggactccgtggtgttgnnncggtttgcagaagacggcgctagaggactgcccctgcagcccatttacaccatggtgctgctccggtttgcagaagacggcgcnnnagaactgcccctgcacccccatgactccattctgttgctttggcgccggcagtgctgccacaaactgaaatcttcatgagaagaactgcnnnnagatggatgtggcctctaaatgt

SEQ ID NO: 42509 - protein, 140 aa, Zea mays
  misc_feature: Ceres CLONE 1440921-F
  misc_feature (58)..(58): Xaa is any aa, unknown, or other
  misc_feature (59)..(59): Xaa is any aa, unknown, or other
  misc_feature (89)..(89): Xaa is any aa, unknown, or other
  misc_feature (90)..(90): Xaa is any aa, unknown, or other
  misc_feature (118)..(118): Xaa is any aa, unknown, or other
  misc_feature (119)..(119): Xaa is any aa, unknown, or other
MASALKMTAICMLILTTGQLMATAGAKAPLVQADAAPTARRLLSADHERSASGRTSNXXCTAMTPWCCFGLQRTATENCPCTARTPWCXXGLQKTALEDCPCSPFTPWCCSGLQKTAXXNCPCTPMTPFCCFGAGSAATN

SEQ ID NO: 42510 - DNA, 672 bp, Zea mays
  misc_feature: Ceres CLONE 1440922-F
  misc_feature: Encodes the peptide sequence at SEQ ID NO. 42511
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
aagctggagctccccgcggtggcggccgctctagttccaaaggatcccccgggctgcaggaaatcccacgagaccagnnnctagaacatcctaatcgaaaaaacactcccccgatctccgccactccaaaatgtggcgccgccaccacctcctccggctacttccacctccggccaccgccgccaccgccgnnnccccttctcatttcctgcgccacctctctacctcaagcaccccgaccccggccgcctccctggcctcgtccctcgcgtcggcgctcaccgcgctctccacgaccccgnnncccgccaccaccccggacgcttacttctccctccacttctccgacgtgcggcctaccaacgcgctcctcgctgaggcgctcgcgctctccccgcccgccacctcccgcgccgctgccnnnctcttccgcttcctcgtccgccgccgctcgctccacccctccgacggcgcgctcgcgcccatcgttcgccacctcgcccgccgccgcgacttccccgccgtgcgcgcgctcatccaggagtttcnnnccgctctcgggcccgccacgctcgacgcctatctccagcagctcaccagagccgggcgcccaacggacgctgtcaaggtgttcgacgaattgccggagcagctccgtaaccgcgaggctct

SEQ ID NO: 42511 - protein, 180 aa, Zea mays
  misc_feature: Ceres CLONE 1440922-F
  misc_feature (21)..(21): Xaa is any aa, unknown, or other
  misc_feature (22)..(22): Xaa is any aa, unknown, or other
  misc_feature (58)..(58): Xaa is any aa, unknown, or other
  misc_feature (98)..(98): Xaa is any aa, unknown, or other
  misc_feature (140)..(140): Xaa is any aa, unknown, or other
  misc_feature (141)..(141): Xaa is any aa, unknown, or other
MWRRHHLLRLLPPPATAATAXXPSHFLRHLSTSSTPTPAASLASSLASALTALSTTPXPATTPDAYFSLHFSDVRPTNALLAEALALSPPATSRAAAXLFRFLVRRRSLHPSDGALAPIVRHLARRRDFPAVRALIQEFXXALGPATLDAYLQQLTRAGRPTDAVKVFDELPEQLRNREA

SEQ ID NO: 42512 - DNA, 636 bp, Zea mays
  misc_feature: Ceres CLONE 1440928-F
  misc_feature (66)..(66): n is a, c, t, g, unknown, or other
  misc_feature (67)..(67): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (360)..(360): n is a, c, t, g, unknown, or other
  misc_feature (361)..(361): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
ggagctccccgcggtggcggccgctctagaactagtggatcccccgggctgcaggaattcgcacgnnaccattacctagaacatcctaatcgaaaaaaccaagcagagcaaagagagagacgcggagccaccgcgttccggagagagacgcggagagccaaggcaaggcagctgtcnnnccagcgacgatgtggagctcgggctctgaccgcgacgaggccctagacacggcgaacgcctcgtcagtcgacgcttcgtcgcccgcgcggcagccgtccacgcnnnccccgccgcctcggcgccggcgccagcgcgcgcgacgccgcgctcaccgcctccgtgccaggaacacgggcgcanngagcggaggaggaggagggactcgtggaggccgacccggnnncggacgacgtctggcgcgggctgcagcagcagcgggagcgggaggcgtggctgcggcgggcgtcgaggcccgtggtggtggtcgccggcgaggaggggtcccctccggacgcctccgnnngctcgggggagagcggcggggtggggagggcgcggagcctgaccgacgacgacctggaggagctcaaggggtgcgtggatctggggttcggcttcagctaccgcgagatcccc

SEQ ID NO: 42513 - DNA, 672 bp, Zea mays
  misc_feature: Ceres CLONE 1440931-F
  misc_feature: Encodes the peptide sequence at SEQ ID NO. 42514
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
aagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctcccnnnccaagcccatgtcacctccttcttctcctccttcccccgggcgctcccgccgccgccgccctgggcgcgcatcacctcgccagcctccacctccggggccctacctacctctgagatcgaggagcggctcgccgggnnncccgtgtacgcgctcgccaacgccgcccaggagttcgtgcttgtgtcgtccacacgcgtgggagggcaagggggcgagagcgtgagtccaacgccggcgctcgggctgctctgcttccggnnnnnagatgctgacgcgctgctggagcagatggatggcgatatgcgcgccggctctggtgtcgttcctgtcgcgctgaacaggttatccaaatgaagta

SEQ ID NO: 42514 - protein, 154 aa, Zea mays
  misc_feature: Ceres CLONE 1440931-F
  misc_feature (37)..(37): Xaa is any aa, unknown, or other
  misc_feature (83)..(83): Xaa is any aa, unknown, or other
  misc_feature (124)..(124): Xaa is any aa, unknown, or other
  misc_feature (125)..(125): Xaa is any aa, unknown, or other
MPFRFQFPWLKNPTTNGGTSNIDTNPSPRFPNPFLPXQAHVTSFFSSFPRALPPPPPWARITSPASTSGALPTSEIEERLAGXPVYALANAAQEFVLVSSTRVGGQGGESVSPTPALGLLCFRXXDADALLEQMDGDMRAGSGVVPVALNRLSK

SEQ ID NO: 42515 - DNA, 655 bp, Zea mays
  misc_feature: Ceres CLONE 1440933-F
  misc_feature: Encodes the peptide sequence at SEQ ID NO. 42516
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (537)..(537): n is a, c, t, g, unknown, or other
  misc_feature (538)..(538): n is a, c, t, g, unknown, or other
ggagctccccgcggtggcggccgctctagaactagtggatcccccgggctgcaggaattcgcacgagacnnntacctagaacatcctaatcgaaaaaccaccactgggtcttcagaccattagctttatctactccagagcgcagaagaacccgatcgacaccatgagggtgttgctcgttgccnnngctctcctggctctcgctgcgagcgccacctccacgcatacaagcggcggctgcggctgccagccaccgccgccggttcatctaccgccgccggtgcatctgccannnccggttcacctgccacctccggtgcatctcccaccgccggtccacctgccgccgccggtccacctgccaccgccggtccatgtgccgccgccggttcatctgccgccgccaccatgnnnctaccctactcaaccgccccggcctcagcctcatccccagccacacccatgcccgtgccaacagccgcatccaagcccgtgccagctgcagggaacctgcggcgttggcagcaccccgatttnntgccagtgcgtcgagtttctgaggcatcagtgcagcccgacggcgacgccctactgctcgcctcagtgccagtcgttgcggcagcagtgttgccagcagctcaggcaggtggagccg

SEQ ID NO: 42516 - protein, 64 aa, Zea mays
  misc_feature: Ceres CLONE 1440933-F
  misc_feature (25)..(25): Xaa is any aa, unknown, or other
  misc_feature (26)..(26): Xaa is any aa, unknown, or other
MPVPTAASKPVPAAGNLRRWQHPDXXPVRRVSEASVQPDGDALLLASVPVVAAAVLPAAQAGGA

SEQ ID NO: 42517 - DNA, 671 bp, Zea mays
  misc_feature: Ceres CLONE 1440964-F
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
ctccccgcggtggcggccgctctagaactagtggatcccccgggctgcaggaattcgcacgagaccattacctagaacatcctaatcgaaaaattcnnnatccctctacctctcgcatccggtgcctggctgccagccccagcgctcgccaacctcatcttccccggcgtttcctcctagctccctccaccatgccgctgccatggaactcactgctcggccgcgccctggccatgctnnnngcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcgcccagcctgttggcacacgcactcctctgtcgcacgctcctccaagtcagagctccctctggccgttcccatggtcgcccctctctcagcttcatcttcagctgctcga

SEQ ID NO: 42518 - DNA, 681 bp, Zea mays
  misc_feature: Ceres CLONE 1440984-F
  misc_feature: Encodes the peptide sequence at SEQ ID NO. 42519
ggcggccgctctagttctagtggatcccccgggctgcaggaatttgcacgagaccattacctagaacatcctaatcgaaaacttagccgcgcggacgcccaccagcagctgcccccttgctgtcgccgcctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggcgaaccctaggcagttcaaggtgcccgactggttcctcaacaggaagaaggattacaaggacggaaggttctcacaggtcgtccccaacgccctcgacatgaagttcagggacaacctccgagaggctcaaaaggacagggaaaccaccgtggtctggcgtcactactggggcctccgtgtccgtgggccgcacacccaagaccactggcaggccccgaaaaacctgttgggggccccccaaaaagcgaaaagcttacctttctttccgacaaatcttcaaagggtaccaaagggttcggttcc

SEQ ID NO: 42519 - protein, 172 aa, Zea mays
  misc_feature: Ceres CLONE 1440984-F
  misc_feature (14)..(137): Pfam Name: Ribosomal_S13 Pfam Description: Ribosomal protein S13/S18
MSLIAGEDFQHILRLLNTNVDGKQKIMFAMTSIKGVGRRFSNIVCKKADIDMNKRAGELTPEELERLMTVVANPRQFKVPDWFLNRKKDYKDGRFSQVVPNALDMKFRDNLREAQKDRETTVVWRHYWGLRVRGPHTQDHWQAPKNLLGAPQKAKSLPFFPTNLQRVPKGSV

SEQ ID NO: 42520 - DNA, 695 bp, Zea mays
  misc_feature: Ceres CLONE 1440988-F
  misc_feature: Encodes the peptide sequence at SEQ ID NO. 42521
  misc_feature (420)..(420): n is a, c, t, g, unknown, or other
  misc_feature (438)..(438): n is a, c, t, g, unknown, or other
  misc_feature (439)..(439): n is a, c, t, g, unknown, or other
  misc_feature (591)..(591): n is a, c, t, g, unknown, or other
  misc_feature (677)..(677): n is a, c, t, g, unknown, or other
agagctggagctccccgcggtggcggccgctctagaactagtggatcccccgggctgcaggaattcgcacgagaccattacctagaacatcctaatcgaaaaattcttccttccttcttttcttcaccaatggccacgagaatagccttgtgtcttctcggccacgtcctcctcgccgtcgcgtccatggcagtggcggcggcggccggtgacgcgggcaagatcggcatctgccacggccgcgttggcagtaacctcccgccgccgtcggccgccccggcactgctcaagcggaacgggatcaccaaggcgcggctcttcctgccggacccggacgtgctcccggccttcgccgcggcgggcatcgacctcatggtgggcgtgcccaacgagaacctcaccttcctggccgcggcccgncccgagggcgcggggcannggctgcggtccgcggtcctggcccaagcccaccccgagcccggccgggtgccctcgcccgtcaggcaacgaggttgctgtacaacaatcaggttctatgccccctcaacctctatgccggaccatgggtaaacgctgcagggccgaggctcncccaccccgggggcctggcaccggccagggcccaaaggattttgctaccgcttgcacgagcttccttccgggggaactggaccgancgaactaaaacaccaccg

SEQ ID NO: 42521 - protein, 146 aa, Zea mays
  misc_feature: Ceres CLONE 1440988-F
  misc_feature: SWISSPROT Homolog: EC 3.2.1.39 Glucan endo-1,3-beta-D-glucosidase
  misc_feature (103)..(103): Xaa is any aa, unknown, or other
  misc_feature (104)..(104): Xaa is any aa, unknown, or other
MATRIALCLLGHVLLAVASMAVAAAAGDAGKIGICHGRVGSNLPPPSAAPALLKRNGITKARLFLPDPDVLPAFAAAGIDLMVGVPNENLTFLAAARPEGAGXXLRSAVLAQAHPEPGRVPSPVRQRGCCTTIRFYAPSTSMPDHG

SEQ ID NO: 42522 - DNA, 577 bp, Zea mays
  misc_feature: Ceres CLONE 1440994-F
  misc_feature (317)..(317): n is a, c, t, g, unknown, or other
  misc_feature (359)..(359): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgcgccgtgctctgcacctcgggtcactgcacctcngtgcatctcccacgcgtcacctggcgcgccgtcactgcaccncgggcatgggcgccgccgtatttgcccgccacatgccatactatcaccggccggcttagctatcccagcaaaccttgcggggcaaaagccgttcaaaccctgccaatttagggaacctgggggttgggacccccccaatccgggccaagggccaaaatttccaagggattttggggccccaaaggggaaacccctttgtgtgtcccccaagagggccc

SEQ ID NO: 42523 - DNA, 686 bp, Zea mays
  misc_feature: Ceres CLONE 1440997-F
  misc_feature: Encodes the peptide sequence at SEQ ID NO. 42524
agagctggagctccccgcggtggcggccgctctagaactagtggatcccccgggctgcaggaattcacacgagaccattacctagaacatcctaatcgaaaaatgaacgaactatctatcgtagcacgctagcacgcatctgttcccgtctcctcaggctccgtctcaaactcgcccggtcatcccatctccaccaccacatccgtcctcttccgccgccgccgatggcccgcctcctcacacaaaccctcaccctagcccgtcccgccgcctcctcctcccccaccgccgcattcgcctccctccgttgcctcgctaccaaggtcgagatcgtcgagatcgacctcaccgaggaagacgctggctcctcggcccacggctcctccccctcgtccccatcgatcgaggtggttgggatccggcgcctggaggaggccatccacggcgtcatggtgcgccgcgccgctcccgattggctgcccttcgtgcctggagggtcctactgggtgcccccgctgcgcctcccgcacgaagtcaccgcgtttgtcggccggatcgcgccctcaggaagcccctccggggtcgccaaattcatggacggtggtcccgccccctgggggccccggggccgttgggcggccccttccaagtcgtggaactcaacaacaaccagctcctggaggagg

SEQ ID NO: 42524 - protein, 154 aa, Zea mays
  misc_feature: Ceres CLONE 1440997-F
MARLLTQTLTLARPAASSSPTAAFASLRCLATKVEIVEIDLTEEDAGSSAHGSSPSSPSIEVVGIRRLEEAIHGVMVRRAAPDWLPFVPGGSYWVPPLRLPHEVTAFVGRIAPSGSPSGVAKFMDGGPAPWGPRGRWAAPSKSWNSTTTSSWRR

SEQ ID NO: 42525 - DNA, 685 bp, Zea mays
  misc_feature: Ceres CLONE 1440998-F
  misc_feature: Encodes the peptide sequence at SEQ ID NO. 42526
aaagctggagctccccgcggtggcggccgctctagaactagtggatcccccgggctgcaggaattcgcacgagaccattacctagaacatcctaatcgaaaaaacaccaccgctcgactgctctcaccgaccagcgctgcgccactcctccgccggatctccagcatgcagccctcctcctcgtcctcctccgctcacccgcccgaccatcccaactccaagcccccggccccgccggcccccgccatgggctaccccgccaaccccgcccccaacgggaaccccagcgcctacttcgccgccgcgccgcccgccgccgccgccgccaacggctccgctccggcgtccttcggcgtcgcctacccctaccccgcccctcctcaccaccatcacccgccgccgcaccaccactacccgtaccccccgcccccgccgacgcaccaccactacgcggcccacccgccgccgccgcccacctgcctgcgccgcctcctcgccgccgtcgttggcgccttccttctcctcggcgccgccaccttcatagtctggctcctcctccgcccgcgcgccccggccttctccctcacctccctggccctctcccgcgtcgcttactcccccgccaactcctcactctccgcctccttcgacgctgccctcctcgccgccaaccccaacgccaagt

SEQ ID NO: 42526 - protein, 173 aa, Zea mays
  misc_feature: Ceres CLONE 1440998-F
MQPSSSSSSAHPPDHPNSKPPAPPAPAMGYPANPAPNGNPSAYFAAAPPAAAAANGSAPASFGVAYPYPAPPHHHHPPPHHHYPYPPPPPTHHHYAAHPPPPPTCLRRLLAAVVGAFLLLGAATFIVWLLLRPRAPAFSLTSLALSRVAYSPANSSLSASFDAALLAANPNAK

SEQ ID NO: 42527 - DNA, 676 bp, Zea mays
  misc_feature: Ceres CLONE 1440999-F
  misc_feature: Encodes the peptide sequence at SEQ ID NO. 42528
aagctggagctccccgcggtggcggccgctctagaactagtggatcccccgggctgcaggaattcgcacgagaccattacctagaacatcctaatcgaaaacttcaaaaatcaagttgattatgcggataccgcaaacactgcaaattcggttgttccctacccttctagagtaatctctccacacacacactcacacgctgctgccggctgccctcctcccgccccactcgtcccctccgaaccaagtccgatccatccatccccaaatttctcctctcagcgcgtggggcagtggcggcggcagcgtgggcgcgcggaccgctacgggcacgggagcagcggtggctgcgcaggcagctgtcagcatgcggcatggtgactacgggagcccaggcggcgccggtgcggctgcagccggcggcgggcgaccgtgaggcggctgcgggagcggtgaagtccggtggcgcctgctttgttttgtgttcctatttttgatttgcgaaaggatccaagagagagaggagggggagaaggcgagaatccaagacaagagcgagcatggagtttgctacgggtgccatgggtaccctcctccccagctgggcatgctgctgcaggaagaactccacctgaagaaatatgtgaaggaggggatcaagagcgtcactgccgaa

SEQ ID NO: 42528 - protein, 40 aa, Zea mays; identical to SEQ ID NO: 38508
  misc_feature: Ceres CLONE 1440999-F

SEQ ID NO: 42529 - DNA, 682 bp, Zea mays
  misc_feature: Ceres CLONE 1441007-F
aagctggagctccccgcggtggcggccgctctagaactagtggatcccccgggctgcaggaattcgcacgagaccattacctagaacatcctaatcgaaaaagaaattcgtaactagagaaccgtaactccggtttgatccattcgaattgcgttggattcataataatatcgtctgtacagtatgacactaacatatatcacaccccatacttttattattagaaatttgtctagcctatgtttaatagattaacccctctaattgaagttaacctctccataattatagtttgattaaaatatgatttctagttaagttataattaagattaaagttgaattaattattaatggaatattctctcatatggtgcatactaatcaatttataatatagtttaatcacatagatcttccataaatcataactccttaaccatgactccgatcttactagttctcgaacccacgatctcgtagcgacgagtagatcattattatgcaatttgttcttatgtttggggtgatgttaattattcccataccatgtttgtttgtaattgctatgactagtagtgaggtcacgagaatcctaagatcattctggatacctgggatctcaagtccccagaaagttagccccttgaatcactttatttacccaaaaatgttcttttaaa

SEQ ID NO: 42530 - DNA, 541 bp, Zea mays
  misc_feature: Ceres CLONE 1441011-F
  misc_feature (344)..(344): n is a, c, t, g, unknown, or other
  misc_feature (348)..(348): n is a, c, t, g, unknown, or other
caaagctgggagctccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatgggcggaacccgtgaccgcagcggcatctacggcggcggccacgcccacctacggggcaagcaccagcacccggggaaggaagggggggcgccccaaaaggggggggaaaaacacagggaaaaaaaaaaagggnagtnttcctccccaaaaaaggggcaaaaaggccccggggggaaaagggggggaacttttccccccggggggggggggggggggttgtttgggggggccccaaaacaccccccggggggggggggggggggcccccccccggttttttttattaataaaaaccggggtggtccccccccccccctttttttaaaagac

SEQ ID NO: 42531 - DNA, 665 bp, Zea mays
  misc_feature: Ceres CLONE 1441017-F
  misc_feature: Encodes the peptide sequence at SEQ ID NO. 42532
aaagctggagctccccgcggtggcggccgctctagaactagtggatcccccgggctgcaggaattcgcacgagaccattacctagaacatcctaatcgaaaagtttttaactaagctttaatggccttctctctatatataaacggttagtgatcttttcaggttactaaaatccaccaaaaaatgtctctagtccattatgccatcctcgtggcacttcttgtcatctccgccaatgcagtctctcctccagagaagttgaaacccaaacaaaccgttcctgcttctcctacaatctctgctgccgccaaagctttcaccgacgcgcacaacaaggccagagccatggtaggtgtcccaccgctagtatggagccagacgctggaggcggcggcgaaccggctggctcgttaccagaggaaccagaagaaatgcgagtttgcgagtctaaaccctgggaaatacggcgcgaaccagctttgggccaaaggtttggccgtgacgccgactcttgcggtggagacatgggtgaaggagaaacctttctacgactacaagtcggacaaatgtgccccgaaccacacgtgtggtgtctataaacaagtcgtgtggagagactcaaaggagctaggctgtgctcaaagcatgtgtactaaagagtcacc

SEQ ID NO: 42532 - protein, 160 aa, Zea mays
  misc_feature: Ceres CLONE 1441017-F
  misc_feature (46)..(160): Pfam Name: SCP Pfam Description: SCP-like extracellular protein
MSLVHYAILVALLVISANAVSPPEKLKPKQTVPASPTISAAAKAFTDAHNKARAMVGVPPLVWSQTLEAAANRLARYQRNQKKCEFASLNPGKYGANQLWAKGLAVTPTLAVETWVKEKPFYDYKSDKCAPNHTCGVYKQVVWRDSKELGCAQSMCTKES

SEQ ID NO: 42533 - DNA, 677 bp, Zea mays
  misc_feature: Ceres CLONE 1441028-F
  misc_feature: Encodes the peptide sequence at SEQ ID NO. 42534
  misc_feature (278)..(278): n is a, c, t, g, unknown, or other
  misc_feature (498)..(498): n is a, c, t, g, unknown, or other
  misc_feature (501)..(501): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacggccggggcggaggacggagtggtcgaacgggaccgcaaggaggacctgcggtggtgcaagcaggcgtgcgagtggcagtacggaaaggacaccccgcggaagagggaatgctagagcgagtgccgcgagcggcaccagcaagctgacgcgggcgaggacggcgacagcggcgtggacgcctacgtctcccgctccgggaggggcgagtgccngcnccagtgcctgcgccgccacgagggcagccgtgggagaccaggagtgcatgaggcggtgctcccgccgcggactggccgtcgacatggagcaagaatacggtcgcggcagcaagagcgccggcaagtgccgggagaggtgccagcgccacccccgcggggactgttgggaaaggcac

SEQ ID NO: 42534 - protein, 63 aa, Zea mays
  misc_feature: Ceres CLONE 1441028-F
  misc_feature (24)..(24): Xaa is any aa, unknown, or other
MGKGSVGASWWAFLLLAGVLLVVXATAGAEDGVVERDRKEDLRWCKQACEWQYGKDTPRKREC

SEQ ID NO: 42535 - DNA, 664 bp, Zea mays
  misc_feature: Ceres CLONE 1441030-F
  misc_feature: Translation starting site: 212
gctcttgaactagtggatcccccgggctgcaggaattcgcacgagaccattacctataacatcctaatcgaaaagaggcccccgactgcgaactcgggactcgccaaccgagaaggaagaactagtcgcgaggtgaagaggagaacctgaggtggtccctaatcagagacggaagaaggtgggttcaggagcaagccagtctgccgccgccatgaggcgcacctcgaagaaatcgtcgtcgtctacggcgacagccatcgctggccctactaaagcagtttccaaggaagtagaacggattgatcaatttttttatacttacgctgataactcatctaggcatgattgacccagaaagtagttgaaacactctgttctcaccttgaagttccccacactgatgttaggattctaatgatagcatagaaaatcgtggctgtgataagcaaggttattttaccttggatgaatggagaactggcttgaaagctcttcgagctgacagtattagtaaactgaagaaagcatttccagaactggtccaagaggttacaaggccatccaatttccagagattctacatatatgcatttccttattgcctcacatacgataagaacaaatgtatagaaatactagttgcttgcgagctgctgaatctact

SEQ ID NO: 42536 - DNA, 686 bp, Zea mays
  misc_feature: Ceres CLONE 1441039-F
  misc_feature: Translation starting site: 226
  misc_feature (396)..(396): n is a, c, t, g, unknown, or other
  misc_feature (465)..(465): n is a, c, t, g, unknown, or other
  misc_feature (515)..(515): n is a, c, t, g, unknown, or other
aaagctggagctccccgcggtggcggccgctctagaactagtggaatccccgggctgcaggaattcgcacgaaaccattacctagaacatcctaatcgaaaaatcgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaaaatgaccgccaaggccgccgcggcggcggcggcggcggcggcggcgaaacctgccacgagggcgtacgtgacgttcctggcgggcgacggctactactggaagggcgtggtggggctggcaaaggcctccgcaaggtccgctcgncctaccccctggtgggtgccgtgctgcccgacgtgcccgagtcccaccgcgcatcctcgtctcgcaggnctgcgtcttccgcgagatcgagccgtgtacccgcctaaaaccagaccagntccgcatgggttataagtaatcaataatccaagtcccaatttgaagttcctgggtaccaaaagaagggttccctgaacccgaaactccaggtttcaaaaacttcccggctgttccaaactcaaaaaggtacctcaccccggaaaggctgttttccaaaaaaactgaacccc

SEQ ID NO: 42537 - DNA, 783 bp, Zea mays
  misc_feature: Ceres CLONE 1441049-F
  misc_feature (11)..(11): n is a, c, t, g, unknown, or other
  misc_feature (118)..(118): n is a, c, t, g, unknown, or other
  misc_feature (213)..(213): n is a, c, t, g, unknown, or other
  misc_feature (669)..(669): n is a, c, t, g, unknown, or other
  misc_feature (774)..(774): n is a, c, t, g, unknown, or other
  misc_feature (775)..(775): n is a, c, t, g, unknown, or other
ttctcctgttntcttgtacccctatgctgtgagatttttattttgggcgcaattgtttactcaccacaggtggagggccgctctattactagtgggtcccccgggctgcaggaattcncactacaccattacctatgaaatcctaatcaaaaaacggacggatcccgctgagattagttcgggtatcatttcttacgtcgcgcacgaaagtantaaactccttgcgaccctgcccgccgggcctacaatccttctttttgactggctggctggttggttggttggttggttggccggtcggtcggtttctctacatctctcgctgctttgtgtacgtcactggtttttgctccaagaacgaactcactcacactcactcactcggagcttctcttcttagaaattaggcctgtgagaacgcagcacattggctagccagcaggttctttcttcactagatcttttgctgcttgtccgtttgctgcgttgttacagtaggtttagttgatgttctagttgctgtagtagttctcaagcttttgcatcttaattttgctgttattctcgctggcgctctgcacggatcgatgggggttaagctagtgtgcttcctcctggggttcagggagcagctataagcggcagagcagcgccagccagcggatgtcngttgtggttgttgttagcctgataattaagcggatggggacaggagtctttgggtcttttttaaaaaaaaaaaaaaaaagcttatcgataccgtcgacctcgagnnggggcccg

SEQ ID NO: 42538 - DNA, 739 bp, Zea mays
  misc_feature: Ceres CLONE 1441051-F
  misc_feature (26)..(26): n is a, c, t, g, unknown, or other
  misc_feature (442)..(442): n is a, c, t, g, unknown, or other
  misc_feature (443)..(443): n is a, c, t, g, unknown, or other
  misc_feature (468)..(468): n is a, c, t, g, unknown, or other
  misc_feature (488)..(488): n is a, c, t, g, unknown, or other
  misc_feature (503)..(503): n is a, c, t, g, unknown, or other
  misc_feature (575)..(575): n is a, c, t, g, unknown, or other
  misc_feature (576)..(576): n is a, c, t, g, unknown, or other
  misc_feature (614)..(614): n is a, c, t, g, unknown, or other
  misc_feature (635)..(635): n is a, c, t, g, unknown, or other
  misc_feature (636)..(636): n is a, c, t, g, unknown, or other
  misc_feature (643)..(643): n is a, c, t, g, unknown, or other
  misc_feature (684)..(684): n is a, c, t, g, unknown, or other
  misc_feature (715)..(715): n is a, c, t, g, unknown, or other
gtgggggcggggcgctttagagtagntggagtccgcgggctgcaggaattccgacgagaccattacctacaacatcctaatcgaaaaaattttcggaaaatcttcaccgtccttcagcaaatattacttttggatcaaggattgggagtgcttccagttctggttctacagtactgatacctgcttcacaagatcccagtacaagcttgataggaagtgattttcctgagccccttttgttaggttctttgtttacagctgattcaacaaatttcttatctgcatctggaaacagaagtaaccagcaaaattctggatccagctctagttccatgcttagacctgctgtaaatgttgcagctcaacaagtccctgggttcaacgtatctcagccaagtacaactctaagaggttcagctgatgtgtctaggaggtccttaanngctgctggtgtttctcattttagangttcaagcatgggattgcancaccgtgggacttcntccacaccgtatgagattcggagtcaccagccaggatcaaggctctcgtgcccatcagatggcattaagacnnggtcattcctccatagacacgcagagctcctgttactngggacctacaaacttttatgnnttcattnccttcaacggaagggagccatgcgaattgtaaccacatccntaaacgctttttgaccagaatcacccagggnaacaaaaccccacatattgaagga

SEQ ID NO: 42539 - DNA, 601 bp, Zea mays
  misc_feature: Ceres CLONE 1441068-F
  misc_feature: Encodes the peptide sequence at SEQ ID NO. 42540
tggcggccgctctagaactagtggatcccccgggctgcaggaattcgcacgagaccattacctagaacatcctaatcgaaaaaggtacacatcatctcttccaaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaagaccgtcacccgcatggacgtcgtctacgccctccagcgccagggtcgcacccttctacgggatttcggggggctagaaaaggccctaccccccccttggggggccctgggcaaaaatttttgggggcccgggccaaaaaaaaaccaaagaatttttcggggaagaccggggcttaaattttccccaaaatttttttttttcccacagaggggggt

SEQ ID NO: 42540 - protein, 151 aa, Zea mays
  misc_feature: Ceres CLONE 1441068-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTRMDVVYALQRQGRTLLRDFGGLEKALPPPWGALGKNFWGPGPKKNQRIFRGRPGLKFSPKFFFFPQRG

SEQ ID NO: 42541 - DNA, 711 bp, Zea mays
  misc_feature: Ceres CLONE 1441075-F
  misc_feature (604)..(604): n is a, c, t, g, unknown, or other
gggctgcaggaattcgcacgagaccattacctagaacatcctaatcgaaaaacctgtgttgttctcccgtgataaataaacccgggcctgtgcaggaggaggctccgcgtggaggcgatcaggacgcagcgggagaagcagcggacggaggtgcccgtcgaggagtccgcccccgccagggacgccgccgcgcccctggacggaaacggagccgtagcggacggctccgtggttccttcctcggacgacagctgggttatcaagctcgagcagtcgttcaacattttcgctacggattcggtgattatggtactcaagggcgtgtatggtgatcggtactacgccaggttctttgcgctggagacgattgcgagggtgccgtacttcgcattcatatcggtgcttcacttgggtgcgacctttggatggtggagacgagctgattatataaaggttcactttgcgcagagctggaacgagttccatcacctcttgatcatggaagagttggggcggcgctccgcgtgggctgggctggtggtcgggcgggggggggggggggtgtgggggggcggggaggggtgtcccccccctcggggggggnggccaaaaaaaagaaaaaaattttttttttgtttggggggggcctttttttttttttttttattgggcgggggggggggggagaaaaaaaagggggtccgcgccccc

SEQ ID NO: 42542 - DNA, 668 bp, Zea mays
  misc_feature: Ceres CLONE 1441076-F
  misc_feature: Encodes the peptide sequence at SEQ ID NO. 42543
  misc_feature (510)..(510): n is a, c, t, g, unknown, or other
  misc_feature (624)..(624): n is a, c, t, g, unknown, or other
tcccccgggctgcaggaattcgcacgagaccattacctagaacatcctaatcgaaaaaggtcatgtcaggccaggcatcttgggcaacagcaactggcaacagccgggccttttgagcgtgctctctctctctctctcccctatccgtgctttgtgcctgtttggtgcgcgtccacctttcggggtcaccggcttctgctttcttgctacgccaccgcgcctctcgtctatttatggagtcccccgatccatgaagccggtgcaggccgagagttgtcaacgacgacgtctgccggcagtgctcctgctcctcctcctccttcccggccgccgcgcgagcttgggttagtgtctcttcttcgcggaggcctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaagnagcagaaggtgacagtcaaaggcaatgtcaagcctgaggacgtcttccagacggtttcccagtcggggaagaggacctcgtactgggagggcgaagccacggccccggacgctngcggcgctccagagccgaacagctcccagcaccgcgcagaagcc

SEQ ID NO: 42543 - protein, 93 aa, Zea mays
  misc_feature: Ceres CLONE 1441076-F
  misc_feature (7)..(68): Pfam Name: HMA Pfam Description: Heavy-metal-associated domain
  misc_feature (41)..(41): Xaa is any aa, unknown, or other
  misc_feature (79)..(79): Xaa is any aa, unknown, or other
MAAVETVVLKVAMSCEGCAGAVRRVLSKMEGVETFDIDLKXQKVTVKGNVKPEDVFQTVSQSGKRTSYWEGEATAPDAXGAPEPNSSQHRAEA

SEQ ID NO: 42544 - DNA, 693 bp, Zea mays
  misc_feature: Ceres CLONE 1441092-F
  misc_feature: Encodes the peptide sequence at SEQ ID NO. 42545
aaagctggagctccccgcggtggcggccgctctagaactagtggatcccccgggctgcaggaattcgcacgagaccattacctagaacatcctaatcgaaaaaatcgaaaaacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgat

SEQ ID NO: 42545 - protein, 176 aa, Zea mays
  misc_feature: Ceres CLONE 1441092-F
  misc_feature (1)..(175): Pfam Name: Zein Pfam Description: Zein seed storage protein
MAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLQQLVLGNLAAYSQQQQFLPFNQLAALNSAAYLQQQLPFSQLAAAYPQQFLPFNQLAALNSAAYLQQQQLPPFSQLAD

SEQ ID NO: 42546 - DNA, 725 bp, Zea mays
  misc_feature: Ceres CLONE 1441100-F
  misc_feature: Encodes the peptide sequence at SEQ ID NO. 42547
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcgaaaaaagaggcgagaggagagagcaacgacgccatcggagggaggaaagagaagaagacgatccgctagcgtgtgcgtggcgacgagatgtggcggaggcgagtgggcgccctcctccgatctccacgaacttcttcctcggcctcctcggcctgccagagccgccgccaccatcttctccccagcgaggaacctcttgctctcaaccgtcttgccaggctcttcacgtcccaggctggaagtgatggtggcgatacccagaagccctttattgctttttgtctaggtggtcctgggagtgggcaaggaacacagtgcactaagattgcttcggatttttggattgcccatctgaccgctggtgatattctcggactgaaattacctctggcntgagaaaggggaattgatcctaaattcttaagggagggaggatttgtccctcctgaaatcctggggaccccctcaaaaaaccggggaaatggaccaggctaaaagggttttttttgagggcttcccagggggtgggagaaaaaaaaatcccctttaaaagggttttgtgggaaaaccccccaatttgggatttttcttgggggccccgggggaaagagggggaaaacccctcct

SEQ ID NO: 42547 - protein, 102 aa, Zea mays
  misc_feature: Ceres CLONE 1441100-F
  misc_feature: SWISSPROT Homolog: EC 2.7.4.3 Adenylate kinase
MWRRRVGALLRSPRTSSSASSACQSRRHHLLPSEEPLALNRLARLFTSQAGSDGGDTQKPFIAFCLGGPGSGQGTQCTKIASDFWIAHLTAGDILGLKLPLA

SEQ ID NO: 42548 - DNA, 779 bp, Zea mays
  misc_feature: Ceres CLONE 1441102-F
  misc_feature: Encodes the peptide sequence at SEQ ID NO. 42549
  misc_feature (29)..(29): n is a, c, t, g, unknown, or other
ggggccccgggccccggaggcggaggganttgttggcaagaaggccaagaaacagagggcatcccggtgggggggggccccacattaaaggatggcccgggctgggggagtgggcacgagaccattacctacaacatgcgaatcgaaaaagtgttcgccagagccaagcccctagtagccacctcgctccagaagctttcctcccctagatctccctcccgtgcccggtcgcgctgccgacccggccatggcgaccaaggggaagctcggggagctagtgtgggagcaccgggggcaggcggccgcagcggtggctttcgtggccgcggccgccgtgtcgatctccgccgtcgggcccaggctcggcgccgtggtgtcattcttctggccgctgctcgtctccacgggcctcttcctggtggaggtcgccggtgctgctccggatctcgccgccgcccgagggcgaccaccaccagggcgggaaggagctcatcgacttcgtcgccgggagccggcgggagcacctcgtcccggatgcggcgccgccggcggccgtagcccccgtggaggctccgcccgagctgcagatctaacgggctgccggaggaggaggctgacagcagcctacctgtgctgtgtgctgctgcggggcatggcgtgctccggccccgggtgaacttcctccaggggcacgggtgggggcaaccgttgcggggccacctgtaaatggcaggccggcgggcccccggggcctgggtaccctaagacttctcccatgg

SEQ ID NO: 42549 - protein, 142 aa, Zea mays
  misc_feature: Ceres CLONE 1441102-F
MATKGKLGELVWEHRGQAAAAVAFVAAAAVSISAVGPRLGAVVSFFWPLLVSTGLFLVEVAGAAPDLAAARGRPPPGREGAHRLRRREPAGAPRPGCGAAGGRSPRGGSARAADLTGCRRRRLTAAYLCCVLLRGMACSGPG

SEQ ID NO: 42550 - DNA, 732 bp, Zea mays
  misc_feature: Ceres CLONE 1441111-F
  misc_feature: Encodes the peptide sequence at SEQ ID NO. 42551
  misc_feature (410)..(410): n is a, c, t, g, unknown, or other
  misc_feature (432)..(432): n is a, c, t, g, unknown, or other
  misc_feature (445)..(445): n is a, c, t, g, unknown, or other
aagctggagctccccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagccctcagattcccctggtaggctngtggtgtaaatctgcctgcggnatcagctcctgcngcagctgctccctgcgatgaagctgaggacgatgatgaccttgatctttttggtgatgaaactggagaagacagaaagcacctgatgagcgtgcccccctgccagggcttttctaaaaagaaggaagggggaactcccccggcttatggaggtcaaccctggccctatgaacctatttaaaaaacttgggggggcttccccccttcccaaaggggggtctaaattgggaacaccaaaccttgggccgttgggacgcgtcaaaaaaagaaattcgggggaaatttcca

SEQ ID NO: 42551 - protein, 70 aa, Zea mays
  misc_feature: Ceres CLONE 1441111-F
MAVFSDLHTADGLKSLEAHLAGKTYVSGDSITKDDIKVFAAVPSKPGAEFPNAARWYETVSAAVALRFPW

SEQ ID NO: 42552 - DNA, 731 bp, Zea mays
  misc_feature: Ceres CLONE 1441118-F
aactggagctccccgcggtggcggccgctctagaatagtggatcccccgggctgcaggaattcgcacgagaccattacctagaacatcctaatcgaaaatccaaccctagggtttccatccggctcttccggaagcttccgaaaatgggcaccgacgagttcgcccaagccgttcgccccggccccggccgggggcgaccactccccgggctttctgtttaaaaattggagccctaaagaaagcacccttgaaacggtgggggggggccccccctgagaaaaccccccggggggaacacatttttttaaaaactattgggggggggccgcgcccacaacaccaaccccgggggggggcataaaagggaggaggtttttttacccccgcctccttaggggggggggccccccctccccctcccccaagaggaggaaaaaaaggtctctcttttttttccccccaggggggggggcccccccctccactcttcaataacacccccccccgaaaacagagtttgggggggagacccctccacaaaagggggcttctttttctccacaaaaaaaaaaaaaccccaccccccgggggggggggaggggcacccaacaccctctttttttttttttttctctacccgccactgggggcgtgcgtgttcccacatctagattcacttccccggagggtatccctttaacccctcccttatccatttctatggccctaa

SEQ ID NO: 42553 - DNA, 697 bp, Zea mays
  misc_feature: Ceres CLONE 1441119-F
  misc_feature: Encodes the peptide sequence at SEQ ID NO. 42554
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaactaaatcctcggttcccaaatggcgacgccgccgactgcgctgctgttgctcctcgcggcggcagcggcattccacggcgcgacggcgaaaacgacgatcgagccgtgctctggcgcggacgcgtgcccggctcttctgggctacaagctctacgcggaacatgaaggtgtccgaggtggcggcgctcttcggcgccgacccggcagcggtactggctgccaacgcgctcgacttcgcctctccaggcgccgccaaccgcatcctcttcgcgggaaaacccctccgcgtgcccacccgctgcgcctgcgccgacggcgtccgcaagtccgtcgccatccgctacgccgctcggccttccgacacgctcggctccatctccgaagtcgtcttcgccgccttcccctcggcgaacagatccgcactgctacgggctcgccgcgaagaactccgaccgtcgctcacctggncaggagtcgtcatccgctccctgggttggttcactcacgaaaaaacctcccgttgggacttccaaggccggcagtcgggaacctggaatcatgccccgcaaaaaacccgtattgaattggatggaac

SEQ ID NO: 42554 - protein, 144 aa, Zea mays
  misc_feature: Ceres CLONE 1441119-F
  misc_feature (103)..(103): Xaa is any aa, unknown, or other
MKVSEVAALFGADPAAVLAANALDFASPGAANRILFAGKPLRVPTRCACADGVRKSVAIRYAARPSDTLGSISEVVFAAFPSANRSALLRARREELRPSLTWXGVVIRSLGWFTHEKTSRWDFQGRQSGTWNHAPQKTRIELDG

SEQ ID NO: 42555 - DNA, 823 bp, Zea mays
  misc_feature: Ceres CLONE 1441123-F
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tttgtgttgggtgntggnnnggggnnnnnnnnnnnnttnatttcccnnnnnnnncaaactggagctccaccgcggtggcggccgctctagattagtggatcccccgggctgcaggaattcttacgagaccattacctagaacatcctaatcgaaaaatatagcggatcctggcccgatccctcttcccacctacctccgcttctctccaagtgaggaaccccaagccctcgccatggcgtcgcggatcctggcccgatccaagtcccttcacctcgtcgccgccctcacccctgccgctgccaaagcaacaacgcctatcgccggaacccgcgcgctcgcgtccctgccccgctacccgtctgccccgtcgccccatgggctcggcaaggttctgggatatgaaccaacctctcacctcagtggaccacgagttttacctcgttgggtatcgtctctagcatccactacatctccccccccggggtggcggatctctgagacatacccgtcaggtggtgaaatgaaacagtctgagacccggaaaatcaggtgagggaacccacacccaaaagtggtgggcgttcactcccgctacaaagcccctatcgcctaaaccctgggagctagggccccttgaccagtgaaaagttctaaaagtaagggggatcagagactggccaccccaggtccccccttatagatggatcgccaggcccaggcttccttgccccccaaagaaccggattaggtcccctcccctgcctggtccggcgcccgtgggttcccatgagaggatacgagggctcccccgagggaggattc

SEQ ID NO: 42556 - DNA, 711 bp, Zea mays
  misc_feature: Ceres CLONE 1441124-F
  misc_feature (565)..(565): n is a, c, t, g, unknown, or other
  misc_feature (578)..(578): n is a, c, t, g, unknown, or other
  misc_feature (579)..(579): n is a, c, t, g, unknown, or other
  misc_feature (588)..(588): n is a, c, t, g, unknown, or other
  misc_feature (596)..(596): n is a, c, t, g, unknown, or other
  misc_feature (613)..(613): n is a, c, t, g, unknown, or other
  misc_feature (642)..(642): n is a, c, t, g, unknown, or other
  misc_feature (671)..(671): n is a, c, t, g, unknown, or other
tggagctccccgcggtggcggccgctctagaactagtggatcccccgggctgcaggaattcgcacgagaccattacctagaacatcctaatcgaaaaagatggctgagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctccagccatcggcgcccgccctcctccgccgagacgccgagtgccgagcgcccgagcaccccggtccccagcgcccaacaagctagcaggctgcaggtatgcgctctttgttgatgcgtccaaggagttgagctgaatgcccagaaggctagcaggctgcagaaactgaaggaaaaggcggcattcangaaccccgatganngtctatttnaaatgatncacagtaggactgtggntggaattcaaagaccctagcctgaagatnataagtatactgaagaagaacttcatctngtgaaaaaataagatatggatatatcctttaaagcggtca

SEQ ID NO: 42557 - DNA, 679 bp, Zea mays
  misc_feature: Ceres CLONE 1441125-F
aagctggagctccccgcggtggcggccgctctataactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagcttgaagagatgcgtactgctcatgttgtctcaattggctcagaatcattctgtgacttgaatcctcattacaaagcaggaagaaaaactgagtttaccttggatactcgaacaagtttggcactttttgggtctttcactgcaactgattatgtggcttctcaaagtataaggaggaggataatgcattatcacatggaagctttcaagaaggtcaatgtcatagcaactcctacaactggcattactgctccaaaaatacctccaagtgctctgaagtcaggagagtcagattatgttgtgtcag

SEQ ID NO: 42558 - DNA, 682 bp, Zea mays
  misc_feature: Ceres CLONE 1441126-F
  misc_feature: Translation starting site: 198
gctctagattagtggatcccccgggctgcaggaattcttacgagaccattacctagaacatcctaatcgaaaaaggaaagcaaagcgcttcgcaagcacaggcagtgatcggtaaccaaatccggacagtcttgagctctctcagtctcagcatttcagttcccagattcacatagccccagcccccaagtagcgaaatggcagctgctccgttcgcgattgccggccggctctcccccgttgcgcgcctcccggtccgcgcctggaggcccgcgcacgggtttgcgtcgtccggggagagcccgctcggctcggccgttggcgtccgcggcgcaggagaacagggaaaaaaagttgtcacgtacaggttagccagaacggcgggaaacgggcaccaggccaaaccctgtggagggcccccccgccccgggggaaaggggttcaaaaatctccccatcccctttcgggttatttgaatccgatggccccaaatggcaaaaatccgccaaatgctgaaaacaatggaaagggttgttttaacaaacgcgggggggttcccccgggggaaaccgggaggtccccggggaaaacacgggggaaaaatcccccggggcggggggatccttggggggcacccaaaaggggggtaaagaagccagtttcgttgttgccggggccgccg

SEQ ID NO: 42559 - DNA, 720 bp, Zea mays
  misc_feature: Ceres CLONE 1441127-F
  misc_feature: Translation starting site: 359
  misc_feature: Pfam Name: FAA_hydrolase Pfam Description: Fumarylacetoacetate (FAA) hydrolase family
  misc_feature: SWISSPROT Homolog: EC 3.7.1.2 Fumarylacetoacetase
  misc_feature (667)..(667): n is a, c, t, g, unknown, or other
aagctggagctccccgcggtggcggccgctctagatctagtggatcccccgggctgcaggaattctcacgagaccattacctagaacatcctaatcaaaaagaatgggtgttggtatcggttgcagcgtggaaatagttaattgaggatctaaggaaactggtctggtactgagtagtgactatagagtacaaaataactggtgtccttggtgctgcatgcaggagacgctcaacatgttcttggggatgggccggccggcgtgaagggaggcgcgcgccacgctacagaaaatcctatcagccgacgagcccgtcttgcgtgacaacgaagcactgaggaacaagtgtctggtaccaatgagtgatatagagatggttctaccaatcacggttggaggttacacggacttcttttgttctgtgcaccatgcaattgattgtgggatcatcttcccagggccgcagactccagtcaatcccaataggttttatcttccagtaagatacaaatgggccagcatcatctatagttgtgtctggaacccatggtcttaggcccaggggacaaagacatccaaaagaaactcccgctccttattttgtccctcccaaaagcttgatttgagcttgaaatggctgcctttgttggtcccgggaaatgatttngcaaactatttgaattatggccccaaaaaaccttttttgggcctactttaaag

SEQ ID NO: 42560 - DNA, 758 bp, Zea mays
  misc_feature: Ceres CLONE 1441128-F
  misc_feature (427)..(427): n is a, c, t, g, unknown, or other
ggagctccccgcggtggcggccgctctagtctagtggatcccccgggctgcaggaattttcacgagaccattacctagaacatcctaatccaaaaaaacggttaaggcacaacgaataagagagatcaactactcatgcaggcactgcggtatttaatttagattcttaggaacaaaaacaccaagcaccaactttgtacatattaatggacaccatgcacatggtgatctatcggtctatatagaaagacaggcgggtactagagaagttgtgtggtgtccaagctacgcacgggatgctactaactagctgcacgcaacggcgaggaatggcaagcctttcatgtgctcgggcggacggtgttgtctgttccggccctctgcccggcaagctgttgctgtgcgccagctgctgcttccctacggnggctccgggcccggaccgataattgcaggtgcttgcctgcccccatcatctccactcctttgcgaggggtcaagattccctttccccagcgcccctggcagtcccattcctcaggctcggccgcttcccccaggggcccgaaacagctggggccttggaaagggtccaggctgcccttccaacctccgggttccgcaggggttcttaaccggggccccccctttaacccccccgccccgggcggaattggtacaaaaattatccccttggcaaacaggataccaatctcccaaaaaccttgtccttggaacaccataaacctcccgccttg

SEQ ID NO: 42561 - DNA, 672 bp, Zea mays
  misc_feature: Ceres CLONE 1441138-F
  misc_feature: Encodes the peptide sequence at SEQ ID NO. 42562
tccccgcggtggcggccgctctataactagtggatcccccgggctgcaggaattcgcacgagaccattacctagaacatcctaatcgaaaaacaccgcttgacgggagaaccttgggtctcctatcctccccacccgtctctcggtctcttccccaccgcgtcttcgtcgtctcgtcttcctgcctccttcgcccgagaaaggagagaataggggagcacccagaaaaccgttgccgcttacggagagtacacctacgctgagctggagagggagccctactggccgagtgagaagctgaggatttcgattactggggctggtggtttcattggatcccacattgctcgccgtctgaagaaggatggccattacatcattgcctctgactggaataagatcgaggacatgaccgaggacatgttctgccatgagttcgacctcgttgatctgagggtcatggaccactgtctcaagagtcacccagggcgtcgaccctgtctccgatctccctgctgacctggggggcctgggtttcatccagtcgaatctctctgggatcgtgtacgataccccgtgatcagctgttaactcctgaaagctgcccgtatcaatggtaatgagatggtcttctactcgtctggtgcagattttccccctctagtcaggcggc

SEQ ID NO: 42562 - protein, 36 aa, Zea mays
  misc_feature: Ceres CLONE 1441138-F
  misc_feature: SWISSPROT Homolog: EC 5.1.3.18 GDP-mannose 3,5-epimerase
MTEDMFCHEFDLVDLRVMDHCLKSHPGRRPCLRSPC

SEQ ID NO: 42563 - DNA, 701 bp, Zea mays
  misc_feature: Ceres CLONE 1441140-F
  misc_feature: Encodes the peptide sequence at SEQ ID NO. 42564
  misc_feature (694)..(694): n is a, c, t, g, unknown, or other
aaactggagctccccgcggtggcggccgctctagaactagtggatcccccgggctgcaggaattcgcacgagaccattacctagaacatcctaatcgaaaaaaattctattactagctgcaaaagggcgtgtttgagactagcggaccgaccttgaagttgaagttgaaaaggccggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcatggccaagggtatcaccgcggttggtgccatctgccacgtctccgacgcacagcagcgcaagagcctcatcgagactgccgtcaagagctttgggcacatacatattcttgtctccaatgctgccgcacatccttctgtagatagcatacttgacatgaaagagtctgttctcgactagttgtgagatattaacgtcaaagctcctatccttcttatccaggatgctgctcctgcactacagcaggggtcatctgtgatgtatcatatctcaattgctggctacagtccagaacaacgattgacaatgtatggtgtcacaaacactgctctccttgttctcantaggctc

SEQ ID NO: 42564 - protein, 113 aa, Zea mays
  misc_feature: Ceres CLONE 1441140-F
  misc_feature: SWISSPROT Homolog: EC 1.1.1.184 Carbonyl reductase (NADPH)
MDVKCRRLEGKVAIVTASTMGIGLAIAERLGLEGAAVVISSRKQKNVNEAVEGLMAKGITAVGAICHVSDAQQRKSLIETAVKSFGHIHILVSNAAAHPSVDSILDMKESVLD

SEQ ID NO: 42565 - DNA, 650 bp, Zea mays
  misc_feature: Ceres CLONE 1441141-F
  misc_feature: Translation starting site: 171
  misc_feature (123)..(123): n is a, c, t, g, unknown, or other
aagctggagctccaccgcggtggcggccgctctagattagtggatcccccgggctgcaggaattctcacgagaccattacctagaacatcctaatcgaaaaaaaccctagtggcttcccaccngtatccatttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaaggtgaacggcgcccgtccacaggggatgccgcaccagttctaccacggccgccacggttcgggtctggaaacgtcccaaagcgcggcatcgggggtcgaaaataaacaagcaggggaatggtcccatccaccagaaaacgttatccttgtcccccggggaagagtgggcaacccgtcccccgtttaaaaaaaaaattcccccctggaggaaagggaaaaaagggttccccttaaagggggaatgcaaaggaaaccccggggaaggtccctccccccccagaagggggcccggtgggggccccaacccttgtttttttggtggtaggggggatcccctctaaaaccccccct

SEQ ID NO: 42566 - DNA, 719 bp, Zea mays
  misc_feature: Ceres CLONE 1441142-F
  misc_feature: Encodes the peptide sequence at SEQ ID NO. 42567
  misc_feature (390)..(390): n is a, c, t, g, unknown, or other
  misc_feature (719)..(719): n is a, c, t, g, unknown, or other
tccccgcggtggcggccgctctagaactagtggatcccccgggctgcaggaattcgcacgagaccattacctagaacatcctaatcaaaagactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcgatagcataatgagctcgccagtggagaggtgattcgtcaggctggtatcaagttcctagtctatggtgcctggatgagcagtanatatgctactggccgtggaacgaggagggttcttctcgtcttcagctacaggttacagccatggcctcgccctcttgctgctcggacgcaaagctgaggagaagcccgtaaaggtctcgccgtggaaccagtaccggctagtcgaccgggagaccgagcaggtgtaccacctgccctccgccaagaccaggctcctggggaatgtgctccctttgtctgcttcggatgcacggctaatggcctcgaggtggcgtctcctccaaaagcgacctccgccaatgcgcttggtaccggtacctcaaaggagaagcatcttgttcagcaaaaan

SEQ ID NO: 42567 - protein, 108 aa, Zea mays
  misc_feature: Ceres CLONE 1441142-F
MLLAVERGGFFSSSATGYSHGLALLLLGRKAEEKPVKVSPWNQYRLVDRETEQVYHLPSAKTRLLGNVLPLSASDARLMASRWRLLQKRPPPMRLVPVPQRRSILFSK

SEQ ID NO: 42568 - DNA, 872 bp, Zea mays
  misc_feature: Ceres CLONE 1441146-F
  misc_feature (43)..(43): n is a, c, t, g, unknown, or other
  misc_feature (44)..(44): n is a, c, t, g, unknown, or other
  misc_feature (872)..(872): n is a, c, t, g, unknown, or other
ggagtggtaccccccccccctccgtctgtgtggaggtttatgnncccaagccaacacgctgggactccccgcggtggcggccgctctataactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggtgggagattgctgacccgggagccgttggggacagggctgggcttcgaagcggccggccaccccccagggggggaggaacacggtccagaacggccggtcaaggttttacctcccacccccaagggtgggggggtttccccccggtggtccacgggggggattcctttcctctccgagaaaaaaaaggggctctttaagccccgggagggaaaatccaaccgagggccttttccagaaggggggttccctggaattccctcaaaccccggggcggtctctggccgtatcccaactttttcctcccgtgaataaacatcaggggtcaacacaccgccccataatacccaaagacccggggccggggggggccacaagctcttttgtcgcgcgttaagggaggagaaactcgttgggccaacccctcttgcaataccggctggggtctcctggttgtctctatctatcacacaaccgtaacccccccgggcttctagtctgggggacccccacccccttgctcccagctgcgcgccgcgacgggagcctctcttgtttggggaagatttgtggagtgtcatataagcccattgtggcgtcttn

SEQ ID NO: 42569 - DNA, 734 bp, Zea mays
  misc_feature: Ceres CLONE 1441147-F
  misc_feature (622)..(622): n is a, c, t, g, unknown, or other
aagctggagctcaccgcggtggcggccgctctagaactagtggatcccccgggctgcaggaattctcacgagaccattacctagaacattctaatcgaaaactcgggtcgcgcctcgcttgctcttgtcttgcccgctagctctgattccagcttctcaccggatttgcatgcacaaagatccgcccctccccgctccgctccacgtacggctccagatctgctaaagaggcggtcggtggacaccgctcccaccgggctcgatggatggaagggacaatggcatccagcgaggcctcgtcctcctgctcatcatcaccggcggaggggccggtgtactacatcggccgctcggtccctactctcgaggtgagaggcgaagcgcatcttgtcataccacgccgacgcatggaggatcacaccaatgtcatgcgccgtgaaggaaagctttagtataatatgtgggaaaccgagtatgacatctacctcgactggatgcgatgcctcctctaatcatacgaccttagggaatacgatgccatgccgtgatcttcagatcaaggaacaagtccggatataaaagatcaactcgatcgtttgacaaacgtgattatgcgactaangacgctaaagagatctgacactgcttacgccatctgacgacagaactatgttattgctctcaaggacataaggatgtctgcatatagaaggagctcctaggatgttcacttg

SEQ ID NO: 42570 - DNA, 778 bp, Zea mays
  misc_feature: Ceres CLONE 1441148-F
  misc_feature (431)..(431): n is a, c, t, g, unknown, or other
  misc_feature (658)..(658): n is a, c, t, g, unknown, or other
aagctggagctccccgcggtggcggccgctctagattagtggatcccccgggctgcaggaattctcacgagaccattacctagaacatcctaatcgaaaaatctacctcactcttagctcaagtatcagtggcaggagctctgggcagcgtgcgcacgctgggatacctatttcgctctgctaccctaccatgtctgatcactaccggggcactacagcaggtggcgggggctacagtgacctccagtccgagcgcggtatatacaggcaggggaaacagcagaacaagcagggccgccatgatgacggcgctcaacgccggcgacggccgcgaccttcggcagttcgatgctggtgctgtacgcgctgatcctggccggcaccgtgatcgcgctcaccgtgccaccccagtgctggtagaccttcacacnggggctgggggcaggtccccttcgaactggcggtcatgggagaacggtttctcccttccggggagcctcggcctccttgaattgtttccggttttcgggaagagaaattcccccccctggcattccccccccgggaaccccccccgtttgaacaccccaaggcgaaggtttgggctcccaggctcccccaaatcgggggttttaaaagattcccgcttttaaaaaangcccccgggggtttttaaaaaaaaaaacccccctcgggggggaaacggcccgccccccccccctcttaaaaccttttccggcgcgctggccttttatttttcccctcaacaggggggggg

SEQ ID NO: 42571 - DNA, 792 bp, Zea mays
  misc_feature: Ceres CLONE 1441151-F
  misc_feature: Encodes the peptide sequence at SEQ ID NO. 42572
  misc_feature (42)..(42): n is a, c, t, g, unknown, or other
gggttgaagttgggtggggaaaaatcgccgcttcccccggcncccacactggggctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggccgctgctggcagcaacacggtagtagctgttgcccaagttgagttgcaaacaatgaacgtgcagcagcccgctgatgttgccggacccagcgagggggtggcggcgatctccaaaggggggaaggtagggccgacccggtgcaccgcctgcaggaagaggggtggacttacggggattcaactgccggtggggggaaatttgtactggcggcactccccccggtgactcccgacaaggcacgaactgtcaaatttcaaattcccgggaactgccggcccaagggcacccccctttggccccaggggttaattcccggaggagtg

SEQ ID NO: 42572 - protein, 142 aa, Zea mays
  misc_feature: Ceres CLONE 1441151-F
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDAVMEPAAAGSNTVVAVAQVELQTMNVQQPADVAGPSEGVAAISKGGKVGPTRCTACRKRGGLTGIQLPVGGNLYWRHSPR

SEQ ID NO: 42573 - DNA, 698 bp, Zea mays
  misc_feature: Ceres CLONE 1441153-F
  misc_feature: SWISSPROT Homolog: EC 3.1.2.15 Ubiquitin thiolesterase
catgaactagtggatcccccgggctgcaggaattctcacgacacctttacctaaaacttcctaatccaaaaactcgaggactaggcacctaactaaccttacccatgtgcatcctacggcatcagcatggggaccgtggcccttctggacaggttgcatctgctggagacgtccaaacatccctttttctgcaactttctccgtctaggtggggcttggcacaaatgctccggggcttttactgaatagaaatctggactcaacttgaagggcacctaactgactaatgaggatcttgtcccgcctagactctcattggaggcctgcttgacatctttttcaaggccagagtagattccatattttaatagggctgcattaaattcatcgactacccccctctaaaacagctggattcactacctttccttattaccttgtgctgcacctgcgatactttgtaccgcaaacatgatgtgcgccaaagaaactcgatggttatatacatgtgaacgatacgattgatatcacacatatgcgttgcaaaatgattattcgcctgggggaagacttgcaactctgaaagagggttcctggtgagtacagtgacggagcctgctttatcctggttcccagggggggatgtctgtaactccacacattgctaaccaaggcccttcaacctacccttcctttgg

SEQ ID NO: 42574 - DNA, 718 bp, Zea mays
  misc_feature: Ceres CLONE 1441154-F
  misc_feature: Encodes the peptide sequence at SEQ ID NO. 42575
ggagctccccgcggtggcggccgctctatatctagtggatcccccgggctgcaggaattcgcacgagaccattacctagaacatcctaatcgaaaaaaagaagggaagagttctcggcttctcgcgagtcgcgacagagagaggcggacttgcggagaatatgcggagcagcagcatgaagagggagatcagcgaggcccacgacaccattcgcttcggcatcaacgccggcgtcaaagccgacctcgccccgccgcacccgctccagtctaccatccaatcggagaccaagttctgggcggacaagaagaagttcgggacagatgccatatatggatccgccctcaacatccgcaaggatctcgatgcccagatcctctccaggttccaaaggccctctggtgactatgagtcatctctgcttggatacgaggcactgacaggttccctggatgattttggatttgaggatatcttaacatgcctcatgaatctgacagtttccggccacctgaacatgcaccatggaatggaagttccccctttggttggccaaggggaccaatctgggcctaccttccatggggggggggatgtaatccgggcgggggtccccccttccccccaggaattccccccttaaccatttttaggaggggaaaatggaaaaatggacccgggcctccgccccgggggagaatttaacccccccgaaact

SEQ ID NO: 42575 - protein, 160 aa, Zea mays
  misc_feature: Ceres CLONE 1441154-F
  misc_feature (2)..(126): Pfam Name: UMP1 Pfam Description: Proteasome maturation factor UMP1
MRSSSMKREISEAHDTIRFGINAGVKADLAPPHPLQSTIQSETKFWADKKKFGTDAIYGSALNIRKDLDAQILSRFQRPSGDYESSLLGYEALTGSLDDFGFEDILTCLMNLTVSGHLNMHHGMEVPPLVGQGDQSGPTFHGGGDVIRAGVPPSPQEFPP

SEQ ID NO: 42576 - DNA, 731 bp, Zea mays
  misc_feature: Ceres CLONE 1441155-F
  misc_feature: Encodes the peptide sequence at SEQ ID NO. 42577
  misc_feature (423)..(423): n is a, c, t, g, unknown, or other
aagctggagctccccgcggtggcggccgctctagatctagtggatcccccgggctgcaggaattctcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccacccgggcggcgacctcccgcttctcaccctggcggggcaggacgccaccaacaccttcnccgcctaccacccgccctcggcgcgcccgctcctccgccgcttcttcgttggccgcctctccgactacgccgtctcccccgcgtccgccgactaccgccgcctcctcgcgcagctatcctccgcgggcctcttcgaacgcgtcggccccacccccaaggtccagctcgtcctgatggccgtcctcttctacaccgggctctacctcgacctcgcctgcgccagcggcgggggcgcacctcctcgcgggggggtctcaacgggattccaccgggatcaggcccgggggggatgcgcccacgaactcggc

SEQ ID NO: 42577 - protein, 177 aa, Zea mays
  misc_feature: Ceres CLONE 1441155-F
  misc_feature (22)..(95): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (75)..(75): Xaa is any aa, unknown, or other
MPPSVDAMPAPGDAAGGGDVRMISSKELRSHASADDLWISISGDVYDVTPWLPHHPGGDLPLLTLAGQDATNTFXAYHPPSARPLLRRFFVGRLSDYAVSPASADYRRLLAQLSSAGLFERVGPTPKVQLVLMAVLFYTGLYLDLACASGGGAPPRGGVSTGFHRDQARGGCAHELG

SEQ ID NO: 42578 - DNA, 711 bp, Zea mays
  misc_feature: Ceres CLONE 1441156-F
  misc_feature (698)..(698): n is a, c, t, g, unknown, or other
  misc_feature (711)..(711): n is a, c, t, g, unknown, or other
aagctggagctccccgcggtggcggccgctctagaattagtggatcccccgggctgcaggaattctcacgagaccattacctagaacatcctaatcgaaaaacaaccggaaggtaaagttaaacagttcctaagaagaaacatccattacatataataatactacatgggtaaggacgtggaaggatcacaggggttcgcgacgagggactacaaagatccgccgccaacaccgttcttcgatgcggaggatctgacccagtggtctttgtacagagcccggcatacccgagttcgtagccactctcctcttcttgtatgtcactgttatgactgtcatcggctacaacatttcgtacgatcactaaggtctgacgtgacaagtgccgaggcgactgaatccatgagtatctcgatgggactgcggcgccatgatcttcatgcttgtcgactgaacccccggcatcgtcacgcggtcacataaaccccgcggcgaccttcggcttgttctatggcaggaaggtctccgtggtctagagcggatgaaaacatggtgcctcaggagtatgtgtgcgatttgtggagttgctttcatcaaaggcttccacacctcttactacatcctcttcggtggaggagcacaatctctaaccgatggatacctcacaggagactggacacactacaaagaatcttggnacattctttctgn

SEQ ID NO: 42579 - DNA, 822 bp, Zea mays
  misc_feature: Ceres CLONE 1441158-F
  misc_feature: SWISSPROT Homolog: EC 4.1.2.13 Fructose-bisphosphate aldolase
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (36)..(36): n is a, c, t, g, unknown, or other
tgtttttctttnnnnnnnncgcaccctccctcctanatatctaaacaaactggagctccccgcggtggcggccgctctataatagtggatcccccgggctgcaggatttcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggctagggtatccttgctgctgatgagtcaactggcaccattgggaagcgcctttccagcatcaatgtcgagaacgtggaggagaaccggcgggctctccgtgagctcctgttctgctggcctggtgccccccagtacatcagcggggtgatcctcttcgacgaccaccctcctaccaaatagaccagggatgggcagccttttttccgatggtcctcgagggagggagggcgtccttccttgtgtttcaaggtctgacaaagggcaccatttgaaggttggctggccccctgaaaaggaaaacccacaaccccagagccaccaatgacctctgggcaaggggtgggttctatgtagtaggcaaggggcgggggccccgctttttccgaatgggctttgtccgttttttaaaaatttggcctaaatggaagaccgtttccacttctggccgtttggtcccctatgtgcgttctggggtctggggttcggtcttggggctttcgagctgggcaagagaacgaccgggcca

SEQ ID NO: 42580 - DNA, 701 bp, Zea mays
  misc_feature: Ceres CLONE 1441165-F
  misc_feature: Encodes the peptide sequence at SEQ ID NO. 42581
aagctggagctccccgcggtggcggccgctctatacctagtggatcccccgggctgcaggaattcgcacgagaccattacctagaacatcctaatcgaaaagaggaggcacatccctccatcctctgcgactgcgagggtctctcgagctcaaatcaattgatgattcgtcttcctagtctcgtctccgcgccattctccagatccatctcttcccatcatcccgatccccgccctcgaccccatgcacctgcagcaggacccagcaccctctgatcccgacccagagccgccccccgacctcggtgatgccgccgcctcgtccgcaacgcatacaatcccttcccgcaacgcctcctccacgtacgatttcttcatcgtcaaggtctggctcgaggagaacgcaaccactactacatcctctccggttcctctcattaggatgcttcacgtcgccaagattctaaacctgtcacctcacgatgccttgactcaaaagctccttgccacaaaacccgggtagagtttccccaaatgaatataagggttaacttttccaactttaggaaaaacggggatacgggaaggggttttaaatggcttttaccgggggggaggggtcccctcaaacgcggttcacaaaaatattttgaggggggaaaaacctctttttgttaaaaaaccacccccccgaaacaaatt

SEQ ID NO: 42581 - protein, 92 aa, Zea mays
  misc_feature: Ceres CLONE 1441165-F
MHLQQDPAPSDPDPEPPPDLGDAAASSATHTIPSRNASSTYDFFIVKVWLEENATTTTSSPVPLIRMLHVAKILNLSPHDALTQKLLATKPG

SEQ ID NO: 42582 - DNA, 836 bp, Zea mays
  misc_feature: Ceres CLONE 1441166-F
  misc_feature: Encodes the peptide sequence at SEQ ID NO. 42583
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (48)..(48): n is a, c, t, g, unknown, or other
nnttttttttttnnnttnnntttttctttatttcccctaatttatccnggactccatgcggtggtgggcgctctactctatatgtatcccccgggctgcaggaattctcaccagaccattacctaaaacatcctaatcgaaaaaactactccgtcactttgtttgcaaagctcctcctcgatccatcgatcactgcaccggccggcggcaccgcgctcgcaggggctagccaacgatacggcagcaatggcggaccgtgaccgcagcggcatctacggcggcgcccactccacctacgggcagcatcagcaacagggaggaggcgggcgcccgatgggtgagcaggtgaagggcatgctccacgacaaggggccgacggcgtctcacgcgctgacggtggtgactctgttcccgctggacggactgctgctggggctgtcggggctggtgctgacggcctccccgccggggctaggccgggccacgccgggggttcatgaatcttcagcccccgtgctcgttccccgaccgtgcttgctcatcgggcaccggccgatcatggggtttccctcaagtcctgggcacgcttggcggcttccggggggcctgttcctcgcttcacggggcctccacccaaacacggacccctgtaaggcgtttccaagcggaacccccgggaactagcctggaaggaaggtgcctccgcccaggaattgggagaaggccccctcgggtcccagcgtggtccacttttaaccgtctctgggctagcccaatgtcctcccagacgcccgaggcccgaagcaacccccgcccgccccggggagagaggtccc

SEQ ID NO: 42583 - protein, 145 aa, Zea mays
  misc_feature: Ceres CLONE 1441166-F
MADRDRSGIYGGAHSTYGQHQQQGGGGRPMGEQVKGMLHDKGPTASHALTVVTLFPLDGLLLGLSGLVLTASPPGLGRATPGVHESSAPVLVPRPCLLIGHRPIMGFPSSPGHAWRLPGGLFLASRGLHPNTDPCKAFPSGTPGN

SEQ ID NO: 42584 - DNA, 601 bp, Zea mays
  misc_feature: Ceres CLONE 1441167-F
  misc_feature: Encodes the peptide sequence at SEQ ID NO. 42585
  misc_feature (94)..(94): n is a, c, t, g, unknown, or other
  misc_feature (103)..(103): n is a, c, t, g, unknown, or other
  misc_feature (312)..(312): n is a, c, t, g, unknown, or other
  misc_feature (425)..(425): n is a, c, t, g, unknown, or other
  misc_feature (461)..(461): n is a, c, t, g, unknown, or other
  misc_feature (464)..(464): n is a, c, t, g, unknown, or other
  misc_feature (483)..(483): n is a, c, t, g, unknown, or other
  misc_feature (542)..(542): n is a, c, t, g, unknown, or other
gcggtggcggccgctctagaactagtggatcccccgggctgcaggaattcgcacgagaccattacctagaacatcctaatcgaaaatctatcantcatccaantccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgncgagtacctgaggcagccgcagtgcagcccgctgggcgcggcgccctactacgcccgggtgtgggcagacaagccgcatgtaccagccgcttcggcaacagtgctgccagcancagatggagatgattgacctgcattccgtcccgcancanctgccaaatgatgatccanctttgagcgtggcccctgccgcccaacaaaaaccttgtacaacccgctttttattgcanaaccaaccaaaagttttttggaaaccccagggtctccaacccccctgggccctgaagaa

SEQ ID NO: 42585 - protein, 95 aa, Zea mays
  misc_feature: Ceres CLONE 1441167-F
  misc_feature (53)..(53): Xaa is any aa, unknown, or other
  misc_feature (91)..(91): Xaa is any aa, unknown, or other
MKMVIVLVVCLALSAASASAMQMPCPCAGLQGLYGAGAGLTTMMGAGGLYPYXEYLRQPQCSPLGAAPYYARVWADKPHVPAASATVLPAXDGDD

SEQ ID NO: 42586 - DNA, 659 bp, Zea mays
  misc_feature: Ceres CLONE 1441169-F
  misc_feature: Encodes the peptide sequence at SEQ ID NO. 42587
tggcggccgctctagaactagtggatcccccgggctgcaggaattcgcacgagaccattacctagaacatcctaatcgaaaaaagatgttgttcgaggcgttcccctcctccacgcgaccttctcccctccagatccaggattgccgggctccttgactcgttacctcgcgcgccctcggtgagctactttgtttcgatttagcgacaaatcagtttgcttcatgttgcgcaggcttagatcggagtgccggattcttcgtcttacggcttgaatcgagctgggaggctgtggatctgagcaggggaggtacaacagatccgcgtgtatgacgagttggatcggcaccggttagtctctgaccgcaagattttgttgttgtgttgggctgatctgccgcgttgttttgcttcaggttctagagctagcgaaatcgcaaggctattatggttcttttcggagcgcgtctgaaccgatgatggctgaagtccgcggtgggatcgggatcttctctgccctgctccactcgggatgatgaatctgctgcgctcatcattattggatgaatttcgataattattagatctaagagatgcgccgacttgaataggcgaggtaaggtgcaacatgtataagacgtgacatgctatagaggccttt

SEQ ID NO: 42587 - protein, 51 aa, Zea mays
  misc_feature: Ceres CLONE 1441169-F
GGRSRTSGSPGLQEFARDHYLEHPNRKKMLFEAFPSSTRPSPLQIQDCRAP

SEQ ID NO: 42588 - DNA, 675 bp, Zea mays
  misc_feature: Ceres CLONE 1441172-F
  misc_feature: Encodes the peptide sequence at SEQ ID NO. 42589
gtggatcccccgggctgcaggaattcgcacgagaccattacctagaacatcctaatcgaaaagaagtctatctttttctcctcctgccgtacgtccggtccgttccagcttgcaaagcgctcgcgagctgctgccatggccggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccgccgcctctgggccgccgccgaggccgaggccggctatcgcgtgctcaccccgacgccgcacctctccatgggcccgcggagcagcgcctcgctcgccgccgccatcgccaacatcggcgccgaggaggtggacgaagacgaccttcaccgcaggtggggcggcgccttcgccctcaccgtcccgggccgggtggacgcgtgggtcaccgcgctcagcgaccacgggggggtgctcagcgccaccaaggccggggccatgttccagtcgctccgcgtcgccgaaagggccgtg

SEQ ID NO: 42589 - protein, 180 aa, Zea mays
  misc_feature: Ceres CLONE 1441172-F
  misc_feature (20)..(178): Pfam Name: DAO Pfam Description: FAD dependent oxidoreductase
  misc_feature: SWISSPROT Homolog: EC 1.5.3.1 Sarcosine oxidase
MAGAGAPAVPQAGRPAPNFDVIVVGAGIMGSCTAHAAASRGARVLLLERFDLLHPLGSSHGDSRIIRDAYAQPRYLRMVRLARRLWAAAEAEAGYRVLTPTPHLSMGPRSSASLAAAIANIGAEEVDEDDLHRRWGGAFALTVPGRVDAWVTALSDHGGVLSATKAGAMFQSLRVAERAV

SEQ ID NO: 42590 - DNA, 714 bp, Zea mays
  misc_feature: Ceres CLONE 1441178-F
  misc_feature: Encodes the peptide sequence at SEQ ID NO. 42591
  misc_feature (714)..(714): n is a, c, t, g, unknown, or other
ctgaactggtggatcccccgggctgcaggaattcgcacgagaccattacctagaacatcctaatcgaaaacttcctcgtcgcccttttccttccgcaacacacacacaccggcacgatcgagtgcacgaccgcgggcgcagcagccaccgatccggcggcatctccgccctgctcgcgcccgcgcccgccggagaagaagagccttccatgagattgttgatgtcgcgccggcgcggcgccggcggcgggctgtgcatcaggaagaaggcccgcggattcatgtgcgggtgcggcggcaccaaggccatctccatctccgacggctccgacaagtcaccaacggccacgccgcaaaccgccgcgtccaccactccccttaccggcatgtcggccaccaccaccaccaccaccacgaccaagcccaccagaggaggaggaggaggagggtaccggccggcggcggcaccgtccaccacggaggctccctccctgttctcgtcctcgccctttgacccggacactacggacgacggcccctgcggcatggaaagacacgcccggcctgtcggcgctcctgcgccaggtcggggaagctggagcttagcgttcggcttcctggaccttccgagggggccctgaaagtgaagaaagaggccgaacccccggcaagcttggaggggccacccgcgggccgggcgggatagccccgcgcn

SEQ ID NO: 42591 - protein, 143 aa, Zea mays
  misc_feature: Ceres CLONE 1441178-F
MRLLMSRRRGAGGGLCIRKKARGFMCGCGGTKAISISDGSDKSPTATPQTAASTTPLTGMSATTTTTTTTKPTRGGGGGGYRPAAAPSTTEAPSLFSSSPFDPDTTDDGPCGMERHARPVGAPAPGRGSWSLAFGFLDLPRGP

SEQ ID NO: 42592 - DNA, 872 bp, Zea mays
  misc_feature: Ceres CLONE 1441179-F
  misc_feature: Encodes the peptide sequence at SEQ ID NO. 42593
  misc_feature (1)..(1): n is a, c, t, g, unknown, or other
  misc_feature (2)..(2): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (872)..(872): n is a, c, t, g, unknown, or other
nncccggggggggtgggtgttttcctggccgccgnnnnngnngnnnnaaaaatgggactccccgcggtggcggccgctctagaactagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccaaccgcggtcccaggcgctgaacggtggcgaacctgtttcccgttgggggagcctcctgctgggggctgccggggatggggcttaaagaagttgggccccccccccctggcccgtgggcccccccggggggtcctaaatccttcacgccccgcttatgggtcccccggcggcggttgcgcctagtgggccgggcccggcacggggggttcccttcacgtacgggccctccccctaaggacaccggggcgggccctgggccgtcggttcctacgtgcccgtgggcctaataagagggggggggatttagtgtttgacgggtgtcacccgccgggaaacactcttagaggggggggcgcgccgtccgtctgtgtatttcctggaaaccgccgcggtgggggggcgccgctccttcctaaggagacgccggagccaagaaagaggcttggagcgcgtcctctaacgcggcatagactcactgaccgtgggcgcctn

SEQ ID NO: 42593 - protein, 103 aa, Zea mays
  misc_feature: Ceres CLONE 1441179-F
MADRDRSGIYGGAHATYGQQQQQGGGGRPMGEQVKGMLHDKGPTAVPGAERWRTCFPLGEPPAGGCRGWGLKKLGPPPLARGPPRGVLNPSRPAYGSPGGGCA

SEQ ID NO: 42594 - DNA, 655 bp, Zea mays
  misc_feature: Ceres CLONE 1441181-F
  misc_feature: Pfam Name: CAF1 Pfam Description: CAF1 family ribonuclease
  misc_feature: SWISSPROT Homolog: EC 3.1.13.4 Poly(A)-specific ribonuclease
tccccgcggtggcggccgctctataactagtggatcccccgggctgcaggaattcgcacgagaccattacctagaacatcctaatcgaaaacccattcatcgagtctacgctcttcgtctttctccggtccgaattccccaatcggactctcctcttcttgccggatctccacaccccattccaccccgcccatgggtgcccccacccctcgccgctgacctgtgggtacactgccccctgctcccccgccccgctcccgctcgcccacgcgaaccctaggcagctaggctttgctgctagaagagctccagcgaccgacgaggagaggagaataaagctcaaatcttggatgcgcccgaaccgatggcgacacctgccgcagagaagccggaagatgtagagatccgtgaggtttgagcggacaacctcgagacagagttcgccgtgatccgcgacatcgtcaacgactatccgtatgtggctatggacactgagtttccgggcgttgtgtgtcgtccgctcggacactacaagtcggcggccgatttcactacaccactcttaaagctacgtggacatgctgaatcttattcagctcgggctcaccttgtccgagagaatggtgggctgccgcgctaggccagacggtctccc

SEQ ID NO: 42595 - DNA, 677 bp, Zea mays
  misc_feature: Ceres CLONE 1441183-F
  misc_feature: Encodes the peptide sequence at SEQ ID NO. 42596
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcacgagggccccgtggaggcgaagcaggcgctctactcgagggacctcgctcgcaacctgcgcttcgcctccaacttcgacctcttcaaggctgctgcggccgactggcgcgacacgctcttctgcgaggtggctccgaancccgccgccgcgggaggagctgccggagc

SEQ ID NO: 42596 - protein, 177 aa, Zea mays
  misc_feature: Ceres CLONE 1441183-F
  misc_feature: SWISSPROT Homolog: EC 1.14.11.20 Desacetoxyvindoline 4-hydroxylase
  misc_feature (168)..(168): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFTRAPWRRSRRSTRGTSLATCASPPTSTSSRLLRPTGATRSSARWLRXPPPREELPE

SEQ ID NO: 42597 - DNA, 825 bp, Zea mays
  misc_feature: Ceres CLONE 1441190-F
  misc_feature: Encodes the peptide sequence at SEQ ID NO. 42598
  misc_feature (15)..(15): n is a, c, t, g, unknown, or other
  misc_feature (16)..(16): n is a, c, t, g, unknown, or other
  misc_feature (24)..(24): n is a, c, t, g, unknown, or other
  misc_feature (38)..(38): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (72)..(72): n is a, c, t, g, unknown, or other
  misc_feature (74)..(74): n is a, c, t, g, unknown, or other
  misc_feature (79)..(79): n is a, c, t, g, unknown, or other
  misc_feature (80)..(80): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (216)..(216): n is a, c, t, g, unknown, or other
  misc_feature (230)..(230): n is a, c, t, g, unknown, or other
  misc_feature (244)..(244): n is a, c, t, g, unknown, or other
  misc_feature (250)..(250): n is a, c, t, g, unknown, or other
gtccccccccccccnncccccccncccccccccccccncccccgtcccgccccnnnnnnnnnnnngnnnccngnccctnncgccgnnnnnggggggggggggggggggggggtcccctctccgccggcggggggggggggggcgccctctctaaatctagtcttcccgccggggcgtttcccccccgaccggggttgggcgggggaccccggcccnttttccttttgggntaaaaaccttaggnttgggntattccccccggggctgcaggaattcgcacgagaccattacctagaacatcctaatcgaaaaatttttccttcctcctcccacctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagcccgcagatcatctttcgcccgcgcccaagcagtacgcccgaggagtacccacgccccaggagaaaggaggcttgtgcagcctcaagccgttgaggccccggtttgaaggggtgggtttcttatgttgagcccccagaaggcccaaacctttctggttttgtggggttccccccttccccgggggttttaaatgggcctttggccccccccaaagaaccccccaaagaaatttttgtccccccccccccggccctttttgggggccaaaatctttttccacgcggtgttttttttttccctcacaagggggttaac

SEQ ID NO: 42598 - protein, 73 aa, Zea mays
  misc_feature: Ceres CLONE 1441190-F
MSAAEAKAAAVPESVLRKRKREEQWAADKKEKALADRKKALESPQIIFRPRPSSTPEEYPRPRRKEACAASSR

SEQ ID NO: 42599 - DNA, 677 bp, Zea mays
  misc_feature: Ceres CLONE 1441196-F
  misc_feature: Encodes the peptide sequence at SEQ ID NO. 42600
  misc_feature (137)..(137): n is a, c, t, g, unknown, or other
  misc_feature (158)..(158): n is a, c, t, g, unknown, or other
  misc_feature (159)..(159): n is a, c, t, g, unknown, or other
  misc_feature (177)..(177): n is a, c, t, g, unknown, or other
  misc_feature (390)..(390): n is a, c, t, g, unknown, or other
  misc_feature (472)..(472): n is a, c, t, g, unknown, or other
  misc_feature (473)..(473): n is a, c, t, g, unknown, or other
  misc_feature (480)..(480): n is a, c, t, g, unknown, or other
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaaaagagaggattttgctaggtttttgcccccaaccngcccaactgggcgcgtgctcnnctgccgaacctcccaccncctccactcccctgcggttggcggctgtctcgccgaagcgacccagccggcgcagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcaagtcggggaaagcgccgcgcctgcgaggncatgtgctttctcgctccccacgcccgaacgacccgttcaacgagcgccatggcaggaagccacaagctcgatgacaagccnngccaaannaaccagcccgccgaaccccgctgaaggacagcggcaaccccaagagagaaaaggccccaaacaccaaaaaaccccccacccgggtggaaaaatatgggcgcccaaaggccaaaattcaaaggcggtttccccaaaaaggaaaaaagggggcgcaaaagggggccccccgggaaatttccacccggcgcccccaaaa

SEQ ID NO: 42600 - protein, 75 aa, Zea mays
  misc_feature: Ceres CLONE 1441196-F
MAKGDDALARKRNRVRRKRLRSSENAVSARVAAIIASKHRRKSGKAPRLRGHVLSRSPRPNDPFNERHGRKPQAR

SEQ ID NO: 42601 - DNA, 708 bp, Zea mays
  misc_feature: Ceres CLONE 1441197-F
  misc_feature: Encodes the peptide sequence at SEQ ID NO. 42602
  misc_feature (243)..(243): n is a, c, t, g, unknown, or other
  misc_feature (268)..(268): n is a, c, t, g, unknown, or other
aagctggagctccccgcggtggcggccgctctagaactagtggatcccccgggctgcaggaattcgcacgagaccattacctagaacatcctaatcgaaaaaccaaagtccaagcaccttcccaaaaaatcccccattttcttcgaggcgaggagagcgtgaaagacagggcaccggcagcgacgatgtcggggcgcggcaagggcggcaaaggtctgggcaaggggcggagcaaagcgccanccggaaggtgctcccgtgacaacantccaggggcatcaccaagccccgccatccggaggctggctcggagggggcggcgtgaagcgcatttcgggcttatctacgaggagacccgcgcgtcctcagatcttcctcgagacgtcatccgcgacgccgtcactacccgaagaacgcacgccgaaggatgttaccgccatggacgtcgtctacgcgctcaggcgcagggcccgacccttctagggttcgaagctaggctggaagcctcttcccttgcctgccgggatgcctgttttgtttaaggggaacccccttaaacccccggccggggaccgggggaaatttggaaaagaattctttgaagtgtgtttcaaaaggaccccacctttcctcccaaaaaaaaaaattcccgggaaaaaaaaaaaaaaaatttttttccccccccccccggggggggggccgcccctt

SEQ ID NO: 42602 - protein, 118 aa, Zea mays
  misc_feature: Ceres CLONE 1441197-F
  misc_feature (20)..(20): Xaa is any aa, unknown, or other
  misc_feature (28)..(28): Xaa is any aa, unknown, or other
MSGRGKGGKGLGKGRSKAPXGRCSRDNXPGASPSPAIRRLARRGRREAHFGLIYEETRASSDLPRDVIRDAVTTRRTHAEGCYRHGRRLRAQAQGPTLLGFEARLEASSLACRDACFV

SEQ ID NO: 42603 - DNA, 710 bp, Zea mays
  misc_feature: Ceres CLONE 1441198-F
  misc_feature: Encodes the peptide sequence at SEQ ID NO. 42604
gcggtggcggccgctctagaactagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgactcgccggagaacaagccggacatgaaatgggagttctcacaggcgaatatgaagaaggtcaatgagattctgtctcactatccaagcaactacaagcaatctggtattattccgctgcttgatcttgcacagcagcagcatggtggatgggtgccagttgcagcaatggatgctattgctaaaattgtccaagttgcaccaatcagggtctatgaagttgcaactttctatacaatgtttaacgggactaaggttggtaaataccaccttttggggtggtggacctaccccttgtaatgattcccgggttcccctgaaaacgaaaaaaccttttttgaaa

SEQ ID NO: 42604 - protein, 91 aa, Zea mays
  misc_feature: Ceres CLONE 1441198-F
  misc_feature (3)..(92): Pfam Name: Complex1_24kDa Pfam Description: Respiratory-chain NADH dehydrogenase 24 Kd subunit
  misc_feature: SWISSPROT Homolog: EC 1.6.99.5 NADH dehydrogenase (quinone)
MKWEFSQANMKKVNEILSHYPSNYKQSGIIPLLDLAQQQHGGWVPVAAMDAIAKIVQVAPIRVYEVATFYTMFNGTKVGKYHLLGWWTYPL

SEQ ID NO: 42605 - DNA, 741 bp, Zea mays
  misc_feature: Ceres CLONE 1441199-F
  misc_feature: Translation starting site: 197
ctgaattagtggatcccccgggctgcaggaattcttcacgagaccattacctagaacatcctaatcgaaaaaagttccatatccaacacacagcagcaacgctcggtcgacactgtcactagctggttgctctactagagggcgggtatagagctgcctgcaatccgctgctgagaagggaggatcggaagcgacgatgaggtcgtttgctcctgtctttctgtcggcggtcgtggcctggctggagctggcgggcaccgggcaaggcggtcacttctacctcgacacaaaggtgaccctggggcgatggccccgaccaggtactgaacggccgggcgcgggcttggactggactctggaaccgcccgtccggctcccgggttcccagtccaagacccccccccctgtttccgcaaaaaatcgacatggccaaatcaaacttggggcccgggaaaatcccgttggcccgggaaacccacctttttagaccgggtcctccccccgggtgttgcgcccccccgaacaaaatccccccttcccggttccccgggggcacggggggggggggaaaccccttaaaccccgttctcccccaagggtttcaccccccccatattgggcccgagggggacccccagtgccccccctgggtttacccctcacacagtgcttccacaacaggcgcccccgggggggacccccccccacaagatcttgagggaggcgcccccccctgtggga

SEQ ID NO: 42606 - DNA, 717 bp, Zea mays
  misc_feature: Ceres CLONE 1441202-F
  misc_feature: Encodes the peptide sequence at SEQ ID NO. 42607
  misc_feature (659)..(659): n is a, c, t, g, unknown, or other
aaactggagctccccgcggtggcggccgctctagaactagtggatcccccgggctgcaggaattcgcacgagaccattacctagaacatcctaatcgaaaaagatcaggtaaccccgtgccgagattcctgcgtctcttctctcctcttcgtcgcggatcactcgccgcggagctgggacactttccgtccacgcggatcgctggtcctgcgccgtgcggtcggttcgctgacatgatccctggatcccaaatctttctcgccgagctactgtgatgcgtgttattgaaatacgtcgcggcggatttgttggtgcctctgccgcgtgccggaatatctggataacggcatggaagtacacagctggcattgagctgagagatggacgccaacaggcgccaaggtgggattcagcagttgctggctgcggagcaggaggctcagcaaattgtgaatgcggctagagctgctaagtcagcaaggcttaggcaagcgaaagaggaggcagagagggaaatagccgaataccgtgcccagatggaggctgagttccagaggaaggtcgcagagagcagtggtgactctggtgcgaacgtcaagcgtctcgaggaagagacaacggcgaaaatcgaacagctcaaccagcaggctgcaagcatnctcccagatgtcattcagatgcttctgaagcatgtcaccaccgtgaagaactgagaag

SEQ ID NO: 42607 - protein, 110 aa, Zea mays
  misc_feature: Ceres CLONE 1441202-F
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
  misc_feature (93)..(93): Xaa is any aa, unknown, or other
MDANRRQGGIQQLLAAEQEAQQIVNAARAAKSARLRQAKEEAEREIAEYRAQMEAEFQRKVAESSGDSGANVKRLEEETTAKIEQLNQQAASXLPDVIQMLLKHVTTVKN

SEQ ID NO: 42608 - DNA, 736 bp, Zea mays
  misc_feature: Ceres CLONE 1441208-F
  misc_feature: Translation starting site: 301
ccccgcggtggcggccgctctagaactagtggatcccccgggctgcaggaattcgcacgagaccattacctagaacatcctaatcgaaaaatcatcactgccatctctctctgactctgtgtccgcgtctcaacaaaatgcccggctcctcgcgacccctggttaccgtgagggccctggagggctacatggccacggactccgcctgtggtccgctggcggacgtcctccgcgcaccgatccgcccggacatcgttcgcttcgtccacaagctcctgtcctgcaacagccgccaaccctatgcggtgtcgcgtcgcgccggacaccagacctccgcggagtcctggggcacggggcgtgcggtatcccgtatcccccgcgttcctggcggtggtacccaccgcgccggccagggagcgttcggcaaacatgtgtcgtggtggacgcatgttcgcgcccaccaagatctggcgccgctggcaccgtcgcgtcaacatacaccttcgccgtgtcgccatcgcctccgcactctccgccaccgccgttccgtcccttgttctcgcacgtggccaccgcgtggagtctgtgcccgagctcccgctggtcgtttcggactccgcggagtccattgagaagacagcccaggccatcaatatcctcaaacagctcggtgcctacgccgatgctgagaaggcaaggattctgttggcatccgccccgggcaggggcagatgcg

SEQ ID NO: 42609 - DNA, 763 bp, Zea mays
  misc_feature: Ceres CLONE 1441211-F
  misc_feature: Encodes the peptide sequence at SEQ ID NO. 42610
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ttttttcctccctttttttctcccccgngggggagnnnnncccttttttttcaagctgggactccccgcggtggcggccgctctatcctagtggatcccccgggctgcaggatttcccacgagaccattacctagaacatcctaatcgaaaattcttccttccttctttccttcaccaatggccacgagaatagccttgtgtcttctcggccacgtcctcctcgccgtcgcgtcgatggcagtggcggcggcggccggtgacgcgggcaagatcggcatctgccacggccgcgttggcagtaacctcccgccgccgtcggccgccgcggcactgctcaagcggaacgggatcaccaaggcgcggctcttcctgccggacccggccgtgctcccggccttcgccgctgcgggcatcgacctcatggtgggcgtgccgaacgaaaacctcaccttcctggccgcggcgcgccccgagggcgcggcgcagtggctgcggtccgcgtgcctggcccacgcccccgccgaagccgttccggtgcctccccggcggcaacgaggggctgtacaccaacccagttctatgccccctaacctggtgccggcctatccagaacctgtgccgccgcggctctgccttcctgggggctgcaaaggtgagggttgaagggtttccccgcggcggaacgcctcccttcggggtgcctgggccgcccgggataactcagcccttacgcgggggggggggtgtgctgaaccccacccg

SEQ ID NO: 42610 - protein, 161 aa, Zea mays
  misc_feature: Ceres CLONE 1441211-F
  misc_feature: SWISSPROT Homolog: EC 3.2.1.39 Glucan endo-1,3-beta-D-glucosidase
MATRIALCLLGHVLLAVASMAVAAAAGDAGKIGICHGRVGSNLPPPSAAAALLKRNGITKARLFLPDPAVLPAFAAAGIDLMVGVPNENLTFLAAARPEGAAQWLRSACLAHAPAEAVPVPPRRQRGAVHQPSSMPPNLVPAYPEPVPPRLCLPGGCKGEG

SEQ ID NO: 42611 - DNA, 566 bp, Zea mays
  misc_feature: Ceres CLONE 1441213-F
  misc_feature (466)..(466): n is a, c, t, g, unknown, or other
  misc_feature (467)..(467): n is a, c, t, g, unknown, or other
  misc_feature (494)..(494): n is a, c, t, g, unknown, or other
  misc_feature (547)..(547): n is a, c, t, g, unknown, or other
aagctggagctccccgcggtggcggccgctctagaactagtggatcccccgggctgcaggaattcgcacgagaccattacctagaacatcctaatcgaaaaaaaccaccgcagccgcagcacaatcgcctcgccttcccttccccaccagcccccgtctctctctctctctctctgtctctctctcgaaagcgcgtccatctcgcagcagcaagcaagcgcgaccaaaatggcgcctcttaggaaaccggcggaacctttttttccccccgggggggcttccaaaaaaaccctgggggggggttcttttctgggggaaaaaaggggtagaaaaaaaattttttccccccccaaagggggggggggttttttttttttttgtggaaaaaaaaaaggggggggttttttttttttataaaaaaccccccccccggggggggggccccccccccccacaaaaaaaaaanngggggggggggcggccgcccctcctcnaaaaaaagaaaaggggggggggggggcccccccccccccccccccctttttgngagggagggagaaagagga

SEQ ID NO: 42612 - DNA, 707 bp, Zea mays
  misc_feature: Ceres CLONE 1441214-F
  misc_feature: Encodes the peptide sequence at SEQ ID NO. 42613
ggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgctagagcgagtgccgcgagcggcaccagcaagctgacgcgggcgaggacggcgacagcggcgtggacgcctacgtctcccgctccgggaggggcgagtgccggcgccagtgcctgcgccgtcacgagggccagccgtgggagacccaggagtgcatgaggcggtgccgccgccgcggactggccgtcgacatgtagcaggagtacagtcgcggcagcgagagcgcgggcaagtgccgggagaggtgcgagcgccaccacgcgggggactggtgggagaggcagcgctgcctgatgactgcagaaccccgggagccggagggaggag

SEQ ID NO: 42613 - protein, 63 aa, Zea mays; identical to SEQ ID NO: 13484
  misc_feature: Ceres CLONE 1441214-F

SEQ ID NO: 42614 - DNA, 695 bp, Zea mays
  misc_feature: Ceres CLONE 1441215-F
  misc_feature: Encodes the peptide sequence at SEQ ID NO. 42615
tggagctccccgcggtggcggccgctctagaactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaaatgttggcgctgaactggctcatcaagtccctgggagagtttcgacggaaatagatgctcggttagcttatgacacccagggcataatccacagggtacatgaactgttgaatctatacaccaacatgatgtctcaac

SEQ ID NO: 42615 - protein, 184 aa, Zea mays
  misc_feature: Ceres CLONE 1441215-F
  misc_feature: SWISSPROT Homolog: EC 2.2.1.2 Transaldolase
MALSIYTPTSSSLVPPSIQEVRLTSRPPKPATFSLRRPHLAARAAAGNAPTSPVREVVTELDAVAGFSEIVPDTVVFDDFERFAPTTATVSSSLLLGITGLPDTKFKSAIDTALADGECNALEKAEDRMSCYLTKALANVGAELAHQVPGRVSTEIDARLAYDTQGIIHRVHELLNLYTNMMSQ

SEQ ID NO: 42616 - DNA, 720 bp, Zea mays
  misc_feature: Ceres CLONE 1441216-F
  misc_feature: Encodes the peptide sequence at SEQ ID NO. 42617
  misc_feature (468)..(468): n is a, c, t, g, unknown, or other
ccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgattggagcgtctgggttgtcagcgccccgccgaagggcaaccggttggcggcggcaaatgacctgcatcatcaggcccaaaaagaggctatggcccccancaggcttaggctcccccccctcttctgggactcccccctggagggaggcaatcaaacaaagccccctcctgggtccccgcgggaatttctcctttttgggaaaaaaacccccaccctttttttccaatttccaaatcgaaaagggcccccggggaattaaatttggggggtgcgtgtggccccaaatattaaccgccccggggaaaaaccgacccccagggggaacccccttttcccccagtttttttcctc

SEQ ID NO: 42617 - protein, 88 aa, Zea mays
  misc_feature: Ceres CLONE 1441216-F
  misc_feature (36)..(36): Xaa is any aa, unknown, or other
MGDWSVWVVSAPPKGNRLAAANDLHHQAQKEAMAPXRLRLPPLFWDSPLEGGNQTKPPPGSPREFLLFGKKTPTLFFQFPNRKGPPGN

SEQ ID NO: 42618 - DNA, 687 bp, Zea mays
  misc_feature: Ceres CLONE 1441218-F
  misc_feature: Encodes the peptide sequence at SEQ ID NO. 42619
  misc_feature (638)..(638): n is a, c, t, g, unknown, or other
  misc_feature (647)..(647): n is a, c, t, g, unknown, or other
gctctagaactagtggatcccccgggctgcaggaattcgcacgagaccattacctagaacatcctaatcgaaaaaatacgaggcctggcctaccacctgcgacaaaccagtcaccgcctaccaccgttttataatccacccctcccactccccctgttttttcttcttccgctgttctactccggcgtgttggtcgacggcggcgcagatgacgaccctcgatctgatgggagggtacgggcgggtggacgagcaggtggccatccaggaggccgccacggcggggctgcgcgggatggagcgtctcatcttgcagctctcccaggctggcaccggggagcggtcgttgtccccaccggcggtacaggcgcagcgccagcagcagaagcagctggagcagatccagcagcaggttgactgccgggagctcacggacatgacggtgtccaagttcaagaaggtgatctccatcctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcaggnactccgggntcagcgtgtccggcgcgagctcgtcgttcctgtcgtcggg

SEQ ID NO: 42619 - protein, 159 aa, Zea mays
  misc_feature: Ceres CLONE 1441218-F
  misc_feature (144)..(144): Xaa is any aa, unknown, or other
  misc_feature (147)..(147): Xaa is any aa, unknown, or other
MTTLDLMGGYGRVDEQVAIQEAATAGLRGMERLILQLSQAGTGERSLSPPAVQAQRQQQKQLEQIQQQVDCRELTDMTVSKFKKVISILNRTGHARFRRGPVAARSQSQSQGPASPEPAQSAPAPAARPLTLDFTKSVSGYSRXSGXSVSGASSSFLSS

SEQ ID NO: 42620 - DNA, 728 bp, Zea mays
  misc_feature: Ceres CLONE 1441227-F
  misc_feature: Encodes the peptide sequence at SEQ ID NO. 42621
aaagctggagctccccgcggtggcggccgctctagaactagtggatcccccgggctgcaggaattcgcacgagaccattacctagaacatcctaatcaaaaaaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacataccttaatcacccttgtttcaacaatcgccagccctatctttggtgcagtcattggtacaaaccatcagggcacagcagctgcagcaactcgtgctacctgtgatcagcaagtagctctggaaaatctttctccccattctcagaaacacaattttcttcattcaacccactgtctacatgaacctttgcttcttatttgcaggaacaactattaccattagggcggtttgttatggccactcttccagaaaaaaaaatttttttcatttaaccaattgggcccccctaaacccccgttctttttttgggcgcaggaagaacaattgacctttttggcccgttttggggaaaaaccccttt

SEQ ID NO: 42621 - protein, 68 aa, Zea mays; identical to SEQ ID NO: 13356
  misc_feature: Ceres CLONE 1441227-F

SEQ ID NO: 42622 - DNA, 731 bp, Zea mays
  misc_feature: Ceres CLONE 1441231-F
  misc_feature (388)..(388): n is a, c, t, g, unknown, or other
tccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcgagggtcccatcggaagatggcccgcgcagcattctgggaggagccagcaggctctatngactgcagacgggagaggacgtctccacaatcgcgagtggagtctgattgaccgaggacgcattcccgttgctgggtaaaagttggtggatatgatgtgcggcccctcgtgtgttgcagcatttggattcaacattgaggacggtgcattacaacaacatcaacttccaagtatgggatcttgggggtcaaacaagcgtcagggaccggctctttatcatgatagtaaattcctgactgctctttcttaagtaaataatacggttgcctttatttaatcccccaatgataagccttgcaatagaggcccaaatggggggtctatctttcaaacaccaagcaat

SEQ ID NO: 42623 - DNA, 685 bp, Zea mays
  misc_feature: Ceres CLONE 1441235-F
  misc_feature: Translation starting site: 217
  misc_feature: SWISSPROT Homolog: EC 2.4.1.207 Xyloglucan:xyloglucosyl transferase
ctccccgcggtggcggccgctctagaactagtggatcccccgggctgcaggaattcgcacgagaccattacctaaaacatcctaatcgaaaaaagttccatatccaacacacacagcaacgctcgctcgacactgtcgctagctagttgctctactagagggcgggtatagagctgcctgcaatccgccgctgagaagggaggatcggaagcgacgatgaggtcgtttgctcctgtctttctgtcagcggtcgtggcctgcctggaactggcgggcaccgcgcagggcggcaacttctaccacgacacagagatgacctgagccgatggccccggcaaggtagtggacggcaggctcgggctggacctgacgctggaccacacgtccggctccgggttccagtccaagagcgagtacctgttcggcaagatcgacatgcacatcaagctggtgccaggcaactccgtggcacggtcaccaccttctacctgtcgtcccagggcgacgcgcacgacgagatcgacttcgagttcctgggcaacgtgagcggggagccctacacgctgcacaccaacgtgttcacgcgcggacagggccagcgggagcagcagttccgcctctggttcgaccctaccactgccttgcacacctactccatcctgtggaactcgcagcacgtgatctt

SEQ ID NO: 42624 - DNA, 692 bp, Zea mays
  misc_feature: Ceres CLONE 1441239-F
  misc_feature: Encodes the peptide sequence at SEQ ID NO. 42625
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaactcttttccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcagcagagaaagctcttcagaattttactggtcatgtgatgccaaacactgaccggccatttaaattgaactgggcatcgtatagcatgggtgaaaagcgatctgaagtggcttctgatcactcgatatttgttggcgatctagctgctgatgtcactgatgaaatgctgctggagcttttctccagcaagtaccgctcggtgaaaggagctaaagttattattgatgcaaacacaggccgttccaggggctatggatttgtcangtttggaga

SEQ ID NO: 42625 - protein, 191 aa, Zea mays
  misc_feature: Ceres CLONE 1441239-F
  misc_feature (50)..(121): Pfam Name: RRM_1 Pfam Description: RNA recognition motif. (a.k.a. RRM, RBD, or RNP domain)
  misc_feature (189)..(189): Xaa is any aa, unknown, or other
MVAAPPPPPQFAKHFAAGPPPPPQAGAGRRTPTPPSSGSGGNGCEENKTIWVGDLQYWMDENYLHNCFGPSGEVVTIKVIRNRQTGQSEGYGFVEFFSHASAEKALQNFTGHVMPNTDRPFKLNWASYSMGEKRSEVASDHSIFVGDLAADVTDEMLLELFSSKYRSVKGAKVIIDANTGRSRGYGFVXFG

SEQ ID NO: 42626 - DNA, 728 bp, Zea mays
  misc_feature: Ceres CLONE 1441247-F
  misc_feature (346)..(346): n is a, c, t, g, unknown, or other
  misc_feature (356)..(356): n is a, c, t, g, unknown, or other
  misc_feature (357)..(357): n is a, c, t, g, unknown, or other
  misc_feature (369)..(369): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (390)..(390): n is a, c, t, g, unknown, or other
  misc_feature (392)..(392): n is a, c, t, g, unknown, or other
  misc_feature (400)..(400): n is a, c, t, g, unknown, or other
aaagctggagctccccgcggtggcggccgctctagaactagtggatcccccgggctgcaggaattcgcacgagaccattacctagaacatcctaatcgaaaaaagctcacttggacccctcttcggctcttcccacaatctcacagccctcgaaggcaccacccgcgccgccgccaccgctccgaaattacagccatcgtagtgcggcggctaggtcggccggcgtttggaggactccgaagatgtggtgcagtcgtgcaaggaaggtacgacgagaggacgccggacctgcaggagtgctacgaggaggccagcgagacgagaagagctcaagcgggagatcgangaaactcgtnncccgctcttttnctcgnnnctccctccctaccntngaggccgnatccggccccaattgggaactccttcctcaaggcatccccttcaccggggggggaaggccaaccccaatgctgggcccaccccccaaacacccggccgggcccgccctttcggtatttcctggccaagaaaatttccttgtttcaaaaagaatcttttaaaaataaattgaaaaaaaattgggggggcccccccaaaaattttaaaagggctctaaaaaacccctccgggttttttcccctaaaaggacccccggaaaaattcctttaaaaaaaaaagaggccccccccccccggggggtggagaaaaaaaacaaaaaaaaccccgca

SEQ ID NO: 42627 - DNA, 668 bp, Zea mays
  misc_feature: Ceres CLONE 1441250-F
  misc_feature: Encodes the peptide sequence at SEQ ID NO. 42628
  misc_feature (465)..(465): n is a, c, t, g, unknown, or other
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcagaaacctcttnctcagcactgatgttgagaagcacgtcgctgaggctgacatttatcttgtctcggtgaacacccccaccaaagaccggtgggcttggagctggcaggctgccgaccttcactactgggagagcgctgcccgcatgatggcngatgtctcccaatctacaagaattgttgtgaaaaagtcactgtccctgtcaagacgcttaag

SEQ ID NO: 42628 - protein, 134 aa, Zea mays
  misc_feature: Ceres CLONE 1441250-F
  misc_feature (2)..(133): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (67)..(67): Xaa is any aa, unknown, or other
MVKICCIGAGYVGGPTMAVIALKCPDIEVVVVDISKPRIEAWNSDTLPIYEPGLDDVVKQCRGRNLXLSTDVEKHVAEADIYLVSVNTPTKDRWAWSWQAADLHYWESAARMMADVSQSTRIVVKKSLSLSRRL

SEQ ID NO: 42629 - DNA, 700 bp, Zea mays
  misc_feature: Ceres CLONE 1441252-F
aagctggagctccccgcggtggcggccgctctagaactagtggatcccccgggctgcaggaattcgcacgagaccattacctagaacatcctaatcgaaaaattctcgatccctctacctctcgcatccggtgcctggctgccagccccagcgctcgccaacctcatcttccccggcgtttcctcctagctccctccaccatgccgctgccatggaactcactgctcggccgcgccctggccatgctccctgcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcgcccagcctgttggcacacgcactcctctgtcgcacgctcctccaagtcagagctccctctggccgttcccatggtcgcccctctctcagcttcatcttcagctgctcggctcccaggtgcgcgcgttct

SEQ ID NO: 42630 - DNA, 843 bp, Zea mays
  misc_feature: Ceres CLONE 1441254-F
ttttttttttttttttttttgggcgcggaaggacccccccccctttggggctccccgcggtggcggccgctctaaaatagtggatcccccgggctgcaggaattcgcacgagaccattacctagaacatcctaatagaaaaacactgatggccccgccagatccaagccgcgacccagacggcaagatagagcgagcgatctctcaattctccccatcccgccgtgcttcccgtcttcaccaaatccttccccacgatggcgcgcctgctcatccccctccgcttcgccgccgcgtctgcgtcaccgctccacatcgacgtctcccgccttcctctcgcccggggcctctcgccggcgcgtgcgcgagggtctcctctggcgggaccggagcaacaaggaccgtcaaagggtgctcgtcgaggggggccacgcgagggtatagacaccaacactaaatgagggccgcccccccccccccctggcggaggtcttatgttaatgggcccaatacggacgtgaccttccgcgctgcgatgtcttccgccgccgcccccgaaccacccccgatcaccatctgctcttgttcccccaacaagcacgggaagtggcgtcgtgttaggtgaaatacgtcaccctccccctttgcatggtcaccccctcctgcgccccactcacatccaccagtcccgcgaagtatcactactaattgcccgcctccaagccaacgcccctaccgtctaaggcgcgcggccgaacggcgttgccgtcttacccccgatcaccgccatagccaccatacaatacacatataattcacgtatcattgccttcctctctccctc

SEQ ID NO: 42631 - DNA, 701 bp, Zea mays
  misc_feature: Ceres CLONE 1441264-F
  misc_feature (52)..(52): n is a, c, t, g, unknown, or other
  misc_feature (288)..(288): n is a, c, t, g, unknown, or other
  misc_feature (663)..(663): n is a, c, t, g, unknown, or other
  misc_feature (664)..(664): n is a, c, t, g, unknown, or other
aaagctggagctccccgcggtggcggccgctctagaactagtggatcccccngggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggncagaatcaggagagagatagcagggggggctagctagctgagctcgtgcgacgaaaaatgcccgaaatggcaagaacattgtgggccccttcctggggcccaacccatcatgaaattatccgcaatcggtttcggagttggaacctaaacccttttataaagggaaaacaattcccccgggtgggcgggaaaaggccaaatttttttttccggggttccccccccggcccggggggggggggggccccaaaaagggggggggggccccagtggggccggggggcccaaaaattgggcaaaaaaacgccggggttttttttttcggggggaaaaaaaggcccccttttttgggtgggggggagaaaaaaacccccnnaaacccccccctgtggccccccccttataaggaaacc

SEQ ID NO: 42632 - DNA, 666 bp, Zea mays
  misc_feature: Ceres CLONE 1441266-F
  misc_feature: Encodes the peptide sequence at SEQ ID NO. 42633
  misc_feature (552)..(552): n is a, c, t, g, unknown, or other
acccgcggtggcggccgctctagaactagtggatcccccgggctgcaggaattcgcacgagaccattacctagaacatcctaatcgaaaatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccttatctgaacacgtatgacggccgcaccatccgctaccctgaccccctcatcaaggccaacgacaccatcaagatcgatctggagaccacaagatttgtgactttcatcagtttgatgtttgcaacgtcgtcatggtgacctgcgaaaggaacactgccccgtgggtgttatcaagaacagggagaagccnaggcagctttgagacattcacgttgaggatccttgggcaccattccccaccgtatggcaacgtgttcccatcggcagggtaataccctgggggacccgcccaaggcaaggaaca

SEQ ID NO: 42633 - protein, 117 aa, Zea mays
  misc_feature: Ceres CLONE 1441266-F
  misc_feature (29)..(105): Pfam Name: Ribosomal_S4e Pfam Description: Ribosomal family S4e
MQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETTRFVTFISLMFATSSW

SEQ ID NO: 42634 - DNA, 708 bp, Zea mays
  misc_feature: Ceres CLONE 1441267-F
  misc_feature: Encodes the peptide sequence at SEQ ID NO. 42635
  misc_feature (419)..(419): n is a, c, t, g, unknown, or other
  misc_feature (452)..(452): n is a, c, t, g, unknown, or other
  misc_feature (520)..(520): n is a, c, t, g, unknown, or other
  misc_feature (534)..(534): n is a, c, t, g, unknown, or other
aaagctggagctccccgcggtggcggccgctctagaactagtggatcccccgggctgcaggaattcgcacgagaccattacctagaacatcctaatcgaaaaacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttcctttttcactcaaaatatgagctgctacttncagcaaggtccgcgacaaaggtacctttccttnagttgggaccatacctgctgcagccaccctctgtacgggagtctgagcttatccagagactacctttnttgtgaaaatgcancacaaggagctactggatgagctgggcatcccaaccgaggagccccagtttgaccaatcccccctttggggcgaatggcttaacaggccccttttacgggaatgggggggaacaaaacttgccacccggggtttaccccccgggaatggaggggccccccaaccccaataaatc

SEQ ID NO: 42635 - protein, 106 aa, Zea mays
  misc_feature: Ceres CLONE 1441267-F
  misc_feature: SWISSPROT Homolog: EC 5.3.3.2 Isopentenyl-diphosphate Delta-isomerase
  misc_feature (72)..(72): Xaa is any aa, unknown, or other
  misc_feature (83)..(83): Xaa is any aa, unknown, or other
  misc_feature (105)..(105): Xaa is any aa, unknown, or other
MAAAVVDDAGMDAVQKRLMFEDECILVDEQDNVVGHESKYNCHLMEKIDSENLLHRAFSVFLFHSKYELLLXARSATKVPFLXLGPYLLQPPSVRESELIQRLPXL

SEQ ID NO: 42636 - DNA, 706 bp, Zea mays
  misc_feature: Ceres CLONE 1441272-F
  misc_feature: Encodes the peptide sequence at SEQ ID NO. 42637
tccccgcggtggcggccgctctagaactagtggatcccccgggctgcaggaattcgcacgagaccattacctagaacatcttaatcgaaaagcgaggtcgaaatccccaaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcagggtcagagtacctacccagcagaccagcaaatgctcatataccaagggaaaattctgaaggatgagaccactttggaaagcaacggagttgctgagaacagcttccttgttataatgctgtccaaggctaaggcatcgtcaagtggagcttccaccgctactgctgcaaaagctcctgcaacttcagcccaacttgctgcccctgccacatcattgtaaagacacctacccaagctcctggtgccacagctgaaacggaccctccaagtgcacaaactcagggtggtccagctgctacggttgctgcatcgaaaggagctaattggtaccggccaggcactttcaaccttggttcgggccccaccttaaaacaacatttcccacaattcgtggcaggggggggggg

SEQ ID NO: 42637 - protein, 106 aa, Zea mays
  misc_feature: Ceres CLONE 1441272-F
  misc_feature (6)..(78): Pfam Name: ubiquitin Pfam Description: Ubiquitin family
MKLNVKTLKGTNFEIEASPDASVAEVKRIIETTQGQSTYPADQQMLIYQGKILKDETTLESNGVAENSFLVIMLSKAKASSSGASTATAAKAPATSAQLAAPATSL

SEQ ID NO: 42638 - DNA, 721 bp, Zea mays
  misc_feature: Ceres CLONE 1441276-F
  misc_feature: Encodes the peptide sequence at SEQ ID NO. 42639
  misc_feature (309)..(309): n is a, c, t, g, unknown, or other
  misc_feature (332)..(332): n is a, c, t, g, unknown, or other
aaagctggagctccccgcggtggcggccgctctagaactagtggatcccccgggctgcaggaattcgcacgagaccattacctagaacatcctaatcgaaaagctatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttnatctgcacatgcttgacattccngcagcagctgaagcccttaatggtggtaagatgaagtgggtgatgctgccttttctcctactgaggggggtgttgcctccacctgattttggggaaacctgcctgggtccaaagggccctcagggttggggggttcccccgaaggggggaatggaaaggaaaaatttttttcaaaaaagtttttacctaaaaacccaaattttcccctttgaacccctggggctccccaagagaggttttggggggtccacccccaaaaaaacaaggttttttttgaaaaaaattcccccctttcccaaaaaaaaaattttttttcccccccccggggaaaaaaaggggtttttggaaaattttaaaaaaaaattttcggttttttgggagaaaaaata

SEQ ID NO: 42639 - protein, 174 aa, Zea mays
  misc_feature: Ceres CLONE 1441276-F
  misc_feature (6)..(150): Pfam Name: Ldh_1_N Pfam Description: lactate/malate dehydrogenase, NAD binding domain
  misc_feature: SWISSPROT Homolog: EC 1.1.1.37 Malate dehydrogenase
  misc_feature (38)..(38): Xaa is any aa, unknown, or other
MAKEPMRVLVTGAAGQIGYALVPMIARGVMLGADQPVXLHMLDIPAAAEALNGGKMKWVMLPFLLLRGVLPPPDFGETCLGPKGPQGWGVPPKGGMERKNFFQKSFYLKTQIFPFEPLGLPKRGFGGSTPKKTRFFLKKIPPFPKKKIFFPPPGEKKGFLENFKKKFSVFWEKK

SEQ ID NO: 42640 - DNA, 710 bp, Zea mays
  misc_feature: Ceres CLONE 1441278-F
  misc_feature: Encodes the peptide sequence at SEQ ID NO. 42641
  misc_feature (392)..(392): n is a, c, t, g, unknown, or other
  misc_feature (442)..(442): n is a, c, t, g, unknown, or other
  misc_feature (494)..(494): n is a, c, t, g, unknown, or other
aaagctggagctccccgcggtggcggccgctctagaactagtggatcccccgggctgcaggaattcgcacgagaccattacctagaacatcctaatcgaaaaaaacgcaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccccttcactcatcatggctgtgtacaggtcaaatggagatngtggatctatctcctttgtggtctttctctacctggtcctcgttctgctngtctactgcctgcgccccgatcgagacactccccaagagtcgctaggccggnagcacataaaaatggccgtgtgggtactccacaagatgctcactgcgggcgtctcaaacaaggggggaagcattttgcccctccccgggcagggcctgtgttgggcaaaggaaagaacaccgggttccgggggttttttagttttctcccccccccagaaaaaccccccccgtggacccccaaaaacaaaagggggggcccttccctttaaccggg

SEQ ID NO: 42641 - protein, 161 aa, Zea mays
  misc_feature: Ceres CLONE 1441278-F
  misc_feature (56)..(56): Xaa is any aa, unknown, or other
  misc_feature (90)..(90): Xaa is any aa, unknown, or other
MASKQQQKQFLDEAMIKQPTPEEDREGAWPSVLTIIGFGFLTPSLIMAVYRSNGDXGSISFVVFLYLVLVLLVYCLRPDRDTPQESLGRXHIKMAVWVLHKMLTAGVSNKGGSILPLPGQGLCWAKERTPGSGGFLVFSPPQKNPPRGPPKTKGGALPFNR

SEQ ID NO: 42642 - DNA, 712 bp, Zea mays
  misc_feature: Ceres CLONE 1441285-F
  misc_feature: Encodes the peptide sequence at SEQ ID NO. 42643
  misc_feature (630)..(630): n is a, c, t, g, unknown, or other
  misc_feature (712)..(712): n is a, c, t, g, unknown, or other
tccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgatcttgtccccttcaccaacaaggtgtacaacggcagcctggacaagcggctgggcgtcaccgcgggcatctgcgtgctcatccagcacgtccccgacccgcacngcgaccgctacgaggccatctacagcttctacttcagagactacggccacatctcggtgcaggggccgtacctgacctacan

SEQ ID NO: 42643 - protein, 159 aa, Zea mays
  misc_feature: Ceres CLONE 1441285-F
  misc_feature (59)..(159): Pfam Name: Allene_ox_cyc Pfam Description: Allene oxide cyclase
  misc_feature: SWISSPROT Homolog: EC 5.3.99.6 Allene-oxide cyclase
  misc_feature (133)..(133): Xaa is any aa, unknown, or other
MAAALRCPASVRVSGPAAAGLAKVRQASRVVAVSGARQSRSGGVAVRASLFSPKPAAAKDARPTKVQELYVYEINERDRESPAYLRLSAKQTENALGDLVPFTNKVYNGSLDKRLGVTAGICVLIQHVPDPHXDRYEAIYSFYFRDYGHISVQGPYLTY

SEQ ID NO: 42644 - DNA, 700 bp, Zea mays
  misc_feature: Ceres CLONE 1441286-F
  misc_feature: Encodes the peptide sequence at SEQ ID NO. 42645
  misc_feature (636)..(636): n is a, c, t, g, unknown, or other
tggagctccccgcggtggcggccgctctagaactagtggatcccccgggctgcaggaattcgcacgagaccattacctagaacatcctaatcgaaaagtacaggaagcgctagaacaacgcgaccgccgccgcctcagctactcgcctggtgatgggcgtcgaactggcgcaaccgaccgccgccgcggctgcggtgaccaccgctgagcaggctcaggatctcatcgacgccgctaggtacgacgacttggaggacgtcgtcgccctgttctccgctggtgtctcgctggactccacagattcgcaaggccgcacagctcttcacatggcttctgccaatggtcaccttgctgtggtggaatacttgattcaaaatggagcgaatgttaacgccaccaacatggagaagaacacaccactccactgggcatgccttaatggacgtatagaggtaatcaggggctttgatctcagcggggggctagcgtgagtgctctgaacagccacgagaaaaacgcaatggacgaaagcgtgaccacaggcaagatgcacgtgatcgacgcgatcggtgcggcagtagctcaagccgagctcaacggcgttactgtctcctaaaagacctgatgagtacctgnagctttgaatgacttgcagccttttgtctatctcccagcgttcttgctgtatcctccccaacta

SEQ ID NO: 42645 - protein, 112 aa, Zea mays
  misc_feature: Ceres CLONE 1441286-F
  misc_feature (52)..(84): Pfam Name: Ank Pfam Description: Ankyrin repeat
  misc_feature: SWISSPROT Homolog: EC 2.1.1.43 Histone-lysine N-methyltransferase
MGVELAQPTAAAAAVTTAEQAQDLIDAARYDDLEDVVALFSAGVSLDSTDSQGRTALHMASANGHLAVVEYLIQNGANVNATNMEKNTPLHWACLNGRIEVIRGFDLSGGLA

SEQ ID NO: 42646 - DNA, 708 bp, Zea mays
  misc_feature: Ceres CLONE 1441289-F
  misc_feature: Encodes the peptide sequence at SEQ ID NO. 42647
  misc_feature (444)..(444): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcgaaaaaagacgatctgcgaaacaaacactagtgcgtttgcgagagaaaccgagaaagagaagctacagagtcactgaccgaccgctatggcatcgaggcaaaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctggagagcgtgcaggagggcgccaggtccttggccagcgccgtgagccgcaccttcggtggcgccaggacgcgaccgtgnacagaactcgcagacgcgccaccgcgggcgacaagctcgcgagtacaggactacaccgtcaacaaggcccggaaggccaacnacggggttcccataaaaacgggcaaaccgccaaggccccccggacaagctgggccaatacaagaccgccccctggaaaagggagggaaacaaggacccggttggcccaaaaacaagcgaaaccccggaggggacccaaaaaacccctccggaagaaaaagggcccccccccccgtaaaaggc

SEQ ID NO: 42647 - protein, 175 aa, Zea mays
  misc_feature: Ceres CLONE 1441289-F
  misc_feature (87)..(87): Xaa is any aa, unknown, or other
  misc_feature (115)..(115): Xaa is any aa, unknown, or other
MASRQNTREARAEADARRAVEELARARDEHLEKAEVNARSAADEIARSRADRGAAGGGGILESVQEGARSLASAVSRTFGGARTRPXTELADAPPRATSSRVQDYTVNKARKANXGVPIKTGKPPRPPGQAGPIQDRPLEKGGKQGPGWPKNKRNPGGDPKNPSGRKRAPPPVKG

SEQ ID NO: 42648 - DNA, 718 bp, Zea mays
  misc_feature: Ceres CLONE 1441295-F
  misc_feature: Encodes the peptide sequence at SEQ ID NO. 42649
  misc_feature (434)..(434): n is a, c, t, g, unknown, or other
  misc_feature (460)..(460): n is a, c, t, g, unknown, or other
  misc_feature (490)..(490): n is a, c, t, g, unknown, or other
  misc_feature (505)..(505): n is a, c, t, g, unknown, or other
  misc_feature (516)..(516): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (547)..(547): n is a, c, t, g, unknown, or other
  misc_feature (552)..(552): n is a, c, t, g, unknown, or other
aagctggagctccccgcggtggcggccgctctagaactagtggatcccccgggctgcaggaattcgcacgagaccattacctagaacatcctaatcaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgnaatatatctatctagctttgtgtggntggttgaacaataataaagcgagccgagcntgctgccatacatangtatttgtgtngtgtgtgaaaaaaaaaaaaaaacnnanntcntcagnttgctacctctccctctgcatgtttggcggtcagccttgggccccatgaaccgggggctacatgcatggtgggttgatcccaatggcctctgctgtaaccataaattaattgggcccccgagggaatggtttggaccctttttttattttttaccccaaaaaaaaa

SEQ ID NO: 42649 - protein, 76 aa, Zea mays
  misc_feature: Ceres CLONE 1441295-F
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAAESGEAAHACGCGSSCKCDPCNC

SEQ ID NO: 42650 - DNA, 695 bp, Zea mays
  misc_feature: Ceres CLONE 1441297-F
aaagctggagctccccgcggtggcggccgctctagaactagtggatcccccgggctgcaggaattcgcacgagaccattacctagaacatcctaatcgaaaaattagcacatagcggtccattcccttcgtgcttgtttgctctagggtttttgctacgtcgccgccgctctgccccttctcacccctgcgatttactcagatgactgcgtaggtggcggaggatctcgtcgcccgtatctagcagcataggctcgaggagtgtactacctaggcagattaggttgtggtgtatgatgatgactaggatgatgatgatgacttattatgatgacatggatgatgattagctgtcatggacaaaagagtcatggcagtggcacgtctaagcgtagcatgagtgacaataacagccgcatggtcctgctgaaactagccatgaatcccatcactggagtagctctgctcactgtgaagacaagtgccatatgctttttgtcatctcgaagccggatgtgttcaagagcccgagctcttacacatatgtcatattcagagagtcgaaaatcgaggacttcagatcccgtctgcttactcttgttgcaaagtaatacaagtctctagacgtgattccgtatgatccgcagccctgatacatctgatcatggacttggagaacaactggatcatcaggtt

SEQ ID NO: 42651 - DNA, 802 bp, Zea mays
  misc_feature: Ceres CLONE 1441297-R2
  misc_feature: SWISSPROT Homolog: EC 2.3.1.74 Naringenin-chalcone synthase
gtccgggccccccctcgaggtcgacggtatcgataagcttttttttttttttttttgaaatttcttatttttttaagttgttttgctttgtgaaaaaacaattcatttcttttagattcatatcttattatatgcatttctctctctgttgaaatgactataaagcaaaaggggactgtttcttgagcctcaaggtagaaccaaaacacccactttctgctcaaacatcgagattccttgcaacgataccttcaaatgtaacaccaggtccaaaagccagaatcagaccccactcattttcaccttcattcatcttccttgctttcctgctctcctccaacatatactccaacacgtaaacgatcgaattgctacttgcgttgccatagtccatgagagatcttctgcttggactcagcttctccggcgacaggttaagccgcttttccattcggttcaatatggctggtccacctggatgaaccgcccaaaacatctggttatagtctttatgagccagtcctgcttttcctagtagcttcttgcagaaactctccacgttgtcttctattatctgtgggagctctcttgatagtgtgaagtttatgcctgattccgttagcctcccatctattgtcttctccgtgtcaggtagaaaattttgaattgccgtgtgaagctcaaagagtggcttctcaataaccagtctggatcagacccgatgatcatagctccggcttcctcaccaaaaaaagcgaaccaacaaaatccgtcgggctatcttttactcggcggtgttaaa

SEQ ID NO: 42652 - DNA, 869 bp, Zea mays
  misc_feature: Ceres CLONE 1441297-R
  misc_feature (1)..(1): n is a, c, t, g, unknown, or other
  misc_feature (253)..(253): n is a, c, t, g, unknown, or other
nttttaagtcgttttgctttgtgaaaaacattcatttcttttagattcatatcttattatatgcatttctctctctgttgaaatgactataaagcaaaaggggactgtttcttgagcctcaaggtagaaccaaaacacccactttctgctcaaacatcgagattccttgcaacgataccttcaaatgtaacaccaggtccaaaagccagaatcagaccccactcattttcaccttcattcatcttcctgtggnctttccctagctcctccctccaacatatactccaacacgtaaacgatcgaattgctacttgcgttgccatagtcatgagagatcttctgcttggactcagcttctccggcgaacaggttaaagccgccttttcccattccagttccaataatgggctggggtcccaccttggaattggaaaccggggccccaaaaaacaccgggggttaaaggcctttatggaaacccaaggcccgggcctttttcccaaaggaagccttcccttgggaaaaaaaccccccccccccttgtgatgccctcagaattaaccggggggaaacccccccccttgaaaaaagggggagaaaattttattccccaaaattcccctttgcccccccccctttttttgttctccccccgggggggggggaaaaaaaatttggaatttgcggggggggtgagaaacccaaaaaaagagggggttcctccccaaaaaaacgggggggggggggaaaaaaccccccgtatttaaatttttctccccggggggcccttcccccaaaaaaaaagaaggggcccacccaaaaaaaaattttgggggggggggttttttttttttctccgggggggggga

SEQ ID NO: 42653 - DNA, 708 bp, Zea mays
  misc_feature: Ceres CLONE 1441298-F
  misc_feature: Encodes the peptide sequence at SEQ ID NO. 42654
aaagctggagctccccgcggtggcggccgctctagaactagtggatcccccgggctgcaggaattcgcacgagaccattacctagaacatcctaatcgaaaatgacatatgagggtgccgttgatttggagaacatggatgatatgttacaaaagtccgctattgaggaccaaattgcaaattttggacaaacaccaattcaaatttttcggaagaaacacccaaggagaggtcctcctataccaattgtgcatccactatattttgcgccacaatcgataacagtgacttctgttgtcccgaccatagtcacccctttatctgtattattcattggtttgttggactcaaacgttgtcatgatgaatgaggggctcatactctctgtaaagctttggctaacaacacagttgcagtctggtggaaacttcacattttctggatcactggaacctttcttcggaattggttctgatgttatttctccgaggaaaattggcacttctttggctgaaaatgttgagtttggaagacaatgcttagcaactgttcaaattcgtggtgacaattacttaattttgtgtggtaattgggagaatagtttccagatcatatctctaagtgatggaaaaattgtgcagagcatccggcagcataaagatgtagttagtttgtgtggcagtttcatcctgacggaagtgtgattgc

SEQ ID NO: 42654 - protein, 200 aa, Zea mays
  misc_feature: Ceres CLONE 1441298-F
MTYEGAVDLENMDDMLQKSAIEDQIANFGQTPIQIFRKKHPRRGPPIPIVHPLYFAPQSITVTSVVPTIVTPLSVLFIGLLDSNVVMMNEGLILSVKLWLTTQLQSGGNFTFSGSLEPFFGIGSDVISPRKIGTSLAENVEFGRQCLATVQIRGDNYLILCGNWENSFQIISLSDGKIVQSIRQHKDVVSLCGSFILTEV

SEQ ID NO: 42655 - DNA, 671 bp, Zea mays
  misc_feature: Ceres CLONE 1441342-F
  misc_feature: Encodes the peptide sequence at SEQ ID NO. 42656
aaagctggagctccccgcggtggcggccgctctagaactagtggatcccccgggctgcaggaattcgcacgagaccattacctagaacatcctaatcgaaaaaccctcccccatttttcccttggttggccgtcccctctcctcccatggcagccgcccaccatttcttcctcctccatagatctccccctcccccatgcagcaaggatcgagaagaggaggagcaagatggattgaagaggaagagaggatcaaggagatgttctacccccccatctattgcagattttcttggggaaactctaggtacttgattcatgttgggaatgaggggagtagcagcacgtccaccttcactctcataataacgctgcccaggcacaaccatgatttaattagaaacttcttgtcaaaggatgtttgtctttaactagtcatgcacactagttaattcaattcatgtcgttatggttatcttctcattgctagccgattattaatgtctattatgttttcttatcatgatatctgcttatactctgttgcttccacgtttatgcaaattttcaaaggagatgctgtcaaaattttatatatgaatgttagttgtgtagtttagtagcatttcaggatgtttgtggatcctggggtgttacagaagacgagagcta

SEQ ID NO: 42656 - protein, 55 aa, Zea mays; identical to SEQ ID NO: 16588
  misc_feature: Ceres CLONE 1441342-F

SEQ ID NO: 42657 - DNA, 524 bp, Zea mays
  misc_feature: Ceres CLONE 1441347-F
  misc_feature: Encodes the peptide sequence at SEQ ID NO. 42658
  misc_feature (194)..(194): n is a, c, t, g, unknown, or other
aagctggagctccccgcggtggcggccgctctagaactagtggatcccccgggctgcaggattcgcacgagaccattacctagaacatcctaatcgaaaatctagtcatctcgtctcggttgcggccgaacagagcccgtccaactcaccacctctcttctctcggcgcgagcagggcggcgccggcgcgcgtncgcgggaacggggctcgctctcccatctctcgatcacttctgtcctgtgaaaatgcggatgaactacgctccacgtctgtgggtcagaggtccatgggcagtccctgctgttgacaaattcccttctatttccgccctgaacaaccctgttttaaaatggccatttcgggtcaaagggcccccaagggtcattcctggggtgaaaagcacctgtggaaccccatttgggtggggcccccccccccggttttttttttcttcccccaaaaaaaaagaggcttttcccggggttttgaaccccccttttttggggggggggggtttttcccc

SEQ ID NO: 42658 - protein, 92 aa, Zea mays
  misc_feature: Ceres CLONE 1441347-F
MRMNYAPRLWVRGPWAVPAVDKFPSISALNNPVLKWPFRVKGPPRVIPGVKSTCGTPFGWGPPPRFFFSSPKKKEAFPGVLNPPFLGGGGFS

SEQ ID NO: 42659 - DNA, 789 bp, Zea mays
  misc_feature: Ceres CLONE 1441354-F
  misc_feature: Encodes the peptide sequence at SEQ ID NO. 42660
  misc_feature (12)..(12): n is a, c, t, g, unknown, or other
  misc_feature (41)..(41): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (433)..(433): n is a, c, t, g, unknown, or other
  misc_feature (691)..(691): n is a, c, t, g, unknown, or other
ggggggccgccngggggttttctcctccccccccacgatanaacgtnttnnnnaaaaagtggggctccccccggtggggggcgctctacaatagtggatcccccgggctgcaggaattcgcacgagaccattacctacaacatcctaatcgaaaaatatttcagtcgtctctcgaggagccgtggcgcatcgcgactcaggcactcaccgaccgctgatatggccccgccgccatggcctctccttgccacttccctcctccgcatcctattccaccactcggctcgcgccgcggtggcgtttccgccgtctcggggcgacagcctcctgggcgccccccgcgcgccgggtttcgcgggttggctgcgcggcttgcggagccgcatccacgagccccccgagctcgccttccaggagcaccgaaggatggagnacccccgccacgagctcgaggcgatgggggtggggtgggccccgcccgtcgccgagagcggggggcgcggcaaccctcgccgggcgcaagccatggccccgtctgggcggcgccgaggccgacgtggacgcgcctacccttcggcggacttggggggaccggggaaacccggaccgggggagacgtggcgacgaggggtgggtctgtggggacgtggcgcgtcgcgagcccccagagggcttgcctggggggggcggncgaagaacggagtttccatggcgtcgcggccagggaagcgatccctggggaggggtcgcaccccctcgcgcgcgacttggttggcttctccgaggacg

SEQ ID NO: 42660 - protein, 190 aa, Zea mays
  misc_feature: Ceres CLONE 1441354-F
  misc_feature (72)..(72): Xaa is any aa, unknown, or other
  misc_feature (158)..(158): Xaa is any aa, unknown, or other
MAPPPWPLLATSLLRILFHHSARAAVAFPPSRGDSLLGAPRAPGFAGWLRGLRSRIHEPPELAFQEHRRMEXPRHELEAMGVGWAPPVAESGGRGNPRRAQAMAPSGRRRGRRGRAYPSADLGGPGKPGPGETWRRGVGLWGRGASRAPRGLAWGGRXKNGVSMASRPGKRSLGRGRTPSRATWLASPRT

SEQ ID NO: 42661 - DNA, 641 bp, Zea mays
  misc_feature: Ceres CLONE 1441356-F
  misc_feature: Encodes the peptide sequence at SEQ ID NO. 42662
aagctggagctccccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgcccccaagccgcggcgccccgcggcgcccctgcggtgccaccagggcggcgacgccggcatggatctgctcgacctcctcctgtcaaagcacagtgtttagggtgatgaacagtgaccactgaccgctatatctgggggaaaagagagggaacgaaccctaggggggcctttaaggggccccccccttgcggcccataaaaaattgtttttgcc

SEQ ID NO: 42662 - protein, 63 aa, Zea mays
  misc_feature: Ceres CLONE 1441356-F
MSHFAAAAVKSPLAVAAPAAGDAKSPLFCPQAAAPRGAPAVPPGRRRRHGSARPPPVKAQCLG

SEQ ID NO: 42663 - DNA, 694 bp, Zea mays
  misc_feature: Ceres CLONE 1441362-F
  misc_feature: Encodes the peptide sequence at SEQ ID NO. 42664
  misc_feature (360)..(360): n is a, c, t, g, unknown, or other
tggagctccccgcggtggcggccgctctagaactagtggatcccccgggctgcaggaattcgcacgagaccattacctagaacatcctaatcgaaaaagcatttcgatcccgacaccccaaaatccctcagccctctggcctcggcggcgctcaaaccttcgccgtcccgccgtctccaaaaccctcttaccatggccgccgcgacaaccgcgggggccggagccgcgacgccgcagccgccacggcagtacaagctagctccgcaaagcgagctgcgtgtggaggtgctcaccgacgcgcccctccgagtgcgcctcgtcactggcaccgcagaaatcttcggcaccgagctgcctccngaaggctgggtccccttccctccccatccaaaatcgccatttccacctgcaacggcccaaccgtggaactggacgggttgaggcaaaaccattaccttttgaaacaaactcccatgggaattttttgtccaaccccacgccttttttggttccccccgggggaaggggaaaaaaccccccccctccggggggggcaaaagagagatcccccggcccccaaggtgttatttgtgggggcacaaaatatttaaaaaaaacccccctcaaaaaagtttttttagggggggccccaaaggggggggggaaacccccctttttttttttttattttcgc

SEQ ID NO: 42664 - protein, 82 aa, Zea mays
  misc_feature: Ceres CLONE 1441362-F
MAAATTAGAGAATPQPPRQYKLAPQSELRVEVLTDAPLRVRLVTGTAEIFGTELPPEGWVPFPPHPKSPFPPATAQPWNWTG

SEQ ID NO: 42665 - DNA, 641 bp, Zea mays
  misc_feature: Ceres CLONE 1441375-F
aaagctggagctccccgcggtggcggccgctctagaactagtggatcccccgggctgcaggaattcgcacgagaccattacctagaacatcctaatcgaaaagggagaaaatctccaaacgcagcagagcccctcgcgccggcggcctctgcagccttgcatcacaccgtcgccagaccgagtgaccgctgcagcctatgtttcctgctcctatggccgtaaagtaaggaaaggtctgctggctgcccagacgacggccgccactagcaccgaccagggacaggacaagaataagggccccgtgtgccgctctttccgcggccgggtcccaattctccggggggttcatacaaccccaagcttaagtgcggggcctcttggaggagggggcgtgggaggcacctcccccgattatttcggcgccttcccccaggagctccccggcccagaacccccagggtgggcggggaaaccttttaaggaactccaggtcgaggggattaaccccccggcaacctgcggggtcccccacacccggggaggagggagttccaaaaccccccttcaaagggaacaatcatccggggggggggggttttctccccgaatcaccaagaatgtgcctacaccaggaagcgccg

SEQ ID NO: 42666 - DNA, 723 bp, Zea mays
  misc_feature: Ceres CLONE 1441378-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcgcacgagaccattacctagaacatcctaatcgaaaaagcataatacgatttacggtttccttaccttagaagctttttcttccgacgtcgcctcagccctcgcctcgagctgatgtactctgtcatctccttcgccgttgtctaccagatcatcccatggcgtgcgaaaccaagcatgacaaccgcatggcggatatgcaggtccagaagctcggtgctcatatctccgtcggggatagcggtggatcgtctcacctccctccggccagggtattgggacaatctaagccgcccagctccccggtttttcccaagggaaggggaccctttcaaggcccttttgggaacccggtgaaattcaaacaattcccgggaaaatttccccaaaccgggggcctaaaaaggcaactcccccccccccggaaattgggcccaaagggggcaaaaaaaaaaaaaaactct

SEQ ID NO: 42667 - DNA, 655 bp, Zea mays
  misc_feature: Ceres CLONE 1441380-F
  misc_feature (538)..(538): n is a, c, t, g, unknown, or other
aaagctggagctccccgcggtggcggccgctctagaactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgagtacatgtgacgatgcacttaaacttctctgcagtgctttcggatgtcaaatagaagagataacattacctgagcttgaagagatgcgtactgctcatgttgtctcaattgactcagaatcattctgtgacttgaatcctcattacaaagcaggaagaaaaactgagtttaccttggatactcgaacaagtttggcactttttgggtctttcactgcaactgattatgtggcttctcanagtataaggaggaggataatgcattatcacatgcaagctttcaagaaggtcaatgtcatagcaactgctacaactggcattactgctccaaaaataccctcaagtgctctgaagtcc

SEQ ID NO: 42668 - DNA, 621 bp, Zea mays
  misc_feature: Ceres CLONE 1441391-F
  misc_feature: Encodes the peptide sequence at SEQ ID NO. 42669
  misc_feature (379)..(379): n is a, c, t, g, unknown, or other
  misc_feature (380)..(380): n is a, c, t, g, unknown, or other
  misc_feature (388)..(388): n is a, c, t, g, unknown, or other
  misc_feature (389)..(389): n is a, c, t, g, unknown, or other
ggagctccccgcggtggcggccgctctagaactagtggatcccccgggctgcaggaattcgcacgagaccattacctagaacatcctaatcgaaaaatcacctataatattttgagcattcagaaacacacctagggaagcgcactagcaacgacctaacaacaatggctaccaagatattatccctccttgcgcttcttgccctttttgtgagcgcaacaaatgtgttcattattccacaatgctcacttgctcctagtgccattattccaaagttcctcccaccagttacttcaatgggcttcgaacacccagctgtgcaagcctacaggctacaacaagcgcttgcggcgagcgtctttacacaaccaattgcccnnattacacnnacatcctggcacatctaacaatacaaccatcgcaacgcacagcaacacagttcctaacagcactgagccaactagccatggtgacccctgccccctacttggaaaaaaaaaggtttgcatccaacgacttggtctggggaaccgtttttcaaaccaccaaaaaaaatagttgcaaaagttttggcccggcgtcaaaaaaataagcggggggaaaccgggcccacaaaataaa

SEQ ID NO: 42669 - protein, 80 aa, Zea mays
  misc_feature: Ceres CLONE 1441391-F
  misc_feature (72)..(72): Xaa is any aa, unknown, or other
  misc_feature (75)..(75): Xaa is any aa, unknown, or other
MATKILSLLALLALFVSATNVFIIPQCSLAPSAIIPKFLPPVTSMGFEHPAVQAYRLQQALAASVFTQPIAXITXTSWHI

SEQ ID NO: 42670 - DNA, 651 bp, Zea mays
  misc_feature: Ceres CLONE 1441392-F
  misc_feature: Encodes the peptide sequence at SEQ ID NO. 42671
aaagctggagctccccgcggtggcggccgctctagaactagtggatcccccgggctgcaggaattcgcacgagaccattacctagaacatcctaatcgaaaatcatacatttcgactctcaactcccaaggtccctttttttttctcgatctggaagcgccgcactaacagccatggacgtgagcggagcaggcggtaaggcgaacaagggcgcggcggggcgcaaggccggagggccgactaagaaatctgagtcgcggtcctccaggggcggggtgcagttccccgtcggccgcgtcgggcggtacctcagaaagggccggtacgctcagcgtgtaggcacgggtgcccccgtctacctcgccgccatcctgaagaacctcgcgaccgaggtgctcgagctcgccggcaacgcggcaagggacaacaagaagacgcgcatcatcccgcgccacgtgctcctcgccatccgcaacgactaggagctcggcaagctgctggccagcgtcacattcgcccacggcggcgtcctccccaacatccacgctgtgctcctccccaagaaggtggccgagaaggcggacaaagagcccaagaacggcgctaagtcccccaagaaggcggagagcgatctcctgtcttagaacaaaa

SEQ ID NO: 42671 - protein, 102 aa, Zea mays
  misc_feature: Ceres CLONE 1441392-F
  misc_feature (29)..(102): Pfam Name: Histone Pfam Description: Core histone H2A/H2B/H3/H4
MDVSGAGGKANKGAAGRKAGGPTKKSESRSSRGGVQFPVGRVGRYLRKGRYAQRVGTGAPVYLAAILKNLATEVLELAGNAARDNKKTRIIPRHVLLAIRND

SEQ ID NO: 42672 - DNA, 616 bp, Zea mays
  misc_feature: Ceres CLONE 1441398-F
  misc_feature: Encodes the peptide sequence at SEQ ID NO. 42673
  misc_feature (490)..(490): n is a, c, t, g, unknown, or other
ggagctccccgcggtggcggccgctctagaactagtggatcccccgggctgcaggaattcgcacgagaccattacctagaacatcctaatcaaaaatactccctcatattcttaccaaaacacaggattccgtcggccgtctcccaaaaaccaaacaagaccaccgccccttggaatcactggatcttcgcggttcgacggccgcctcgcctttgcaacgacgcatgctgctccccgggcggcagcgcgcgacgtacgtccccaccccgacctccacaggcgaacccgacctctccgagcgcgcgaacaggctgcagatgcccaacccgttcgtgatcggatatggggccccaggcaccaactacacatgtatgaagcgcgcctatgacgaggagctgggcctccgccatcaccaatactgagtcattggatgctgataaagtgacaacattgctcctcattatgcagagcttcaggcagaacaggatgncgctgactctgcgcgcatcattggttggtataacattgcactcatccctaacatgcctctggatacatgctaaatgagtatcgtcattgactgacgactatccggacaggaacttatcggtacaat

SEQ ID NO: 42673 - protein, 65 aa, Zea mays
  misc_feature: Ceres CLONE 1441398-F
MLLPGRQRATYVPTPTSTGEPDLSERANRLQMPNPFVIGYGAPGTNYTCMKRAYDEELGLRHHQY

SEQ ID NO: 42674 - DNA, 677 bp, Zea mays
  misc_feature: Ceres CLONE 1441406-F
  misc_feature (588)..(588): n is a, c, t, g, unknown, or other
aaagctggactccccgcggtggcggccgctctagaactagtggatcccccgggctgcaggaattcgcacgagaccattacctagaacatcctaatcgaaaaatccacatccaaccatttttcacaaaatgttctctctttctcacatccattgttggatgttatcgagagggtgttgttcgtcttcggggactatccgaagactatcatttagtccattgcgggatctaacacctctccggttctactacgtggcgttccctatgtcactccacaccggtttttcctcatattcagtacgattcttgttcccgacactatagccactaatctcctagcctctggagtcagcggccgacgccaccctcggaatcaccgccattactctcatcctgggtactcatcctactgctgaaggtaactcgttggcactgtaagccctcacaccattgaaactgcttaacctctccggtgtatctgaacgatcatgcggaggaaaacccttctctgtaactttcggaactaaacgatctcaatctcctcacaaatatgccagcatggttaaaaaatctactcaatggtataccanctcgtcgaccggcacctgcggcatgacgagctacacctgcatacgtggagcatgcacacgcgacgactccaggatacgggaaattagcg

SEQ ID NO: 42675 - DNA, 619 bp, Zea mays
  misc_feature: Ceres CLONE 1441413-F
  misc_feature: Encodes the peptide sequence at SEQ ID NO. 42676
aagctggagctccccgcggtggcggccgctctagaactagtggatcccccgggctgcaggaattcgcacgagaccattacctagaacatcctaatcgagaaacgccgcattcggatccggccctgaacctttcccgatcccgcccgcttccctgcaccgctcggcacgatccgcccccgctccccgctcccggctccacgaccggtccgccgtcgagctcccggcgcttctgcggtcggcgccatggcgaccggcggcggcaacgagcagccgccagcggaggccgagccgctggagctcgtgctgttccaggtcgccgagtgctacgtctacctgataccaccgaggaaaacggctgcctcctacagggcggatgagtggaacgtcaacaaatgggcatgggaaggggcgcttaacgttgtcagcaagggagaggaatgcatcattaaactggaagataaaaaaacaggggagctttatgctagggcatttctcagagagggtgaaccacatccggtggaaccctgtattgacagtagcagatattttgtactaacgtgttgaaaaggaaaaagatggggcgtcagcgccactgcttttttaaaaagttttaggctct

SEQ ID NO: 42676 - protein, 106 aa, Zea mays
  misc_feature: Ceres CLONE 1441413-F
  misc_feature (15)..(107): Pfam Name: DUF1681 Pfam Description: Protein of unknown function (DUF1681)
MATGGGNEQPPAEAEPLELVLFQVAECYVYLIPPRKTAASYRADEWNVNKWAWEGALNVVSKGEECIIKLEDKKTGELYARAFLREGEPHPVEPCIDSSRYFVLTC

SEQ ID NO: 42677 - DNA, 646 bp, Zea mays
  misc_feature: Ceres CLONE 1441418-F
  misc_feature: Encodes the peptide sequence at SEQ ID NO. 42678
aagctggagctccccgcggtggcggccgctctagaactagtggatcccccgggctgcaggaattcgcacgagaccattacctataacatcctaatcgaaaaaggccaccgcaaaacctgctcctagctgctctcgtgtgttttgtgacatccgttattacgcgagagcgggctacctataggtcaagaccgtaagaggatgatggtggacaggccccgcgtgacgcagtgcgacatgcaggccatgaacatggccatgctcatgcacgtaagaagaccttcaggcagcacgtccacgagctgcatcgcctgtaccgtacacagagggagctgatgacaatgactactagtgacgacctgaccggagccaagacggtgaccaccccccgacggcgcagcaagcaaccaccgctggagctaccgctggtcctgcagatgccgaccgagtagtacatagtcagcgcctaccaggatcgagacgccgccgccggcactgagctggagctgacgctcaccggtcgtgcgcgctagtcagccggccgccgtctcaagatcggaaggatgaggaggatgaaagcttcaaagcctctggacgacagcaggtgcttctgcctccccttctgggcccactgctctagcgctagcat

SEQ ID NO: 42678 - protein, 38 aa, Zea mays
  misc_feature: Ceres CLONE 1441418-F
MTMTTSDDLTGAKTVTTPRRRSKQPPLELPLVLQMPTE

SEQ ID NO: 42679 - DNA, 631 bp, Zea mays
  misc_feature: Ceres CLONE 1441429-F
  misc_feature: Encodes the peptide sequence at SEQ ID NO. 42680
ggagctccccgcggtggcggccgctctagaactagtggatcccccgggctgcaggaattcgcacgagaccattgcctagaacatcctaatcgaaaaattttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacaggtatgaggtcttcgcgctgatt

SEQ ID NO: 42680 - protein, 153 aa, Zea mays
  misc_feature: Ceres CLONE 1441429-F
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTKVKGYRYEVFALI

SEQ ID NO: 42681 - DNA, 649 bp, Zea mays
  misc_feature: Ceres CLONE 1441431-F
  misc_feature: Translation starting site: 244
  misc_feature: SWISSPROT Homolog: EC 5.5.1.4 Inositol-3-phosphate synthase
  misc_feature (520)..(520): n is a, c, t, g, unknown, or other
  misc_feature (525)..(525): n is a, c, t, g, unknown, or other
  misc_feature (563)..(563): n is a, c, t, g, unknown, or other
aagctggagctccccgcggtggcggccgctctagaactagtggatcccccgggctgcaggaattcgcacgagaccattacctagaacatcctaatcgaaaaacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgcggtccccaagctcggggtcatgcttgtggggtggggaggcaacaacgggtccacgctgacggctggggtcattgccacagggaggggatctcatgggcgaccanggacnaggtgcagcaagccaactactacggctccctcacccangcttccaccatcagagtaggcacctacaacggggaggagatatatggcgccgttcaagagccctctacccatggtgaccccgacca

SEQ ID NO: 42682 - DNA, 645 bp, Zea mays
  misc_feature: Ceres CLONE 1441434-F
  misc_feature: Encodes the peptide sequence at SEQ ID NO. 42683
aaagctggagctccccgcggtggcggccgctctagaactagtggatcccccgggctgcaggaattcgcacgagaccattacctagaacatcctaatcgaaaacattaactagaacatcctaatcgaaaagtgctttcttagaggtgggttggcttctcctccccctccggttcgggttcgggttcgtgaggttctccggggttcgggttcgtgggtgagcggatcgagatggcggcgtcagatgttgagtaccgctgcttcgtcagcggcctcgcctgggccacggacgaccactccctccacaacgccttcagcacctacggcgaggtcctcgagtccaagatcatcctcgatcgggagacgcagaggtcccgcggcttctgcttcgtcaccttctccacggaggaggcgatgcggaacgccatcgagggcatgaacggcaaggagctggacggccgcaacatcaccgtcaacgaggcccattcccgcggcggccgtggaggcggcggcggtgggtacggtggaggccgtggaggcggcggctacggcggtggcgggcgccatgatggcggtggcggctacggcggtggcggcggctacggtggcggcggcggctactgtggtggtggcggcggctacggcggt

SEQ ID NO: 42683 - protein, 139 aa, Zea mays
  misc_feature: Ceres CLONE 1441434-F
  misc_feature (10)..(81): Pfam Name: RRM_1 Pfam Description: RNA recognition motif. (a.k.a. RRM, RBD, or RNP domain)
  misc_feature (48)..(139): Pfam Name: GRP Pfam Description: Glycine rich protein family
  misc_feature: SWISSPROT Homolog: EC 5.2.1.8 Peptidylprolyl isomerase
MAASDVEYRCFVSGLAWATDDHSLHNAFSTYGEVLESKIILDRETQRSRGFCFVTFSTEEAMRNAIEGMNGKELDGRNITVNEAHSRGGRGGGGGGYGGGRGGGGYGGGGRHDGGGGYGGGGGYGGGGGYCGGGGGYGG

SEQ ID NO: 42684 - DNA, 657 bp, Zea mays
  misc_feature: Ceres CLONE 1441435-F
  misc_feature: Encodes the peptide sequence at SEQ ID NO. 42685
  misc_feature (510)..(510): n is a, c, t, g, unknown, or other
  misc_feature (511)..(511): n is a, c, t, g, unknown, or other
  misc_feature (519)..(519): n is a, c, t, g, unknown, or other
  misc_feature (587)..(587): n is a, c, t, g, unknown, or other
aagctggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcgggttcgtgggtgagcggatcgagatggcggcctcggatgttgagtaccgctgcttcgtcggcggcctcgcctgggccacggacgaccactccctccacaacgccttcagcacctacggcgaggtcctcgagtccaagatcatcctcgatcgggagacgcacaggacccgcggcttcggcttcatcaccttctccacggaggaggcgatgcggaacgccatcgagggcatgaacagcagggagctcgacggccgcatcatcaccgtcaacgaggcccagtcccacgtcagccgtgaaagacgcggctgtgggtacggtcgtggaccgtgaagcnngcgctacngcggtggcccggcgccgtgatggctggtggcgtttacggcggtggcgattgctacggtgggccacggncgctacggtggttgtgggggccgctacggcgttggcaaccgtggggggggctaagggaaatccaaaggga

SEQ ID NO: 42685 - protein, 101 aa, Zea mays
  misc_feature: Ceres CLONE 1441435-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETHRTRGFGFITFSTEEAMRNAIEGMNSRELDGRIITVNEAQSHVSRERRGCGYGRGP

SEQ ID NO: 42686 - DNA, 768 bp, Zea mays
  misc_feature: Ceres CLONE 1441438-F
  misc_feature: Encodes the peptide sequence at SEQ ID NO. 42687
  misc_feature (70)..(70): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
ttcttttatttttgccctcttgttctgtccgcctccccgcgcgctctgtctgttcttcctggcgtggggnttggnnnnnnncaaagctggggctccccgcggtggcggccgctctatactagtggatcccccgggctgcaggaattcgcacgagaccattacctagaacatcctaatcgaaaaactttatccgttccaagtatctcccctcttgcgcctcctctcgactcttccgtttagtgcccaccgaaatctttctaccacccacgttccggcatccatggctcgtctgttcgcggcgcgagcccttacgctggcccgcccctcggcggcgccatccgccctccgcttctgcccctcccgcgcgctgtcggacaaggtggacttcatcgagatcgacctctccgaggagtccccttcctcttcatccggaggaggaggcgcgggcgaccccgccacggttcaggcgccaatggggtcgcggcgccctggaggaccccctccatggggtgctcgtgcggcgggcggcgccctgaatgggtccccttttctggccggggggcatcccaactggggtccccgcccgttgcccccgggcgccctcggggtggcgcgaagcctcccccagcctcggcttattcgcacctcccctaggggggtccctaagggggaatgacctggaagagaggaggggatttggaacctttccccttaacccgcggcgggggggggtgggggcccaatccccacgagcgtggaccttttatg

SEQ ID NO: 42687 - protein, 131 aa, Zea mays
  misc_feature: Ceres CLONE 1441438-F
MARLFAARALTLARPSAAPSALRFCPSRALSDKVDFIEIDLSEESPSSSSGGGGAGDPATVQAPMGSRRPGGPPPWGARAAGGALNGSPFLAGGHPNWGPRPLPPGALGVARSLPQPRLIRTSPRGVPKGE

SEQ ID NO: 42688 - DNA, 650 bp, Zea mays
  misc_feature: Ceres CLONE 1441441-F
  misc_feature: Encodes the peptide sequence at SEQ ID NO. 42689
  misc_feature (650)..(650): n is a, c, t, g, unknown, or other
aagctggagctccccgcggtggcggccgctctagaactagtggatcccccgggctgcaggaattcgcacgagaccattacctagaacatcctaatcgaaaaaatcgacccagtcatctcctcaccctcgttcaccaagagtccgccactcctttagtagcttgtgatttgtaggtcgactagatcactggtcggccggtgcacgacaacacatggggaagggtactgtgggtgcatcatggtgggagttcctcctgctcgccggcgtgctgctggtcttaccagccacgatctgggatcaggactgactgatcgaactggaccgcagggaagacctgctctgctgcaagcatgcgtgcaagagatagtactgaaaggacaccccgcggaagatggaatgcaagagcgagtgccgcgagctgctccagcaagctgacacgggcgaggacagcgacatcgacgtgtacgcctacttctcccgctccttgaggagcgagtgccggcagcagtgcctgctccgaccagaggtgaagcccgtgagacacccaagattgcatgatgcggtgccgccctctgcggactggcctgtctacatggagcaaatatacgggtcgccgcaacatagacccgggccagagcccggactagtcn

SEQ ID NO: 42689 - protein, 86 aa, Zea mays
  misc_feature: Ceres CLONE 1441441-F
MECKSECRELLQQADTGEDSDIDVYAYFSRSLRSECRQQCLLRPEVKPVRHPRLHDAVPPSADWPVYMEQIYGSPQHRPGPEPGLV

SEQ ID NO: 42690 - DNA, 632 bp, Zea mays
  misc_feature: Ceres CLONE 1441447-F
  misc_feature: Encodes the peptide sequence at SEQ ID NO. 42691
  misc_feature (632)..(632): n is a, c, t, g, unknown, or other
ggagctccccgcggtggcggccgctctagaactagtggatcccccgggctgcaggaattcgcacgagaccattacctagaacatcctaatcgaaaaaatcgaaaaatagcgaacaaacatcgagtacagtcggctaggtaatctggtggtacgacgacatggcggccaccagcagcaagtcgtcgtcgtcctcgagctcggcgcagcgggaagctgccgcactgctcgtggccgccgccgtggcggtgtccgtcctgatggtgggcgcggcggcggtgtgcgacatgagcaacaagcagttcatgtcgtgccagcccgcggcggccaaaacgacagacccgccggccgcgccgtcgcaagcttgctgcgacacgctggcaggggcagacctcaagtgcctgtgcggctacaagaactcgccgtggatgggcgtctacaacatcaaccccaagcgcgccatggagcttccggccaagtgcggcctctccacgccgcccaactgatagcagtgtgctagccaagccaagccaagcaggaaggcccccggcattgctagctgtacgtgtctgtgtgtgcatctgcagcaaggtgcaggcaggggcccgtacgtacgtgtctctttctctctctcn

SEQ ID NO: 42691 - protein, 114 aa, Zea mays
  misc_feature: Ceres CLONE 1441447-F
  misc_feature (41)..(115): Pfam Name: Tryp_alpha_amyl Pfam Description: Protease inhibitor/seed storage/LTP family
MAATSSKSSSSSSSAQREAAALLVAAAVAVSVLMVGAAAVCDMSNKQFMSCQPAAAKTTDPPAAPSQACCDTLAGADLKCLCGYKNSPWMGVYNINPKRAMELPAKCGLSTPPN

SEQ ID NO: 42692 - DNA, 714 bp, Zea mays
  misc_feature: Ceres CLONE 1441451-F
  misc_feature: Encodes the peptide sequence at SEQ ID NO. 42693
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (19)..(19): n is a, c, t, g, unknown, or other
  misc_feature (22)..(22): n is a, c, t, g, unknown, or other
  misc_feature (79)..(79): n is a, c, t, g, unknown, or other
  misc_feature (80)..(80): n is a, c, t, g, unknown, or other
tttttccgtttaanngnanganagaatacgcccgcccccaccaccgggaggtggggagggcgaccccccctgtataaannaaagaagaagctggggctccccgcggtggcggccgctcatacaatagtggatcccccgggctgcaggtattcgcacgagaccattacctagaacatcctaatcgaaaaaatctagggttgctgagctccccaccaccgccggtcatgcccgacgcggatgttgacaccgtgattcgcgaagccgccgcggccgcggccccagccggcgacgacgacagcgagggtgacaccgaggaagaggaggaggagggggacgaggtcgacgaggacgaggacgacgacgaggaggagttacccgccgaggcgccggcgccggacgaggagcaacctgccccagcgcccatctcgaccttgccggggaatccaaaccagctgacgctggtcttccagggcgaggtttacgttttcgaatccgtcacccccgagaaggttcaagctgtgctgctactctcaggacgtggtgaactaccacctggctcagctgggatggttttacccaatcaaaatgacgaccagggccatgacgatattacttcgcaggacagacattcccgccaaaagggttgcttccctaaattaggtttccgtgagaaaagggagcgaaagaaattttcgataaggaaaaccccgctat

SEQ ID NO: 42693 - protein, 163 aa, Zea mays
  misc_feature: Ceres CLONE 1441451-F
MPDADVDTVIREAAAAAAPAGDDDSEGDTEEEEEEGDEVDEDEDDDEEELPAEAPAPDEEQPAPAPISTLPGNPNQLTLVFQGEVYVFESVTPEKVQAVLLLSGRGELPPGSAGMVLPNQNDDQGHDDITSQDRHSRQKGCFPKLGFREKRERKKFSIRKTPL

SEQ ID NO: 42694 - DNA, 620 bp, Zea mays
  misc_feature: Ceres CLONE 1441454-F
  misc_feature: Translation starting site: 215
  misc_feature (177)..(177): n is a, c, t, g, unknown, or other
  misc_feature (178)..(178): n is a, c, t, g, unknown, or other
  misc_feature (184)..(184): n is a, c, t, g, unknown, or other
  misc_feature (187)..(187): n is a, c, t, g, unknown, or other
  misc_feature (292)..(292): n is a, c, t, g, unknown, or other
tggagctccccgcggtggcggccgctctataactagtggatcccccgggctgcaggaattcgcacgagaccattacctagaacatcctaatcgaaaaacggtcacacacaccgcctcaactcgcgctgcccgtcgcccccaagcctcggttccgccggcgcgcgaggggattcgagnnctgggntcnttgggggtagcctctcaccgtctcacgatgccgccagcacccaagtccggcgacgccctcttcgccagcgtggatcgcgtcaatgcggagctgttcacgctcacngtacggcgccaattcgtgccgtgcagtttggcttcacgggattctgggaggaggtcgaggaggtcaacaagcagctcgatcagatggggaacaacattggaaacccgatttggttgatgatttctgagcaaagtcagatgtttcaaggtgtgttgacttcaaggagactgccgatgtaatttgcgaaccttggttttcacaaggttcttgggcgggaattgcaacccttgacccaatttgggatggtgaaggggaaaaagttttgcccccttttgcccgggaaaaaaaaaaccctcttttgtttgtattttctcccaaaaagaccccc

SEQ ID NO: 42695 - DNA, 761 bp, Zea mays
  misc_feature: Ceres CLONE 1441457-F
  misc_feature: Encodes the peptide sequence at SEQ ID NO. 42696
  misc_feature (15)..(15): n is a, c, t, g, unknown, or other
gtgtgggcgggcttnttttttcttcaatatgggagtcgcggagtacggcgacctggggggggggaggagtttttcattatttttcaacatttaaaagctggactcaccgcggtggcggccgctctataatagtggatcccccgggctgcattttattcgcacgagaccattacctagaacatcctaatcgaaaaaggccgccaactcttgtaccatcacggcgtcggagggccagtcgacctctctgctcgcgaaaaatggcggcggcagcggaaggtttggctgcctacagggcgatgctgcgggtggcgcggcggacgttcgcgggcaaccagctgatgctgaaggagtctgcggtggagatccggcgccgctttgaggaccatcgtggtctaaccccgggctccgacgatgcagcgcgtgccctcgccgacccccgcgaggtggcgcacttcatcacccatatgatagtccaggacacacgcgctactctcccgacccccccgttgcgaacccctgacagtgcccacgctggaccaacactgggaacctcccctcccgaggagatccttaccaaagtttgaaagcacggtcactaggcaagtgcatgaagtaagtgtcacccccttcttaccggccccctccccaactatagaattaaggttccgcccaacggggactgaatttccccctagtttgcccggcccctactttgggctggctcactttaacagatcaaatattttctagcacacctctag

SEQ ID NO: 42696 - protein, 108 aa, Zea mays
  misc_feature: Ceres CLONE 1441457-F
MAAAAEGLAAYRAMLRVARRTFAGNQLMLKESAVEIRRRFEDHRGLTPGSDDAARALADPREVAHFITHMIVQDTRATLPTPPLRTPDSAHAGPTLGTSPPEEILTKV

SEQ ID NO: 42697 - DNA, 691 bp, Zea mays
  misc_feature: Ceres CLONE 1441458-F
  misc_feature: Encodes the peptide sequence at SEQ ID NO. 42698
  misc_feature (21)..(21): n is a, c, t, g, unknown, or other
  misc_feature (22)..(22): n is a, c, t, g, unknown, or other
  misc_feature (71)..(71): n is a, c, t, g, unknown, or other
  misc_feature (83)..(83): n is a, c, t, g, unknown, or other
ctctttgctccttgtgggttnnacattctacacctcccctgctccgcccccggcagcgcgggccccctcantaaaattttttntgtttatagctgggactcaccgcggtggcggccgctctccaatagtggatcccccgggctgcatgttttcgcacgagaccattacctagaacatcctaatcgaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgcagcgcgctaaaaaggagattgcccctgtggttcccgagggccctgctgattggcaaagcagcccaccccccatgga

SEQ ID NO: 42698 - protein, 123 aa, Zea mays
  misc_feature: Ceres CLONE 1441458-F
  misc_feature (2)..(123): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIAAR

SEQ ID NO: 42699 - DNA, 647 bp, Zea mays
  misc_feature: Ceres CLONE 1441461-F
  misc_feature: Encodes the peptide sequence at SEQ ID NO. 42700
  misc_feature (647)..(647): n is a, c, t, g, unknown, or other
ggagctccccgcggtggcggccgctctttaactagtggatcccccgggctgcaggatttcgcacgagaccattacctaaaacatcctaatcgaaaagccaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcaacaggtcgtgtccgggatgaactaccgcctctacgtcgacgccgccgaccccggcgggcccaccgggccctacgtcgccgtcgttgtacgagcaggtcttggaaccgcacccgcccagcttcgcctccttcaaacccgggggcccccgcgccccctgaaaaccttaaggaacccgggggggggcccgatgcccaccccgaaggatggttctccgcttcaattaccctgtcgaggcccaaccctn

SEQ ID NO: 42700 - protein, 162 aa, Zea mays
  misc_feature: Ceres CLONE 1441461-F
MATHRHCLPLLLVAAALALAAVPARAALGGGRGPLLGGWNPIPDVSDSHIQELGGWALGQAKHQKLAADGLRFRRVVRGEQQVVSGMNYRLYVDAADPGGPTGPYVAVVVRAGLGTAPAQLRLLQTRGPPRPLKTLRNPGGGPMPTPKDGSPLQLPCRGPTL

SEQ ID NO: 42701 - DNA, 618 bp, Zea mays
  misc_feature: Ceres CLONE 1441465-F
  misc_feature: Encodes the peptide sequence at SEQ ID NO. 42702
tggagctccccgcggtggcggccgctctagaactagtggatcccccgggctgcaggaattcgcacgagaccattacctagaacatcctaatcgaaaaattctcatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgt

SEQ ID NO: 42702 - protein, 116 aa, Zea mays; identical to SEQ ID NO: 40624
  misc_feature: Ceres CLONE 1441465-F
  misc_feature (1)..(93): Pfam Name: GRP Pfam Description: Glycine rich protein family

SEQ ID NO: 42703 - DNA, 795 bp, Zea mays
  misc_feature: Ceres CLONE 1441466-F
  misc_feature (17)..(17): n is a, c, t, g, unknown, or other
  misc_feature (46)..(46): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
gttttcgtgttgtttcnttctttcttttttatctgtttgttgcgcnatgcttttcggccggggtgnnnnnnnnggggaatnnnaaaagctggaactcaccgcggtggcggccgctctataatagtggatcccccgggctgcaggtattcgcacgagaccattacctagaacatcctaatcgaaaaaacccgcatcccacatcactcatccacagctcgcagccgtattcctgtctcgtatcctctctcgccgctccgatggcccgcacgaagcaaacagcaaggaagttcgaccgggcggcaaggcccccccgggagaccagcctgggtcatattattaggcgctgcgcccgctacaaatttttggggcccccgtgggccacacccatgttggtagtgcctaaataaaaaaaaaaccccccccctcgcctttttccccccccccccgacaaagataactcccgctgactcccgcctccctccctaatgtatcaaaacacccccccacaatacaccccccccccccaacacacaaaccctctgaccttgtgttttccgcctgtctgcattcccctcattattaacctagcccacgacccactcttttgttcccttatacacacgcccgcccccccccccgctatataccccccctcgacctccaattcccacaataacatagtattggtgtttccctcttcccccctcactccgccccgccccgacggcgctttctctaagcgtctgtcacccccctaattagtacgttactcgcccggattagctgtactccact

SEQ ID NO: 42704 - DNA, 755 bp, Zea mays
  misc_feature: Ceres CLONE 1441475-F
  misc_feature: Encodes the peptide sequence at SEQ ID NO. 42705
  misc_feature (15)..(15): n is a, c, t, g, unknown, or other
  misc_feature (81)..(81): n is a, c, t, g, unknown, or other
tctaccccgtttcgntttatttaagaaaaagacaaaccatagtaacccaaacaccccgcaatttataaaattgttatatanccaagctggagctccccgcggtggcggccgatctttcacagaggatcccccgggctgcaggatttcccacaagaccattacctagaacatcctaatcgaaaaacagatgctctctccctccttgctcctgccgtcccttacctccccttccatcctcgtcctcgagcgagccgctgcaggcgtcacaccgtcgccagaggcgcctgctgacggcgagcctgaatccaaggcctgtgcaactggcgacgacgaccatcagagggccgacgagtggtccctcgcctcctcctccggctagatggtcctgtcgcccatgtatctcccctttcatggccgtcctcgagcgtgctgttgcgggcatcacgctgccgctaaaaacacatgtcggcggcgaggacgaggcctatgcagccggcagcgacaaccaccaacagtttcagcttgccgagcctaaccagaagggcgaggagccaccttctccgcccagatgcctccaacggccggggaatctccccttccaacccctggccctcaaatggggcccttggcgaaacttcgttggcccccgcccagagtcctccttgtccaccgcccaaagggccgaaataacaaccgcccctgtcgcccacccaagcgggtggtaacaaccaacccacctgagggctgggagagat

SEQ ID NO: 42705 - protein, 75 aa, Zea mays
  misc_feature: Ceres CLONE 1441475-F
MSAARTRPMQPAATTTNSFSLPSLTRRARSHLLRPDASNGRGISPSNPWPSNGALGETSLAPAQSPPCPPPKGPK

SEQ ID NO: 42706 - DNA, 708 bp, Zea mays
  misc_feature: Ceres CLONE 1441486-F
  misc_feature: Encodes the peptide sequence at SEQ ID NO. 42707
  misc_feature (27)..(27): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (75)..(75): n is a, c, t, g, unknown, or other
  misc_feature (76)..(76): n is a, c, t, g, unknown, or other
  misc_feature (78)..(78): n is a, c, t, g, unknown, or other
  misc_feature (79)..(79): n is a, c, t, g, unknown, or other
gcgcccggcggtgtttttttccttctncgcccccactcactttcctctcttctccgtnnnnntnatnnnaaattnntnnaaatgctggtgctccccgcggtggcggccgctctataatagtggatcccccgggctgcaggatttcgcacgagaccattacctagaacatcctaatcgaaaaattctcattcgattacacacacacacggagagatcaaattgatacactgcgatctcgatcaaacaaatcaaaaaaaaaaaaaatcttgcgagacattactgaccgatgaagttcggcaagcgcctcaagaagcagatcgaggagagcctgccggagtggcggagccagttcctcaactacaaggagctgaagcggcgcgtgaatgccgtgtcctcccgcgggtcggcggcggatccgtcgtcgtccagcgccgcggaggccgacttcctgacgctcctggacgccgagatcgacaagttcaacgccttcttcctggagcgggaggaggagttcgtgatccggcagagggagctccaggagcgcatcgggcgtgcgggcgggcccgaggccacgctggcgcgcgtccggcgcgaggtggtggacttgcccggcgagatggtgctgctgctcaactacagcaccgtcaaatacacgggccctcgcccaagacccccaagaaattcggacaagcgcaaccggggggcgtg

SEQ ID NO: 42707 - protein, 140 aa, Zea mays
  misc_feature: Ceres CLONE 1441486-F
  misc_feature (1)..(138): Pfam Name: SPX Pfam Description: SPX domain
MKFGKRLKKQIEESLPEWRSQFLNYKELKRRVNAVSSRGSAADPSSSSAAEADFLTLLDAEIDKFNAFFLEREEEFVIRQRELQERIGRAGGPEATLARVRREVVDLPGEMVLLLNYSTVKYTGPRPRPPRNSDKRNRGA

SEQ ID NO: 42708 - DNA, 641 bp, Zea mays
  misc_feature: Ceres CLONE 1441497-F
  misc_feature: Encodes the peptide sequence at SEQ ID NO. 42709
aagctggagctccccgcggtggcggccgctctagaactagtggatcccccgggctgcaggaattcgcacgagaccattacctagaacatcctaatcgaaaactaacacttttcccgtcttccccttcctcgccgcctccactacagggctttgctcctcccaactctcgaaaccctacccacccgatgagagatcgatcggtcgagcgcgaattccccagccgcgagcggggggatcggccgccgcccggggtgctgggccccccgcgccgcgggccggcgtacaagacgaagttgtgcgcgctgtggcagcgcggcggctgttcccgcgacacatgcagcttcgcgcacggacacgccgagctccgccggttccccggatcgcgcacctcgttcccaccccgcgccgtgaagaaaagaagagagcgagactctgacacaactaggccagataaatataggtttgaaggtactattgcaggatttgaaaaactaagcaagggaaccgagccaacaaaatctttatatttgaagaagaaactgtgggaagatgaaaaggataagataggcaactttgtctcctcagccaacattgacaagtacgaggctgatgatgaggaagtcgacgtggaataagtagaa

SEQ ID NO: 42709 - protein, 149 aa, Zea mays
  misc_feature: Ceres CLONE 1441497-F
  misc_feature (33)..(57): Pfam Name: zf-CCCH Pfam Description: Zinc finger C-x8-C-x5-C-x3-H type (and similar)
MRDRSVEREFPSRERGDRPPPGVLGPPRRGPAYKTKLCALWQRGGCSRDTCSFAHGHAELRRFPGSRTSFPPRAVKKRRERDSDTTRPDKYRFEGTIAGFEKLSKGTEPTKSLYLKKKLWEDEKDKIGNFVSSANIDKYEADDEEVDVE

SEQ ID NO: 42710 - DNA, 766 bp, Zea mays
  misc_feature: Ceres CLONE 1441515-F
  misc_feature: Encodes the peptide sequence at SEQ ID NO. 42711
  misc_feature (68)..(68): n is a, c, t, g, unknown, or other
  misc_feature (76)..(76): n is a, c, t, g, unknown, or other
  misc_feature (78)..(78): n is a, c, t, g, unknown, or other
gttttgttgtgtgtggggttttacttcccctccccccccccgatggggtgcggggtggggccctgggnattatttntnttatattggagctccccgcggtggcggccgctctagtctagtggatcccccgggctgcaggaattcgcacgagaccattacctagaacatcctaatcgaaaaaattaaagaaaaaggaaattttcttgggcgttcttcggcttcattgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactacaacatccaaaaggagtcaactcttcatttgggcctcacgcttaggggtggaaccatgatcaaggtccaaaactctcacctgggaaagagatcgagatcgacattgaacccccctgactcgaattgacagggatcagggagcgtggttgaagaaaaaagaaggcatttcctccccgggcaaccaaaggtattgcctttccctggaccgcctggatggcctgattgaagcctatttttgggtccgccccttttggcaggggctccattctaatgggtggcggtaaggcccagcctttgcct

SEQ ID NO: 42711 - protein, 100 aa, Zea mays
  misc_feature: Ceres CLONE 1441515-F
  misc_feature (6)..(74): Pfam Name: ubiquitin Pfam Description: Ubiquitin family
MQIFVKTLTGKTITLEVESSDTVDNVKAKIQDKEGIPPDQQRLIFAGKQLEDGRTLADYNIQKESTLHLGLTLRGGTMIKVQNSHLGKRSRSTLNPPDSN

SEQ ID NO: 42712 - DNA, 810 bp, Zea mays
  misc_feature: Ceres CLONE 1441516-F
  misc_feature: Encodes the peptide sequence at SEQ ID NO. 42713
  misc_feature (12)..(12): n is a, c, t, g, unknown, or other
  misc_feature (16)..(16): n is a, c, t, g, unknown, or other
  misc_feature (21)..(21): n is a, c, t, g, unknown, or other
gggggggggggntgtnttttncccccccgcaacccgcgccccgttgaggggagaagacaccccccttttgttaccccccgcaaaacgggagctccccgcggtggcggccgctctttactagtggatcccccgggctgcaggaattcgcacgagaccattacctagaacatcctaatcgaaaagttttctgctccattcctcctcctgcaagccgcaaaggaatcaggcggagtggcgcgatgggagagcaggtcgtgacggagcagatccagcggaagctggaggaggtcaacgctaccgtccaacagcacctcgcgggtgtccaggaccacatcaacttcaccatgcagcaagcatacttcaagtgcgcatatggttgctttgatcggggccatactcaggaagcgatcagcaactgtgtggagaattgaagtgtgccctgtcctttgctggccaccaatatttttggaaaggcgagatggcccaaagtttcggggaaaggttggaacccgggtcatggagggggcctgccaaagaaaaaggttgggaagcctggcccaatccttcgcgaaagggtcgaacaaccccgatggccagctcgggggaaaccggggaatgccggggtgccgacccgccttcttttggccttgaaccgccccttcaaggttccctctcccgcatggtgcggtggggattcgcaacgaaggtcccgcctcccgcggtagaccacctatggggcggacctttttaagctttctgcccccgatggaacccaccacgcttgcgtggaggaacggggtccccccaaac

SEQ ID NO: 42713 - protein, 63 aa, Zea mays
  misc_feature: Ceres CLONE 1441516-F
MGEQVVTEQIQRKLEEVNATVQQHLAGVQDHINFTMQQAYFKCAYGCFDRGHTQEAISNCVEN

SEQ ID NO: 42714 - DNA, 732 bp, Zea mays
  misc_feature: Ceres CLONE 1441517-F
  misc_feature: Translation starting site: 365
  misc_feature (15)..(15): n is a, c, t, g, unknown, or other
  misc_feature (18)..(18): n is a, c, t, g, unknown, or other
gggccgggtgccccnccncactgaccctccgccgcccgcccaggaagagtgtgggagacccgtttggctcgccccctcaaactggagctccccgcggtggcggccgctcttccctagtggatcccccgggctgcaggttttcccacgagaccattacctagaacatcctaatcgaaaaaaaagaattcggtgctgctagggtactgcgcccctgaactgaacgagccttgttccttccgaatccctccgagaaaaggcggctccaaaaaccagatctcctcagcaaaatctgtacaagatccgcccttgatttggataacacgagcgaacgtgtggtgggccgtcgagtgaaacaagattcgccatgcggcggaacaggaaggattccggctatccgacggcggctccaggggaggaggatgaggcggaggaactgactgaggagggcgacgaggaagaggaggaacagaccggaggagggatgtggtgaggaggatgaagttgaagcggagacgccggcccaggaagctgtggagccccccaaaccggctgagggctacttcgagatcgagggcatccggccgccccccgcctccggaaggggccagcctccgatacctcggccaagggggcggggggtggcccaaagaagggcaaacaccaggggcaaccccccttgaaaacccggaagggcccggttctggaaattggtgggaagccttttccaaaagg

SEQ ID NO: 42715 - DNA, 650 bp, Zea mays
  misc_feature: Ceres CLONE 1441522-F
  misc_feature (423)..(423): n is a, c, t, g, unknown, or other
  misc_feature (431)..(431): n is a, c, t, g, unknown, or other
  misc_feature (603)..(603): n is a, c, t, g, unknown, or other
ccccgcggtggcggccgctctagaactagtggatcccccgggctgcaggaattcgcacgagaccattacctagaacatcctaatcgaaaaaaccctaaccctatccctttcgacggttccacttgcaccctacccacaaccccatccatcgtaacccgccgccgccgcgatacacgcaaatcctgccggcgcatccaaccccgcccgacgtggacgccagagaggtgcacgacttccgcaactcgtggcactcagtgcggtggtcgtccaagctcgtcctctggctcgtcctcaacgccttcagcttcctcgtgccgtcgccgctcgcccagatctacgatgcaatggtgagtggctctgtgaggaggcacacaagctcacattggcggcagcaagaacggtgtcgcctccttggtgggtggncaccaggngcacgacacctgctccctcccacaccggggcagaaacaagaataccggcgtcgccgtccgcgagcacagcggaagcgcgcaacgggcccgggtggcatgaagaaggggggcttccggctgcccaaggccgaaggcttgttaaccaaagaaacgccgaaggggcaaatgcccncctgggtcaagggttccaaggtggcggaaaatgaaaggggggggccg

SEQ ID NO: 42716 - DNA, 812 bp, Zea mays
  misc_feature: Ceres CLONE 1441529-F
  misc_feature (65)..(65): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (770)..(770): n is a, c, t, g, unknown, or other
gtgtgggtcgttttttctcgcgcgctaaaacagacttcccgtggcgccggccgcgctgtgagaanaaaaaaannntttataatggagctccgcgaggtggcggccgctctatttctagtggatcccccgggctgcaggaattcgcacgagaccattacctagaacatcctaatcgaaaaaaaaacggccgcacgccgttttccccatatcgcgcaacgctactgcctgctgtcgcgagtacggaggacagggctcagttccccgccgtgaatccttcctgttgccgcgatggagaccttcccgtcggtgaaaaacatccgcctactgtactccgaggggaagggtgtcgccgtgaaatactataccaatggagggaccactccgcgccgggaaggtggacttccataagtggggtcttcgcccaacgccgcagtaagcaaatggcggaaacggatgggaaccatggctggacaaagacggacaggcccctctacgaatttgcgacccggagcccctgccggggggcctctgcacgcaagttggtagggtggggaagccaatgagtacgttcgaaaaacagggcgggcgggggaaaggactgccagccgcgacggtgggtgtgtggggagggaggggagtggggcccgtggtcgatgccagtgcggcacgcgggctgatagagtgattggtgggggggggcagggccggggggggctagatgaggggagggggggcctgggatggctggtgggggggggcgtggacggggngtgcgctgcggggcgcggaggggtggcgggagcgggggaggg

SEQ ID NO: 42717 - DNA, 598 bp, Zea mays
  misc_feature: Ceres CLONE 1441540-F
  misc_feature: Encodes the peptide sequence at SEQ ID NO. 42718
ggagctccccgcggtggcggccgctctataactagtggatcccccgggctgcaggaattcgcacgagaccattacctagaacatcctaatcgaaaacatctttctttggatagcgcctcctcgtcctctccggtgtcgtcccgccgcccactcccatggcctccctcgccatcccggccttgcgcccggcgggagccaagctcaccggcaatatcacacccacgaatccctggaggcccgctcgccaatgcgcttgcgcgtccggtggccatgtcggggagttgtcagctctggccccggaggctgaggcagagcaggcggtggtgagcgaggtcaagccaaggtttaggtgggacgcgttcgggtccgacctgactgggccgcagcagcgggcggtccgggtcctgtctccgaagctgcccaaccgctgcaaggccctggtggcgcgcgtggtgtgcctgagccccggggacgagaggcttggcgcgctgctcgcgtactgggtgaaggcgatgaagcctaagagagcggattggttgctggttcttaaggaactgaaggccatggagagcccgctgcttgctgaggtactggagca

SEQ ID NO: 42718 - protein, 147 aa, Zea mays
  misc_feature: Ceres CLONE 1441540-F
MASLAIPALRPAGAKLTGNITPTNPWRPARQCACASGGHVGELSALAPEAEAEQAVVSEVKPRFRWDAFGSDLTGPQQRAVRVLSPKLPNRCKALVARVVCLSPGDERLGALLAYWVKAMKPKRADWLLVLKELKAMESPLLAEVLE

SEQ ID NO: 42719 - DNA, 800 bp, Zea mays
  misc_feature: Ceres CLONE 1441543-F
  misc_feature: Encodes the peptide sequence at SEQ ID NO. 42720
ttttttttggttgtgggtgtttcctcccccacacccttgcgaggggcgcggtctacgggtgggcccgggaaacccccccccatactggagctccaccgcggtggcggccgctctatactagtggatcccccgggctgcaggatttcgcacgagaccattacctagaacatcctaatcgaaaaaagtgttcacggctccatcctctctagagtctaagcccatctcgcgaagccgctaacgccgaaaacgaccctacatatggaggcgaagaagtcgggtcccgccgctgccggagccgcggcgccgccgccggctaacgggtacttcaggaccgtcttctccgcgtcgcctgcggggagcgcaaatgacgcaaagcaggccgacctgtacacgaggctgaacaagcagagctccagagggcagaatgtcagtggcattccagatggcaaatcaaacgggccgccctacttacaaggactggaaaaaacatggcgttatccaaatgaccccggccaggaaaccccccttaacttcgggttcccccccgcggccattacgggggggtcggggaaccccacccccccaccccccgtttccacgaacccattccggcccaataggacaccccaatacattaaatccaccgggaggtacaagtcccggaaggggtctcccgcttacccaggaggtggaactgggggggaaaaaggcttccccccttaattacccggacacaatcccggccgggcgagaccccttccctgttttggttgggcaacccgggcgaatacgccaccagg

SEQ ID NO: 42720 - protein, 154 aa, Zea mays
  misc_feature: Ceres CLONE 1441543-F
MEAKKSGPAAAGAAAPPPANGYFRTVFSASPAGSANDAKQADLYTRLNKQSSRGQNVSGIPDGKSNGPPYLQGLEKTWRYPNDPGQETPLNFGFPPAAITGGSGNPTPPPPVSTNPFRPNRTPQYIKSTGRYKSRKGSPAYPGGGTGGEKGFPP

SEQ ID NO: 42721 - DNA, 668 bp, Zea mays
  misc_feature: Ceres CLONE 1441548-F
  misc_feature: Encodes the peptide sequence at SEQ ID NO. 42722
  misc_feature (394)..(394): n is a, c, t, g, unknown, or other
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtggggagaaccggaaaggccanncagaggagggagggagggagcgcgtggaccaggctaggcgcagcagcatgggcgccgggatcagggtcctggcggcgctcttggcggcgctcgcggcagccaccgccggcgtgacggcgcagctgcggcaggactactacgcggcggtgtgcccggacctggagagcatcgtgcgcgccgcggtgtccaagaaggtgcaggcgcagcccgtcgccgtgggcgccaccatccgcctcttcttccacgactgcttcgtcgagggctgcgacgcgt

SEQ ID NO: 42722 - protein, 75 aa, Zea mays
  misc_feature: Ceres CLONE 1441548-F
  misc_feature: SWISSPROT Homolog: EC 1.11.1.7 Peroxidase
MGAGIRVLAALLAALAAATAGVTAQLRQDYYAAVCPDLESIVRAAVSKKVQAQPVAVGATIRLFFHDCFVEGCDA

SEQ ID NO: 42723 - DNA, 651 bp, Zea mays
  misc_feature: Ceres CLONE 1441549-F
  misc_feature: Encodes the peptide sequence at SEQ ID NO. 42724
aagctggagctccccgcggtggcggccgctctagaactagtggatcccccgggctgcaggaattcgcacgagccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagt

SEQ ID NO: 42724 - protein, 135 aa, Zea mays; identical to SEQ ID NO: 42474
  misc_feature: Ceres CLONE 1441549-F
  misc_feature (58)..(135): Pfam Name: PAP_fibrillin Pfam Description: PAP_fibrillin

SEQ ID NO: 42725 - DNA, 620 bp, Zea mays
  misc_feature: Ceres CLONE 1441554-F
  misc_feature (191)..(191): n is a, c, t, g, unknown, or other
  misc_feature (237)..(237): n is a, c, t, g, unknown, or other
  misc_feature (238)..(238): n is a, c, t, g, unknown, or other
  misc_feature (243)..(243): n is a, c, t, g, unknown, or other
tggagctccccgcggtggcggccgctctagaatagtggatcccccgggctgcaggaattcgcacgagaccattacctagaacatcctaatcgaaaaataaataagaaaaatatttttttccaaacactaataataataaaactagtggattacaaaatatataaacaaaaataaaaattgtaatccctagntactaaaaaaaaatcatataaatgggtgtacatttttggaatatcnnggatnatttggtggttggtttgccagggttatcagcaaatgctaaaaatttcccaatccctgctccctccaggttctgaattccccaggtttattgtttgaaaaactttaatggagggatggccgtttcccaaccaaaaacagcgtttttgttccccaaagggggaaaccaaccctttggcaaaaaaaaataatgggggcccccgaaaaacccccaaaggattttcttctcaagggcctttgaaaactttaccgaaaaatttttgggggaaaaaaacccgggggggcccttttcccccgaaaaaaatggggtttaatttaaaaaaaagggggggtcttttttcggggaaagaaacaacccccggggggggggttaaattttc

SEQ ID NO: 42726 - DNA, 580 bp, Zea mays
  misc_feature: Ceres CLONE 1441562-F
  misc_feature (54)..(54): n is a, c, t, g, unknown, or other
  misc_feature (55)..(55): n is a, c, t, g, unknown, or other
  misc_feature (67)..(67): n is a, c, t, g, unknown, or other
  misc_feature (70)..(70): n is a, c, t, g, unknown, or other
  misc_feature (75)..(75): n is a, c, t, g, unknown, or other
  misc_feature (76)..(76): n is a, c, t, g, unknown, or other
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (87)..(87): n is a, c, t, g, unknown, or other
  misc_feature (88)..(88): n is a, c, t, g, unknown, or other
  misc_feature (91)..(91): n is a, c, t, g, unknown, or other
  misc_feature (93)..(93): n is a, c, t, g, unknown, or other
  misc_feature (94)..(94): n is a, c, t, g, unknown, or other
  misc_feature (97)..(97): n is a, c, t, g, unknown, or other
  misc_feature (102)..(102): n is a, c, t, g, unknown, or other
  misc_feature (103)..(103): n is a, c, t, g, unknown, or other
  misc_feature (106)..(106): n is a, c, t, g, unknown, or other
  misc_feature (112)..(112): n is a, c, t, g, unknown, or other
  misc_feature (249)..(249): n is a, c, t, g, unknown, or other
  misc_feature (251)..(251): n is a, c, t, g, unknown, or other
  misc_feature (252)..(252): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
caaagctggagctccccgcggtggcggccgctctagaactagtgggatcccccnncccccggggggnccnttggnncnagggnnnannatntnncgncccanncgnaagaanccattacctagaacatcctaatcgaaaaaggaccggtcactcggcagtcggcacgcaggctagcagcacagcagcagccagagccatcccctctcctcgctacgcttcgcttcctcggcgccgattccctctgctcntnnctcaccnnntcgtcgtccgttccgggcgcgcgaggcttcgcccgagaattggcgaacgccaaatcgggtggttccctgttaaaacgatgaatggccatgctaaaatttgggcgagcttccaatccaaaaaagggttcccccccctttttaaaattttttaaaaagggggccaaaaaaattttccaaggggaaaattttttggggaccacaaaccggggggggagaaacccccctcccccccccctttgatgttttttttaaaaaaccccccccgaaaaaagaacccgccccccccccccccaatatttccccctttttttgggcccgg

SEQ ID NO: 42727 - DNA, 668 bp, Zea mays
  misc_feature: Ceres CLONE 1441564-F
  misc_feature: Encodes the peptide sequence at SEQ ID NO. 42728
  misc_feature (668)..(668): n is a, c, t, g, unknown, or other
aaagctggagctccccgcggtggcggccgctctagaactagtggatcccccgggctgcaggaattcgcacgagaccattacctagaacatcctaatcgaaaacatcaacaaaatttgattttcctttcctttccttttccacccccgactattacccctcctcccactccacggagaagcgaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttaaagaaccatgcagn

SEQ ID NO: 42728 - protein, 118 aa, Zea mays
  misc_feature: Ceres CLONE 1441564-F
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEPC

SEQ ID NO: 42729 - DNA, 722 bp, Zea mays
  misc_feature: Ceres CLONE 1441567-F
  misc_feature: Encodes the peptide sequence at SEQ ID NO. 42730
  misc_feature (53)..(53): n is a, c, t, g, unknown, or other
  misc_feature (73)..(73): n is a, c, t, g, unknown, or other
  misc_feature (74)..(74): n is a, c, t, g, unknown, or other
  misc_feature (94)..(94): n is a, c, t, g, unknown, or other
  misc_feature (95)..(95): n is a, c, t, g, unknown, or other
  misc_feature (361)..(361): n is a, c, t, g, unknown, or other
caaagctggagctccccgcggtggcggccgctctagaactagtggatcccccngggctgcaggaattcgcacnngagaccattacctagaacanntcctaatcgaaaactctatcgatcattcttatccagattgagcattaccgtgtacgtgcgtggcattaggaatcgtactaacacaaacacgcttgacagatgtgtcattcgcttctcgatcgtgatgccatgtgctcgtgtgcatctgacgcagcgacctcttgcttatgcatgatgcacctgtcccctgtcgcgggtgcgtgtcttgtgcttgctacctgttctgagcgccggtcttgacggactatgatgaggagccagcgggnctgtaccccttactcagagtacctgatgcaacccttgtgcatcccgcctggctgtggcgccctactaccccgcggtgtgggcagactagcgccttgtaccagactctccggtgacagtgctgtcaacaacacatgaggatgatgtacgtgcattccgtcgcgacaccacctgcagatgatgatgcaacttgtccttgcccctaccatcagcaccagcctgtacaagccccctctgatgcagcaactgcaacagctgatggcaacccacggtctctaccccatggccatgatggatggcctataacatgccggccatgtgtggactctaccagtgacggatacaattgtcatgataacgagc

SEQ ID NO: 42730 - protein, 42 aa, Zea mays
  misc_feature: Ceres CLONE 1441567-F
MMMQLVLAPTISTSLYKPPLMQQLQQLMATHGLYPMAMMDGL

SEQ ID NO: 42731 - DNA, 650 bp, Zea mays
  misc_feature: Ceres CLONE 1441584-F
  misc_feature (210)..(210): n is a, c, t, g, unknown, or other
  misc_feature (211)..(211): n is a, c, t, g, unknown, or other
  misc_feature (334)..(334): n is a, c, t, g, unknown, or other
  misc_feature (347)..(347): n is a, c, t, g, unknown, or other
  misc_feature (353)..(353): n is a, c, t, g, unknown, or other
aagctggagctccccgcggtggcggccgctctagaactagtggatcccccgggctgcaggaattcgcacgagaccattacctagaacatcctaatcgaaaaatcaatcatcaccgcaagcgtgcgcgcaacccagctcccaccgacgactgcaccggccgtcgctgccgcgctacttcggccccttttccggcgacgagcaccaccaggnntagctgggctaatgggagaattgacagcctcagagaaggatttgatcgagttgctgaagaaacgtcattatcttctgctaaagctctggaaagtgtaatcaaatagtgaatgaaattgagcangctattgttgaangctgcngatgatggaataacggattctactgggaaatgtgacacccatccatccttgcagaaactgaaagctaagcctcattgaaaaggcccccccctaaaccccccttggagggcacccaaagggactccaaggttcctctgagcaaaattcccaaaccccttgagaaatcttttcatccccaatatttctaagggcaaaccaaaagggggaattttgaggcccctcccggaaaacaattctttgggaaacttttttcccccccagggccctttttatttgggggcaaagttttcccccaaa

SEQ ID NO: 42732 - DNA, 661 bp, Zea mays
  misc_feature: Ceres CLONE 1441599-F
  misc_feature: Encodes the peptide sequence at SEQ ID NO. 42733
aaagctggagctccccgcggtggcggccgctctagaactagtggatcccccgggctgcaggaattcgcacgagaccattacctagaacatcctaatcgaaaaatagagcaggcaagatcattgatccattactgataaaaaaaaatattcggatgcgctagagaggaggagaagcaggcaagcagcaatggcagcagcaatcgacgactcgtgcaggagaccaggctcgatcccgttcaagtgggagatctgcccggggacgcccaagcacgccaggagcagcagcgccagcgcggctccgtcgtcgtcgtcgtcgccgtactactcgtcctcctccgccaccgcctccgtctccaaggtagcggtgtcgccgaagctgacgccgcccccgggcatgtcgccgtcgccgtaccactccccgcgcgtctcctactacccggcgcgctcggggtccgtgtcggcgtcccgggggccgcgcgccgcaccgcccaacggcttccctcgaggtcaacccccgggtcgcccccacgttaccgggccggtgcttcttaggctgacgaacaacaagtggccggggccccccgcccgaaaggggcttcccacctcccgtggttccaaagggcggaacggaaggaaaagggcccccaaaggcacccccccg

SEQ ID NO: 42733 - protein, 158 aa, Zea mays
  misc_feature: Ceres CLONE 1441599-F
MAAAIDDSCRRPGSIPFKWEICPGTPKHARSSSASAAPSSSSSPYYSSSSATASVSKVAVSPKLTPPPGMSPSPYHSPRVSYYPARSGSVSASRGPRAAPPNGFPRGQPPGRPHVTGPVLLRLTNNKWPGPPARKGLPTSRGSKGRNGRKRAPKGTPP

SEQ ID NO: 42734 - DNA, 658 bp, Zea mays
  misc_feature: Ceres CLONE 1441602-F
  misc_feature: Encodes the peptide sequence at SEQ ID NO. 42735
  misc_feature (504)..(504): n is a, c, t, g, unknown, or other
  misc_feature (610)..(610): n is a, c, t, g, unknown, or other
  misc_feature (623)..(623): n is a, c, t, g, unknown, or other
tccccgcggtggcggccgctctagaactagtggatcccccgggctgcaggaattcgcacgagaccattacctagaacatcctaatcgaaaaagcaggcgttcggcccggcagcccccaagtcccatcgccgagcagaaagtcaggaacagaactcaggcgttggcgattggcatctccctcccctaagccatggctaccgggcggcccgtacgactcgtgctggatgcctccctcctcctcgacccctcctccaccagggaggcggcggcggtggcgctgcggcccggggtagaggagttgctgcggcggttgcgctactccaacctgagcgtggcaatctgctatgcagagggcatgccaactaatgagtcagactttcttgaaaaggtcgcaagctcacacttgtttggatctatagtacttcttgcaaaaagtgggaatctttctccaattgaattaatgatagaatggagccgaacaagtttttgtttttatgcgacttncagagttgacaaaggtttaatttctgagctccagaatcagaactggagagttctttctgtagctaatgaatgtagcatagagggttcctggtgttttaaatgttcnaagggctcaggangtgcttctcaccttggctactctaatgaaaaggaa

SEQ ID NO: 42735 - protein, 156 aa, Zea mays
  misc_feature: Ceres CLONE 1441602-F
  misc_feature (105)..(105): Xaa is any aa, unknown, or other
  misc_feature (145)..(145): Xaa is any aa, unknown, or other
MATGRPVRLVLDASLLLDPSSTREAAAVALRPGVEELLRRLRYSNLSVAICYAEGMPTNESDFLEKVASSHLFGSIVLLAKSGNLSPIELMIEWSRTSFCFYATXRVDKGLISELQNQNWRVLSVANECSIEGSWCFKCSKGSGXASHLGYSNEKE

SEQ ID NO: 42736 - DNA, 657 bp, Zea mays
  misc_feature: Ceres CLONE 1441604-F
  misc_feature: Encodes the peptide sequence at SEQ ID NO. 42737
aagctggagctccccgcggtggcggccgctctataactagtggatccgccgggctgcaggaattcccacgagaccattacctagaacgtcctaatcgaaaatatccttcccccttccccggttcgagaagtctcgtcccccgcccccttattcgattacgagcaactccgccgccgccataaagccatctcccccatccgccgccgccgccaccgctgctggtgggacgggccgtgcatccgttccagcgaagaggaacagcgggtcggaggagccgccggcgaggtcgggccgcgagggatcgagatggtgctgtgggagctcagggccatcaccgcctacttcctcgggctgaggcgcacctaccgcctcgagctccgcatccagcgccccatcatcacgacgaaccaccccaggatccgggacttcgtctacaggcgcacacgggatgtcttcaacgtctcagcgtcggtccacaagaacattcagcagagagacatagaggtcggccggaacctcggaaacgcgatccttcgctggcttgatcgcatgaagccatcaacggagatccgcccccgtcttccaggcccagaataaacggcatgcacggtccatcccgtcaaaaatttaatccaaccccaggacggggggccgggg

SEQ ID NO: 42737 - protein, 96 aa, Zea mays
  misc_feature: Ceres CLONE 1441604-F
MVLWELRAITAYFLGLRRTYRLELRIQRPIITTNHPRIRDFVYRRTRDVFNVSASVHKNIQQRDIEVGRNLGNAILRWLDRMKPSTEIRPRLPGPE

SEQ ID NO: 42738 - DNA, 664 bp, Zea mays
  misc_feature: Ceres CLONE 1441620-F
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaacgagtgttctgcctcccgaatctcggtcgcgaagagactctccatctccgccgccgccatcatcggcgccaatctcgcgctccgctctgctccgcggcctccacgcccttggtgcccccacccccgtctcccgcccgggtgcctcccctgccccgttcacggtccccgcccccatccctcgaccggcgcgcatgtcgctgctgctgccacagcgcgtacgtgcccccgccccgtcgcgtcctcgccacatcggcgcgccccgtctgagttagcttcaggtctagcgacccgatctggaggcgggcaaaggcgtcacagacgaagatggacttgtctgcgtgcggagccgccgccgcaggcacctgcagtacgatgtcagtgggaatggacagctcggagtcgacggagagcagccccgagcgaaggagcagcgagatgtcntgcaggaggagcgagagcgaggaggccaccatgtcaaggtcgctctttagccgcaaccgccccccggggagcccagggtcctggcaccggacagagagcgcgtgaagggaacggaaggct

SEQ ID NO: 42739 - DNA, 652 bp, Zea mays
  misc_feature: Ceres CLONE 1441625-F
  misc_feature: Encodes the peptide sequence at SEQ ID NO. 42740
aagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgc

SEQ ID NO: 42740 - protein, 108 aa, Zea mays; identical to SEQ ID NO: 16131
  misc_feature: Ceres CLONE 1441625-F

SEQ ID NO: 42741 - DNA, 664 bp, Zea mays
  misc_feature: Ceres CLONE 1441633-F
aagctggagctccccgcggtggcggccgctctagaactagtggatcccccgggctgcaggaattcgcacgagaccattacctagaacatcctaatcgaaaaattgggagttcactcgctggtcgttgcctgctgcggattgcccccaggcggccccactcactccgctgttgatatttcgtttggttctcctttccgtcttgtccgtcgccgaggccttcttcccctcgctccccagctccagcaagcacatcagatccatccaaccacaaacaggaaggtgaacgacgggaacgagccctccgatcctcctactagctgcgatccgtacccttgcgacgatttcgcgcctaatctatcatctaccacgttctaggagtgctgaggtgttttactttcccgggagcgggtggtccaatccttccatccaccaggagagctcgtggcttgtctttgattacctcgggctcccctgtggccgtgatctgatatacgtccggatctgactgctgtaatcatcacgaacgtacgacgcctgaggggctgaagttgaaccatcattgccgtcacgaattcgtcgactctgaacccgaacgcaccgctcttcatgccgacggcgctgctgcaggtggaggacttctcgccacagtggtgggactcatcac

SEQ ID NO: 42742 - DNA, 664 bp, Zea mays
  misc_feature: Ceres CLONE 1441635-F
  misc_feature: Encodes the peptide sequence at SEQ ID NO. 42743
  misc_feature (414)..(414): n is a, c, t, g, unknown, or other
  misc_feature (451)..(451): n is a, c, t, g, unknown, or other
aaagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcgtgtgagggcggcagctgcggaggcgcggccagggcggtgagggggatcgggcaaggagaagtgagggatatgagagcacatgagggagctggaggagctgctttnctagctgaacccctcggcgaaggagttcgtgccgcantccgccccccgcgtgacggggggcgctcccggctttcgggcaaagcgccccttgttgtttccccggggaatgaaataataagggggccccccccaagttcccgcccgccgaattttttggagaaaaaaaacccaaatcaagggttgaaattttggggggggcccccccccggtttttccatttttctgcgcccgggggaagggactctcggcc

SEQ ID NO: 42743 - protein, 141 aa, Zea mays
  misc_feature: Ceres CLONE 1441635-F
  misc_feature (58)..(58): Xaa is any aa, unknown, or other
  misc_feature (71)..(71): Xaa is any aa, unknown, or other
MVAVAVDGLIRGADAVPAAEREACEGGSCGGAARAVRGIGQGEVRDMRAHEGAGGAAXLAEPLGEGVRAAXRPPRDGGRSRLSGKAPLVVSPGNEIIRGPPPSSRPPNFLEKKNPNQGLKFWGGPPPGFSIFLRPGEGTLG

SEQ ID NO: 42744 - DNA, 648 bp, Zea mays
  misc_feature: Ceres CLONE 1441651-F
aagctggagctccccgcggtggcggccgctctagaactagtggatcccccgggctgcaggaattcgcacgagaccattacctagaacatcctaatcgaaaaatcctcctgttgttcggagcgcacaccacacaagcagatctcccccaaagccacccgtctgtccctccgcttcaagatgtaaatctttgtacaaaccctgactggttctactatcaccctccaggtggagtcatctgacaccattgacaactttcatgcccacatccatcacaaggagggcatccccccgtaccagcagccgctcatctttactagcaaacatcttgagaacgggcgcacacttgctgactacaacttccagaaggagaacaccctccaccttgtgctccgtctcaggagatgcatcgccatctttgtgaaaaccctgacctgcgagactctctccctctagctggagtcctctgatcccattgacaacttcgaggccaagatccagaacaatgacggcatccctccataccagcattcggctcatctttgctggaaagcatcttgaagactggcgcacgcttgcctactagctcctccagaaggagagcaccctccacttgctgctgcacctcaagggaggcatgcaaatcttcct

SEQ ID NO: 42745 - DNA, 656 bp, Zea mays
  misc_feature: Ceres CLONE 1441652-F
  misc_feature: Translation starting site: 279
  misc_feature: SWISSPROT Homolog: EC 3.2.1.14 Chitinase
aaaactggagctccccgcggtggcggccgctctagaactagtggatcccccgggctgcaggaattcgcacgagaccattacctagaacatcctaatcgaaaaatcacctcagtatttgtcacaagctcaaatactgatctcatctgatccaggatggctatggcaaagggaggcgcgccgagggtctcggcggcccagctggtgactctcgggctatcactcctcagcgctgtcgccggcccggccgccactcacaactgcggctgccacccaaacgtatgctgcagcaagtttggctactgcggcacgaccgactattactgctgcgactggagccagtcgggcccttgccgctcgggcggcggcggcatcagagccacgctcgtggtgcgaacgtggctagcctcctcaccggctccttcttcaacagcatcaacacccaggccgggagcaggtgccagggcaacaacttctacacccggagcgcgttcctgagcgccgtcaaggcctacccaagcttcacccatggcgggtcacaagtgcagggcaagcgcgagatcgccgccttcttctcgcacgccacgcacgagaccgggcatttctgctacatcagcgagatcaacaagagcaacgcctactgcgacccgaccaagagc

SEQ ID NO: 42746 - DNA, 838 bp, Zea mays
  misc_feature: Ceres CLONE 1441663-R
  misc_feature: SWISSPROT Homolog: EC 1.11.1.11 L-ascorbate peroxidase
cgattgggtaccgggccccccctcgaggtcgacggtatcgataagcttttttttttttttttttgggagaaaaattgtttttttaaaatgttttacccggcaaaggcgcgagagatgtggttaaaaatcccacccccccctaaaagaacccaaacccccgggtcctttaggcaaacaattgacaaaggttcaaaggcaatgcaaactcccccccgacacactggtcaaggtttaagcttcggcaaacccgagctcaaaaagtttcaagggggcctcaccgtaatcagggaaaaacccttcttcatcatcggggtttttcccaccaaggggacggaacccgggatcttccaacaaacccttgtcaaaaacaagctaaaaaaaactttctttctccccgctaaaaagctccttgaagaaaaagttgtcaaaaataaaagggtttgaagtccaggccccttcaaatccggacctatcctgggggcatctccccaaagggggggccccaaaaaaagcgacaatgtccttgtcaaaaaaccccatctgctttgaaaaccccggccccagggggccacacccctttgtagcaccggggaaacgcccctcgggggggggctgaggcttgccctcccttccgggggggaaaggaatctcgggaccaccagggatttcaacggccacaaccccggtaggttgagggaaatctgcaaaggagatggtagggaactgctctctgataggctccaacagcctaagagcaatggggacccaccggtaacctccatgaccttgctaagcatcaaacttagttgttccaaaaggacccccagtcctttgacgc

SEQ ID NO: 42747 - DNA, 646 bp, Zea mays
  misc_feature: Ceres CLONE 1441667-F
  misc_feature: Encodes the peptide sequence at SEQ ID NO. 42748
ggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctctacctctgcctcctcgctgcgccgtgccccgcggcgcgggcggcgcggttcgcgtgcaacgccacggcgccgcgagcgtccacgtgccaggcgctcgtctcctacgcgccgccccacgggacggccacgcccacgctggccgccctgcgggcgctcttccagctccgctcccacggcgcgctgctgggcgccaaagggctcccgctctccacgcccgccacgggggccggggccgtgccgctgcgggtccgcctg

SEQ ID NO: 42748 - protein, 99 aa, Zea mays
  misc_feature: Ceres CLONE 1441667-F
MAPLPASLTPCLWLYLCLLAAPCPAARAARFACNATAPRASTCQALVSYAPPHGTATPTLAALRALFQLRSHGALLGAKGLPLSTPATGAGAVPLRVRL

SEQ ID NO: 42749 - DNA, 641 bp, Zea mays
  misc_feature: Ceres CLONE 1441680-F
  misc_feature: Translation starting site: 278
aaagctggagctccccgcggtggcggccgctctagaactagtggatcccccgggctgcaggaattcgcacgagaccattacctagaacatcctaatcgaaaactcctgcgagagacatttctcgtacatcgctatcggtatctgtctctctcatgatgtccatcacctgagcaacggcgccgggcatgtactcttcgacggatccaacataaggtcgcgccctccccgatcatggtgtcgggggataccatccggacgggaatcggcgtcatctgcaatgggaccaccagttgtgctcttcctctccacggtgaccaccttctggggcatatggaaaaaccctgcggtggagcaccactcagccatcccctacctggctcacgctccagaattgcatcatgtacgtgctttatcgtctgccgctggtgctccctgacaaaaagatggtggtgactatcaacggtaccggcatgctcgtccatttcacctaggtggtgctctacatccgcagctccgatggggcgggggaaccaaaggtctgtgcttctgttctccaccaaggtcgacttctccggcgcctaggccgcgctggtgcacaacctggaccacacgcacgagcacaagtccatggtcaacaacat

SEQ ID NO: 42750 - DNA, 563 bp, Zea mays
  misc_feature: Ceres CLONE 1441681-F
  misc_feature: Encodes the peptide sequence at SEQ ID NO. 42751
  misc_feature (392)..(392): n is a, c, t, g, unknown, or other
aagctggagctccccgcggtggcggccgctctagaactagtggatcccccgggctgcaggaattcgcacgagaccattacctagaacatcctaatcgaaaaagatcagaccacactcgtagagagaaggaaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcnggaacggcaccggcggcgagtccatctacggcgaagagttccccgacgagaaagtcgtgcgcaagcacaccgccccccggggtgctcttcatgggccaacgccggggcccaaaaccacgggctcccagtttcttcatctgcaacgtccgggacccccttgggtcgacggga

SEQ ID NO: 42751 - protein, 133 aa, Zea mays
  misc_feature: Ceres CLONE 1441681-F
  misc_feature (5)..(133): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (77)..(77): Xaa is any aa, unknown, or other
MANPRVFFDMTVGGAPAGRIVMELYANEVPKTAENFRALCTGEKGVGKSGKPLHYKGSTFHRVIPEFMCQGGDFTRXNGTGGESIYGEEFPDEKVVRKHTAPRGALHGPTPGPKTTGSQFLHLQRPGPPWVDG

SEQ ID NO: 42752 - DNA, 639 bp, Zea mays
  misc_feature: Ceres CLONE 1441683-F
  misc_feature: Encodes the peptide sequence at SEQ ID NO. 42753
  misc_feature (639)..(639): n is a, c, t, g, unknown, or other
ggagctccccgcggtggcggccgctctagaactagtggatcccccgggctgcaggaattcgcacgagaccattacctagaacatcctaatcgaaaagaagtctatctttttcgcctcctgccgtacgtccggtccgttccagcttgcaaagcgctcgcgagctgctgccatggccggcgccggtgcgccagcagttccccaggccggtcgcccagcccccaacttctacctcatcgtggggggcgccggcatcaagggcagctgcacggcgcacgctgcagcttctcacggcgcccgcgtcctgctgctggaacgattcgacctgctccacccgctgggctcctcacacggcgactcccgaatcatccgcgacgcctacgcgcagccgcagtacctacgcatggtgcgcctcgcccgccgcctctgggccgccgtcgaggccgaggccggctatcgcgtgctcaccccgacgccgcacctctccatgggcccgcggagcatcgcctcgctcgacgacaccatcgccaacatcggcgccgaggaggtggacgaggacaaccttcaccgcatgtggggcggcgccttcgccctcaccgtcccgggcccggaggacgcctgggtcaccgcgctcagcgaccn

SEQ ID NO: 42753 - protein, 156 aa, Zea mays
  misc_feature: Ceres CLONE 1441683-F
  misc_feature: SWISSPROT Homolog: EC 1.5.3.1 Sarcosine oxidase
MAGAGAPAVPQAGRPAPNFYLIVGGAGIKGSCTAHAAASHGARVLLLERFDLLHPLGSSHGDSRIIRDAYAQPQYLRMVRLARRLWAAVEAEAGYRVLTPTPHLSMGPRSIASLDDTIANIGAEEVDEDNLHRMWGGAFALTVPGPEDAWVTALSD

SEQ ID NO: 42754 - DNA, 618 bp, Zea mays
  misc_feature: Ceres CLONE 1441684-F
  misc_feature: Encodes the peptide sequence at SEQ ID NO. 42755
aagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctgcgcctcctccgtcgatttggattcgcagcggcggcggcggccaatcaaagcaatcatcacccagtcgcccagcccaacagacgctccagtccccagccctcccacccgcctcgatcgatgcgagggacaatgccggccaccgactcctcctcctccacctcctcctcgccggcggcggcgccgctgtcctccatcggccgctccatccgctcgctccgccgtgaccagaaccagatccactccttcccgccgccgccagacgccacagacgccttcaagcgccgcgccgcccaactcctggccaacctcccggcagccgacgacgtcctctccctcgcctggacgcgccaccacctcgaatcctatcctcctctgcctcgaagagttccgcgccctgctcttcggatccggggactcacccgctgctcggcccccgctcgaccgcctcaatcgcctacttctccgaccg

SEQ ID NO: 42755 - protein, 113 aa, Zea mays
  misc_feature: Ceres CLONE 1441684-F
MPATDSSSSTSSSPAAAPLSSIGRSIRSLRRDQNQIHSFPPPPDATDAFKRRAAQLLANLPAADDVLSLAWTRHHLESYPPLPRRVPRPALRIRGLTRCSAPARPPQSPTSPT

SEQ ID NO: 42756 - DNA, 646 bp, Zea mays
  misc_feature: Ceres CLONE 1441687-F
  misc_feature: Encodes the peptide sequence at SEQ ID NO. 42757
aaagctggagctccccgcggtggcggccgctctagaactagtggatcccccgggctgcaggaattcgcacgagaccattacctagaacatcctaatcgaaaaagccgcgtggacgcacaccagcacctgccctcctcgccgtcgccgcctccctccgcgcgaccgatctaccctccgccgccaccatgtcgctgatcgccggggaggacttccagcatatcctgcgattgctgaacaccaacgctggatgggaagcaaaagatcatgttcgccatgacctccatcaagggtggcgggcgccgcttctccaacatcgtctgcaagaaggccgacatccacatgaaccacagggccggcgagctgacgcctgatgaactggagcgcctgatgacggtcggggccaaccctacgcagttcaaggtgccggactggttcctctacaggaagaaggattacgaggacggtcggttctcgcaggtcgtctccaacgcccttgatatgaagctcatggacgaccttgagaggctcaagaagatcaggaaccaccgtggtctgcgtcactactggggccaccgcgtccgtgggcagcacaccgagactactggtaggcgtggaaagaccgttggtgtctcctagaagcgatgag

SEQ ID NO: 42757 - protein, 123 aa, Zea mays
  misc_feature: Ceres CLONE 1441687-F
  misc_feature (1)..(116): Pfam Name: Ribosomal_S13 Pfam Description: Ribosomal protein S13/S18
MFAMTSIKGGGRRFSNIVCKKADIHMNHRAGELTPDELERLMTVGANPTQFKVPDWFLYRKKDYEDGRFSQVVSNALDMKLMDDLERLKKIRNHRGLRHYWGHRVRGQHTETTGRRGKTVGVS

SEQ ID NO: 42758 - DNA, 651 bp, Zea mays
  misc_feature: Ceres CLONE 1441689-F
aagctggagctccccgcggtggcggccgctctagaactagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccaaggagcacaccgtccccacccccatgtttacccaccagttcctctgacggccgccgtgctccgatgaagctgagcgtgctccgtatccgccgctcccactccttctccgtcgccttcctctactgaatctacgtcttctcatgaacgcatcgaccctctccaactgctgatccttcgacgtctctccctctctctttctctctgagatagtctttcgaatccatctctagggatcctgtttctccccatcctccctgcaccccacccctcgagaaacagattcaatccg

SEQ ID NO: 42759 - DNA, 616 bp, Zea mays
  misc_feature: Ceres CLONE 1441691-F
  misc_feature: Encodes the peptide sequence at SEQ ID NO. 42760
aaagctggagctccccgcggtggcggccgctctataactagtggatcccccgggctgcaggaattcgcacgagaccattacctagaacatcctaatcgaaaagtgctctctcagaggtgggctggcttctcctccccctcttaccaagtcctcctcgggttagggttccttagggttttgtggaggggcgatggcggcggctgatgtggagtaccgtcgcttcgtcggcgggcttgcctgggccaccaacaacgagtcgctggagaatgccttcgcctcctacggcgagatcctcgactccaaggtcatcaccgaccgggagactgggaggtctcgcggcttcggcttcgttaccttctcctccgagaactccatgctcgacgctatggagaacatgaacggcaaggagctcgacggccgtaacatcaccgttaaccaggcccagtcccgtggcggtggcagtggcagcggtggctacggcggcggtcgcggcggaggaggctatggaggcgggcgccgtgacggcggctatggcggcggtggcggctactgcggtcggcgcgattgtggtggcggcgactacagaggcggtggcggctacggcggtcgtgacgag

SEQ ID NO: 42760 - protein, 142 aa, Zea mays
  misc_feature: Ceres CLONE 1441691-F
  misc_feature (11)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
MAAADVEYRRFVGGLAWATNNESLENAFASYGEILDSKVITDRETGRSRGFGFVTFSSENSMLDAMENMNGKELDGRNITVNQAQSRGGGSGSGGYGGGRGGGGYGGGRRDGGYGGGGGYCGRRDCGGGDYRGGGGYGGRDE

SEQ ID NO: 42761 - DNA, 632 bp, Zea mays
  misc_feature: Ceres CLONE 1441704-F
  misc_feature: Encodes the peptide sequence at SEQ ID NO. 42762
  misc_feature (515)..(515): n is a, c, t, g, unknown, or other
  misc_feature (524)..(524): n is a, c, t, g, unknown, or other
  misc_feature (525)..(525): n is a, c, t, g, unknown, or other
  misc_feature (539)..(539): n is a, c, t, g, unknown, or other
  misc_feature (567)..(567): n is a, c, t, g, unknown, or other
tccccgcggtggcggccgctctagaactagtggatcccccgggctgcaggaattcgcacgagaccattacctagaacatcctaatcgaaaacgctattcttgctaatcttcaagcaggagagaaaaaagcataagctgagcatccatcaatggcggatgctggcaacgaggccgagggtctgacgctgttgggcctgcacgtgagccccttcgcgttgcgcgtgcgcatggcgctgagcctcaagggcctgagctacgagtacatcgagcaggacctgttccacaagggcgagctcctcctcagctcaaaccccgtgcacaagaaggtgcccgtgctcatccaccacggcaagcccatctgcgagtccctcgccgtcgtggagtacgtcgatgaggtctggcccggcgccgccgccaccatcctccccgccgacccccacggtcgcgccaccgctcgcttctgggcccgctacatcgacggcaagctgtttccgggcgtggacagaatcatgaangcggcaacnngagaaagcgaggcngaaaagctgagggagacgcacgccgcgntcctcaacctggagagggctttgccgagatcagctctagctccagcaacgacggcgcggccttct

SEQ ID NO: 42762 - protein, 161 aa, Zea mays
  misc_feature: Ceres CLONE 1441704-F
  misc_feature (9)..(82): Pfam Name: GST_N Pfam Description: Glutathione S-transferase, N-terminal domain
  misc_feature: SWISSPROT Homolog: EC 2.5.1.18 Glutathione transferase
  misc_feature (122)..(122): Xaa is any aa, unknown, or other
  misc_feature (126)..(126): Xaa is any aa, unknown, or other
  misc_feature (140)..(140): Xaa is any aa, unknown, or other
MADAGNEAEGLTLLGLHVSPFALRVRMALSLKGLSYEYIEQDLFHKGELLLSSNPVHKKVPVLIHHGKPICESLAVVEYVDEVWPGAAATILPADPHGRATARFWARYIDGKLFPGVDRIMXAATXESEAEKLRETHAAXLNLERALPRSALAPATTARPS

SEQ ID NO: 42763 - DNA, 635 bp, Zea mays
  misc_feature: Ceres CLONE 1441722-F
  misc_feature: Encodes the peptide sequence at SEQ ID NO. 42764
  misc_feature (635)..(635): n is a, c, t, g, unknown, or other
ggagctccccgcggtggcggccgctctataactagtggatcccccgggctgcaggaattcgcacgagaccattacctagaacatcctaatcgaaaaaaatcgaaaaccactcgaacacaaactcaggcaaggcaaaaggaacccgcaccatccgaggctcaagcagagaagtgatcatcatcatcagaagaagatgtgcccaaccaagaaggggatgaccggagagccgagctcgccatgcaggtcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcgggcggccgcgcgcacgacgccgccatgctcgccctcgccggcgcgggccgctgctgcctcaacttcgccgactcggcctggctcctccgcggtccggcctcgtgcgccagcctccgcgaggtccgccacgcgggcccggacgccgtggaggaattcctccggcctccaggggtcn

SEQ ID NO: 42764 - protein, 147 aa, Zea mays
  misc_feature: Ceres CLONE 1441722-F
  misc_feature (51)..(104): Pfam Name: AP2 Pfam Description: AP2 domain
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1248 in the 10/374,780 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 752 in the 11/435,388 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 692 in the 11/435,388 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1722 in the 10/412,699 US patent application
  misc_feature: The sequence is a functional homolog of SEQ ID NO 192 in the 11/375,241 US patent application
  misc_feature: The sequence is a functional homolog of SEQ ID NO 1958 in the 10/374,780 US patent application
  misc_feature: The sequence is a functional homolog of SEQ ID NO 2241 in the 10/666,642 US patent application
  misc_feature: The sequence is a functional homolog of SEQ ID NO 424 in the 10/714,887 US patent application
  misc_feature: The sequence is a functional homolog of SEQ ID NO 46 in the 10/412,699 US patent application
  misc_feature: The sequence is a functional homolog of SEQ ID NO 57 in the 10/838,616 US patent application
  misc_feature: The sequence is a functional homolog of SEQ ID NO 576 in the 11/435,388 US patent application
  misc_feature: The sequence is a functional homolog of SEQ ID NO 72 in the 10/669,824 US patent application
  misc_feature: The sequence is a functional homolog of SEQ ID NO 72 in the 10/870,198 US patent application
  misc_feature: The sequence is a functional homolog of SEQ ID NO 98 in the 10/675,852 US patent application
  misc_feature: The sequence is a functional homolog of SEQ ID NO 1720 in the 10/412,699 US patent application
  misc_feature: The sequence is a functional homolog of SEQ ID NO 1956 in the 10/374,780 US patent application
  misc_feature: The sequence is a functional homolog of SEQ ID NO 196 in the 11/375,241 US patent application
  misc_feature: The sequence is a functional homolog of SEQ ID NO 2239 in the 10/666,642 US patent application
  misc_feature: The sequence is a functional homolog of SEQ ID NO 422 in the 10/714,887 US patent application
  misc_feature: The sequence is a functional homolog of SEQ ID NO 44 in the 10/412,699 US patent application
  misc_feature: The sequence is a functional homolog of SEQ ID NO 55 in the 10/838,616 US patent application
  misc_feature: The sequence is a functional homolog of SEQ ID NO 574 in the 11/435,388 US patent application
  misc_feature: The sequence is a functional homolog of SEQ ID NO 70 in the 10/669,824 US patent application
  misc_feature: The sequence is a functional homolog of SEQ ID NO 70 in the 10/870,198 US patent application
  misc_feature: The sequence is a functional homolog of SEQ ID NO 96 in the 10/675,852 US patent application
  misc_feature: The sequence is a functional homolog of SEQ ID NO 1236 in the 10/374,780 US patent application
  misc_feature: The sequence is a functional homolog of SEQ ID NO 1225 in the 10/374,780 US patent application
  misc_feature: The sequence is a functional homolog of SEQ ID NO 1314 in the 11/479,226 US patent application
  misc_feature: The sequence is a functional homolog of SEQ ID NO 16 in the 10/225,068 US patent application
  misc_feature: The sequence is a functional homolog of SEQ ID NO 186 in the 10/374,780 US patent application
  misc_feature: The sequence is a functional homolog of SEQ ID NO 190 in the 11/375,241 US patent application
  misc_feature: The sequence is a functional homolog of SEQ ID NO 516 in the 11/435,388 US patent application
  misc_feature: The sequence is a functional homolog of SEQ ID NO 566 in the 10/225,066 US patent application
  misc_feature: The sequence is a functional homolog of SEQ ID NO 616 in the 10/412,699 US patent application
  misc_feature: The sequence is a functional homolog of SEQ ID NO 696 in the 11/435,388 US patent application
  misc_feature: The sequence is a functional homolog of SEQ ID NO 704 in the 11/435,388 US patent application
MCPTKKGMTGEPSSPCRSASASTLPEHHQTVWTSPPKRPAGRTKFRETRHPVFRGVRRRGSAGRWVCEVRVPGRRGCRLWLGTFDTAEAGGRAHDAAMLALAGAGRCCLNFADSAWLLRGPASCASLREVRHAGPDAVEEFLRPPGV

SEQ ID NO: 42765 - DNA, 625 bp, Zea mays
  misc_feature: Ceres CLONE 1441723-F
  misc_feature: Encodes the peptide sequence at SEQ ID NO. 42766
ggagctccccgcggtggcggccgctctagaactagtggatcccccgggctgcaggaattcgcacgagaccattacctagaacatcctaatcgaaaaaggacagctttattccgttccaacttccaaggtccgagggctccagaaaccggcaaggggatcgaagcggagagcaagggagcggtcgagcgggtgacatcatcgtcatccagggtttctcaatcggcagcgatggcgaccagggcggcggcgaggttcctgcagcgcaggtttctgtcttccggcggcaaggtcctcagcgaggaggagaaggccgccgagaacgtgtacatcaagaaagtggaacaagagaagctggagaagctcgcacgcaagggccccagctcaggagagcaaccctcgtcaaccacaggctctgcagcaagtgatgtgaaggccgatgctgggctaacggagtcagcatctgcaagtgtgtcgacggacaagaacaggaactatgctgttctggcaggcgcagttgctgccctgggtggcttgggttggtatctattgtcaaagcctaagaagtcggaggaggttgtggactgaagagggaggttgtgaatgcgatctgcggatggtcggcctt

SEQ ID NO: 42766 - protein, 118 aa, Zea mays
  misc_feature: Ceres CLONE 1441723-F
MATRAAARFLQRRFLSSGGKVLSEEEKAAENVYIKKVEQEKLEKLARKGPSSGEQPSSTTGSAASDVKADAGLTESASASVSTDKNRNYAVLAGAVAALGGLGWYLLSKPKKSEEVVD

SEQ ID NO: 42767 - DNA, 646 bp, Zea mays
  misc_feature: Ceres CLONE 1441732-F
  misc_feature: Encodes the peptide sequence at SEQ ID NO. 42768
  misc_feature (539)..(539): n is a, c, t, g, unknown, or other
ggagctccccgcggtggcggccgctctataactagtggatcccccgggctgcaggaattcgcacgagaccattacctagaacatcctaatcgaaaaagaaccgtctccaatggcgctactccgagcgctccggcgagcccttccggcgctctcctcgccggcggcggttctcccccgtcgcgccccgcacccactacctcctccgcccgctcctcgtcggttcctggacccgatcgggctccgctccttctccgccgccgccgccaccgcgtcgcaggcgccgcccatgggggccaccctgttcggcgggctcatggacacccggttcccgaagcgccggccgggcttcgccaaccgccggaagagggctagcttgcgccccaaaggtccgtactactgggtgaagtgcaagcctgacgagcccataccagttagtcagccgaaccaagggagcgtacgagggaggaaggagaaagaagcggatcaagcaacgcaaggactttatcatggcttgaaaaaaagaagccgaaaaactcaantattctggctgctgtttaaaagaagggaggcccgaaccaaccacaaagggaaaattggctgcttgtgggcaagaaaagccgggccttgggccaagcaagggttgaat

SEQ ID NO: 42768 - protein, 179 aa, Zea mays
  misc_feature: Ceres CLONE 1441732-F
  misc_feature (144)..(144): Xaa is any aa, unknown, or other
MALLRALRRALPALSSPAAVLPRRAPHPLPPPPAPRRFLDPIGLRSFSAAAATASQAPPMGATLFGGLMDTRFPKRRPGFANRRKRASLRPKGPYYWVKCKPDEPIPVSQPNQGSVRGRKEKEADQATQGLYHGLKKRSRKTQXFWLLFKRREARTNHKGKIGCLWARKAGPWAKQGLN

SEQ ID NO: 42769 - DNA, 1041 bp, Zea mays
  misc_feature: Ceres CLONE 1441734
  misc_feature: Encodes the peptide sequence at SEQ ID NO. 42770
tcgtcacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtggtggagaagccggaggaggggaagaagcccgacgaggagggtgacgagaggaagaaggccgaccccgccgccgagaaggagaagaaggccgaccccgccgccgagaaggagaagaaggcgaggaagccgcggagcaggaagcccaagtccgccgggctgcaccacccgccctatttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggccgtgcagctgcgcggcttcgccgccaagggccgcctcgtcaaggtcaaggcctccttcaagctcgccgccgccgaggagaggaagccctccgcggccgcgaaggcgaagaagaaggcgtcggcgggaatggccaagcgcaagagggccgccgcgccggccaagatgaagccggcggccgctgcctcggcgccgtcgagggaggcacgtaaggtgcgcgcgaagcgagcgaggaaggtggccccggcgcccgcgcagcccaagcccaagccagcccgcgccgccgcttccggtgccggcaagaaggtcaacaaggccagcgcctgattagcggcggccgtcctggtccccccgcgcgcgcctccgtgtattatactagccggtagtagcagtaggagttgcaagtactagcagcgtcgtagtcgtgatgatgttgtggtcgtcgtctccgccggcccgatcgatcgggcgctctgttccgccgtgtggcagagttttgtaaataactagtctggtgtgatgcgctcatggcaataaagcgcgcgcttctagcttccttgatgaaaaaaaaaaaaaaaaaa

SEQ ID NO: 42770 - protein, 235 aa, Zea mays
  misc_feature: Ceres CLONE 1441734
  misc_feature (80)..(151): Pfam Name: Linker_histone Pfam Description: linker histone H1 and H5 family
MATVTEEVAPVVTVSEEPAPEAAKEVVEKPEEGKKPDEEGDERKKADPAAEKEKKADPAAEKEKKARKPRSRKPKSAGLHHPPYFEMIKEAILSQDGGKVGASPYAIAKHMGEKHRDVLPPNYRKVLAVQLRGFAAKGRLVKVKASFKLAAAEERKPSAAAKAKKKASAGMAKRKRAAAPAKMKPAAAASAPSREARKVRAKRARKVAPAPAQPKPKPARAAASGAGKKVNKASA

SEQ ID NO: 42771 - DNA, 622 bp, Zea mays
  misc_feature: Ceres CLONE 1441737-F
  misc_feature: Encodes the peptide sequence at SEQ ID NO. 42772
tggagctccccgcggtggcggccgctctataactagtggatcccccgggctgcaggaattcgcacgagaccattacctagaacatcctaatcgaaaaacttcgattcgctcccacgcacacacactcctgcctgcggttgccactcgcgtagcaccagacagcggcagcagcacgcgcgcgacgttcgcaatggcggcgcgggcaaccgtcgtcctctgcgccgcgttcctcgtcctgctctccgccaccagctccctcgcgcagtcccccgcggccgcgccggctaaggcgccgcccaagtcctcctccaaggccacgccggccgccgcgcccgcgcccaagtcctcctccaaggccagcccattggcgccggccgccgcgccaaccaccccggcacccgcggcggcgccggccacgccaaagcccaaggcccccgcgcccgcgcccgccaccaaggccgcagccccggccccggctacccctgctcccgtcgccactccccccgcggcgacgcctcccgccgccgaggcgcccgtgcccgccgcggcgccggcccccgagaccaagcccgtcgaggcccccgcccccgcccccgcgccggccaagaagaagaagccgtcg

SEQ ID NO: 42772 - protein, 144 aa, Zea mays
  misc_feature: Ceres CLONE 1441737-F
MAARATVVLCAAFLVLLSATSSLAQSPAAAPAKAPPKSSSKATPAAAPAPKSSSKASPLAPAAAPTTPAPAAAPATPKPKAPAPAPATKAAAPAPATPAPVATPPAATPPAAEAPVPAAAPAPETKPVEAPAPAPAPAKKKKPS

SEQ ID NO: 42773 - DNA, 605 bp, Zea mays
  misc_feature: Ceres CLONE 1441740-F
  misc_feature: Encodes the peptide sequence at SEQ ID NO. 42774
  misc_feature (364)..(364): n is a, c, t, g, unknown, or other
  misc_feature (365)..(365): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (428)..(428): n is a, c, t, g, unknown, or other
tccccgcggtggcggccgctctataactagtggatcccccgggctgcaggaattcgcacgagaccattacctagaacatcctaatcgaaaaacgctagtaaaggacccccgctagtaaatcgagctcggaggcgaatctctcgctaactgtcatcaatggcggccgagcccaagatcctagagctctccaacggcaagatcaccgcgaggatctccaactggggcgccaccatcacctccctcctcgtccccgacgcccaggaaaggcatgtcaccttattttggctgcatagttggccgtgtcgcgaataggatcaaggatgggaagtttacactaaacggacttgagtattcattacctgtnncacatggacctaacagccttcatgggtgggtgaaggnnnattgataggtcgtgtgggatgtcntggaacacaaagatggcgaatgcccttcaataacttttcgtatcacagcaaggacgggggagaaagctttcaggcgatgtaacattccagcaaatatcccctcctggagctcctacctaggctttgcctggaacctccccaaaaacaaagcactccaattaacctgggcacccacct

SEQ ID NO: 42774 - protein, 44 aa, Zea mays
  misc_feature: Ceres CLONE 1441740-F
  misc_feature: SWISSPROT Homolog: EC 5.1.3.3 Aldose 1-epimerase
  misc_feature (33)..(33): Xaa is any aa, unknown, or other
MSPYFGCIVGRVANRIKDGKFTLNGLEYSLPVXHGPNSLHGWVK

SEQ ID NO: 42775 - DNA, 572 bp, Zea mays
  misc_feature: Ceres CLONE 1441742-F
  misc_feature: Encodes the peptide sequence at SEQ ID NO. 42776
agctccccgcggtggcggccgctctagaactagtggatcccccgggctgcaggaattcgcacgagaccattacctagaacatcctaatcgaaaaaacccaaacaccacaatccccttcaacaaacgcaccgcactccacggcagccagaaaacacattccacacagtctccgtgaggtctgagcgaggtaggactagctctgagcgagttcttccgtcttcaaggtataatccttgcaactctcactatcctcttcgcatcgctcgtctctttttgtgactagttggatttctcttctttttccttggatcctactacctactagaacagagctccagagccttttagtttctggtctctgatctactcattttcttttcttccccttttggtgacataggtaggtctagttaagatctgtcgtggctgttctttgattttagcctagaaacagcccgaattagtcttccttctttccttaaaaaaaaattcccccaaaaaaaaaaaagttggggagagaaattcttggacccttggagggccccggttaaaatctccccggggcccaggag

SEQ ID NO: 42776 - protein, 57 aa, Zea mays
  misc_feature: Ceres CLONE 1441742-F
APRGGGRSRTSGSPGLQEFARDHYLEHPNRKNPNTTIPFNKRTALHGSQKTHSTQSP

SEQ ID NO: 42777 - DNA, 644 bp, Zea mays
  misc_feature: Ceres CLONE 1441748-F
  misc_feature: Encodes the peptide sequence at SEQ ID NO. 42778
aagctggagctccccgcggtggcggccgctctagaactagtggatcccccgggctgcaggaattcgcacgagaccattacctagaacatcctaatcgaaaaacaagacacaaccaccgccgtgcgcgcgcagctcgagctctgctcctcccttcacctcggattaataaacttcggcgccgatttttactataatattttaccatgggcgcgtgcaactcgtgcgaggcgacggccgtggcggcggtcacgggggcctccgcggtgggcgaggccacggcggcaagggtcgtgctcgcggacggccagctgcagcggttccccgggggcacccgggcgtcgcaggccatgaaggccgcggcggctcccgcgggcgcgtgcttcctgtgcagcgccgacgggctcgagctcggcggcgcggtggccgcggtggtgggcgacgaggagctgcagcccgggcagctctacttcgtgctgcccgcggcgatgcggcggcgggcgctgcaggcggaggagatggccgcgctcgcgatccgcgccagcgccgcgctggccggcgaccacgacggcccgctcgtgttccccgactcggccagtggcgcccccgcggcgaggagcggcgcgaagggcgggtcccgccggcgg

SEQ ID NO: 42778 - protein, 147 aa, Zea mays
  misc_feature: Ceres CLONE 1441748-F
MGACNSCEATAVAAVTGASAVGEATAARVVLADGQLQRFPGGTRASQAMKAAAAPAGACFLCSADGLELGGAVAAVVGDEELQPGQLYFVLPAAMRRRALQAEEMAALAIRASAALAGDHDGPLVFPDSASGAPAARSGAKGGSRRR

SEQ ID NO: 42779 - DNA, 601 bp, Zea mays
  misc_feature: Ceres CLONE 1441751-F
  misc_feature: Encodes the peptide sequence at SEQ ID NO. 42780
ggagctccccgcggtggcggccgctctagaactagtggatcccccgggctgcaggaattcgcacgagaccattacctagaacatcctaatcgaaaaatcacccgcttcacctccagacgtccagttctccaccccacttcgcccatcgagtgccagtggagcgcttccttgacctcgccacctcctgtcctccctctcctgtactggcgcccgttgtttctttcccttgccggatgcccgccgccggagctgaagagggggaatgcagccgccacagcactacccgccgacgcctgaggcggggtcgcgggggccagggccggccccaccaccgtcgacgaggcgtccatggaactcagcaagagcttcatcaaggctctacaggggctccgtgtgagaaggcgaaagagattctgatggaggaaagcaatgttcagaaattctttctttatgctaatgatgaagatgctgcagaagatggagatcaggatgctgaattgctgatagtttggtttgaaaaatgttagatctgaacatctatggtagtacattgttatgtgacattggtaattatttttggcaatatagataataccgcaca

SEQ ID NO: 42780 - protein, 97 aa, Zea mays
  misc_feature: Ceres CLONE 1441751-F
MPAAGAEEGECSRHSTTRRRLRRGRGGQGRPHHRRRGVHGTQQELHQGSTGAPCEKAKEILMEESNVQKFFLYANDEDAAEDGDQDAELLIVWFEKC

SEQ ID NO: 42781 - DNA, 629 bp, Zea mays
  misc_feature: Ceres CLONE 1441753-F
  misc_feature: Encodes the peptide sequence at SEQ ID NO. 42782
ggagctccccgcggtggcggccgctctataactagtggatcccccgggctgcaggaattcgcacgagaccattacctagaacatcctaatcaaaaaccgcacacgcacagtccgtctcgtctgccaacgccgctactcggcgcaccttggcttgctatttcgccaacaacctcctccctctttaccgcggcgtgccgcgtgcggcgggcgcggatggcaacggccacctccgcctccgcctccgcctccgcctcccccggcgcgttcggcgccaaaaccccagccccagcccgtgggctgagcacgcacccggtcctgaccccgagccccgcattcgcgaggccttcgccgcgcacccccgcctgcagcaggtcccgcgccagcctccacctcggcggcctgggctcgaccagcagcagcagcgccgccgccgccggaaacggaaccgggctccacgtgccccccacggtcgcgccgctcgccgtgcctaaaatggccggctccatgaagacccataagaacgtcctgctcttctactgcgaggagatgcgggacctcgcgcagcaggtggtcgcccggaacgatgacatcgaacttcgatccatctcatggaggacatttccagacgg

SEQ ID NO: 42782 - protein, 138 aa, Zea mays
  misc_feature: Ceres CLONE 1441753-F
  misc_feature: SWISSPROT Homolog: EC 2.7.6.1 Ribose-phosphate diphosphokinase
MATATSASASASASPGAFGAKTPAPARGLSTHPVLTPSPAFARPSPRTPACSRSRASLHLGGLGSTSSSSAAAAGNGTGLHVPPTVAPLAVPKMAGSMKTHKNVLLFYCEEMRDLAQQVVARNDDIELRSISWRTFPD

SEQ ID NO: 42783 - DNA, 727 bp, Zea mays
  misc_feature: Ceres CLONE 1441757-F
  misc_feature: Translation starting site: 276
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (74)..(74): n is a, c, t, g, unknown, or other
  misc_feature (76)..(76): n is a, c, t, g, unknown, or other
gggcgcccctttggcgcccgtgtgcgccctaattcactacaccaccgctggtggctttttttttnnnnggtgtncncccaaaactggagctccccgcggtggcggccgctctttactagtggatcccccgggctgcaggatttcgcacgagaccattacctagaacatcctaatcgaaaaacccatccaccgagctgccctgctacacggtcccctgccaagatccatcttcccggttacgccgcctgatcgaagtgaacaagcaaggaagagccatggcgagcgagcacgcggcggggggcgaggctaagcatgaccagaagcagagcctgatggacaaggcgaaggggttcgttgtggagaagatcgcgcacatccccaagcccgaggcgacgctggacggcgtgacgttcaagggcctgagccgggagtgcatcacgctgcacagcagcgtgaacgtgtccaaccccctacgaccaccgcctccccatctgcgaggtgacctacacgctccggtgcgccggcaaggaggtggcgtccggcaccatgccggaccccggctggatcgccgccagcggctccaccgcgctggagacccccgcccaaggggccctacgactttccccggcttcctccgcaagggacgtccggccggggactggggacatccgaccaagaagcctcagggtccgggaatcaccgtccgaacttcccccaatcggtcggg

SEQ ID NO: 42784 - DNA, 741 bp, Zea mays
  misc_feature: Ceres CLONE 1441758-F
  misc_feature: Encodes the peptide sequence at SEQ ID NO. 42785
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (66)..(66): n is a, c, t, g, unknown, or other
  misc_feature (68)..(68): n is a, c, t, g, unknown, or other
  misc_feature (74)..(74): n is a, c, t, g, unknown, or other
  misc_feature (77)..(77): n is a, c, t, g, unknown, or other
  misc_feature (78)..(78): n is a, c, t, g, unknown, or other
gtttgtcttgtgctggttnnntactcccccccgcccccaccccatcaccggggggtggaaagggtntntttttnccnnttcatactggagctccccgcggtggcggccgctctagactagtggatcccccgggctgcaggaattcgcacgagaccattacctagaacatcctaatcgaaaaagattagtgggggaactgggcgtaaccgtaatattcaccctgcgcccctccctcttgttctccggttccccgcggcatactctttcctgcgctctctctctcggttctgccgtgtccctcgcgtgcgctctgtctccggtggcgccgcctccgccgcctccgtcgccctgcgccagatcagattcgtggatatggctgataatgagaaagaagtgggggagggaaccaccccccgaggggcggactgggaagttgtgactctcacagcatctgcctatgaagcggcgccaggacctgtcaggacagaagtaaagcctgttaatgaaaatcaagagcatagttcatccaatgcactgctcatgtttgaccactttgtgtttccccccaggggagcacgagaacctggccaatacaaaccagtttcccatgaaaatacagcctggagaaggatggggcagaaaccctaagacccccttgtggaagaattataatcttttaagaaatggttgttggggccccgaaaaagaatttcaagtttttgaagaatgaaaagggcaaaa

SEQ ID NO: 42785 - protein, 91 aa, Zea mays
  misc_feature: Ceres CLONE 1441758-F
MADNEKEVGEGTTPRGADWEVVTLTASAYEAAPGPVRTEVKPVNENQEHSSSNALLMFDHFVFPPRGAREPGQYKPVSHENTAWRRMGQKP

SEQ ID NO: 42786 - DNA, 629 bp, Zea mays
  misc_feature: Ceres CLONE 1441759-F
  misc_feature: Encodes the peptide sequence at SEQ ID NO. 42787
ggagctccccgcggtggcggccgctctataactagtggatcccccgggctgcaggaattcgcacgagaccattacctagaacatcctaatcgaaaaatattgttttgggtccggaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctgcctacatccgcctgcagccagaagatctgcctccagcgaccgccctgcctgccccttgtggcttctgtggttctgcacaccagcacacgcacttgtccccaaacaacggcggcggcgatgagtatctcagaagagcttcccggcgaaggatctgacggtgaggaggaggtcttcatcaacgaggaggacatcatccacgagataacc

SEQ ID NO: 42787 - protein, 30 aa, Zea mays
  misc_feature: Ceres CLONE 1441759-F
MSISEELPGEGSDGEEEVFINEEDIIHEIT

SEQ ID NO: 42788 - DNA, 794 bp, Zea mays
  misc_feature: Ceres CLONE 1441764-F
  misc_feature: Encodes the peptide sequence at SEQ ID NO. 42789
  misc_feature (20)..(20): n is a, c, t, g, unknown, or other
  misc_feature (63)..(63): n is a, c, t, g, unknown, or other
  misc_feature (687)..(687): n is a, c, t, g, unknown, or other
gtcgggggggggggggcggntcttccccctccatcccggtaatgaggcggggacccccaattngtttaggggcggacaataaaacaggagctccacgcggtgggggccgctcaatactagaggagcccccgggctgaaggaattgccacaagaccattacctagaacatcctaatcgaaaaccacatccccttctgcaatcaaaaaccgagctagggttttagggggagacagagaagcagagggaggctccatggacaaccccgagatgcagcgattcattcagaaagagcagcagaaggcgatgatgaacgatatggtcggcaagctaacgagcgcgtgctgggacaaatgcatcaccagcgctcccgggagcaagttcagctccggggaaacaacctgccggaccaaccgcgcccagaggttcctcgaacagaagcgggctgagtggcccaaacgctgcgagaagggaaaggaggggggcgccaccatcaagggctggttggacggggccaacacgaccctgacgggcctacccccgccgggagtatgaggggttccacatggggggggactttggggaccagatcccccccacagaaaattaaacaacgcagaggggggccggcggggggcggccacacaacgggcgccgggcgatcagggaacaacagccggcaacaagtcncccccttcgaggggcggggggacacaacagaaatcgcgggaacgccgcgcgcggggtccccaagaccgagagggcgcggccgcgcggacgcccgggggtcgggcgcc

SEQ ID NO: 42789 - protein, 99 aa, Zea mays
  misc_feature: Ceres CLONE 1441764-F
  misc_feature (7)..(63): Pfam Name: zf-Tim10_DDP Pfam Description: Tim10/DDP family zinc finger
MDNPEMQRFIQKEQQKAMMNDMVGKLTSACWDKCITSAPGSKFSSGETTCRTNRAQRFLEQKRAEWPKRCEKGKEGGATIKGWLDGANTTLTGLPPPGV

SEQ ID NO: 42790 - DNA, 647 bp, Zea mays
  misc_feature: Ceres CLONE 1441768-F
  misc_feature (647)..(647): n is a, c, t, g, unknown, or other
tcttaactagtggatcccccgggctgcaggaattcgcacgagaccattacctagaacatcctaatcgaaaagaggaattttaaatgtggctgcaatcaaagctcctggttttggtgagaggcgtaaagctcttcttcaggacattgccattgttacaggtgctgaatatcaatccaaagatcttggtctactagttgaggatacaacagtggagcagcttggcatagctcggaaagttacaatctcaagttcctcgacgaccattatagcagatgctgctagcaaagacgatatccaggccagaatcgcgcagctgaagagagagctttctcagacggactcgacgtatgactctgagaagttggcagagagaattgcaaagctttctggtggagttgctgtggttaagggttggagcatcgaccgaggcagagctagaggaccgcaagctccccactaaagacgccaagaatggcaacttttgcagccatagaaggaaggtattgttcccacgaggccggtggcaccgtttggtccatcctttcggaccttccttacccggcctattcaaggaagacccttgggaatgaactcctgagggaagccgcccctaggggggctcgaattattccattccagaaagggtn

SEQ ID NO: 42791 - DNA, 728 bp, Zea mays
  misc_feature: Ceres CLONE 1441776-F
  misc_feature: Encodes the peptide sequence at SEQ ID NO. 42792
  misc_feature (11)..(11): n is a, c, t, g, unknown, or other
  misc_feature (17)..(17): n is a, c, t, g, unknown, or other
  misc_feature (72)..(72): n is a, c, t, g, unknown, or other
  misc_feature (83)..(83): n is a, c, t, g, unknown, or other
ttgttgtttcnttgctnggacccccctttcagtgaattcttttatcaccatccccccaacccggggggaaanccctccccccnaaagctggtgctccccgcggtggcggccgctcttcaactagtggatcccccgggctgcaggatttcgcacgagaccattacctagaacatcctaatcaaaaaaaaacaccacaagataattaccagcagatcatcatcatcatcacattaacgcgccgagctagctaaacgcgaagcgctaatggcgatcgtttacgtgcttctggtggcgctgatcaccgcggcgtcccatgcgccgcacggagcgcacggccagacgtggcacggcgacctcgcggcgctcgccgccgccggcaagctccgcagcgaccccaacgccaccctggcggcctccacggacttcggcaacatcacggcggcgctcccggcggccgtgctgttcccgtcgtacccggcggacgtggctgctctcctcccccccgcgcacaccaccgtggcgtggccgtacaccatctcgttgtgcggccgccgcccactccctgatggggccagggccttggccctccggcggcgcggtcgctccaaatgcccgcccctgcgtagggccgtccctaccgaggctcaccatcaacggggtcgtgcggaacgggctggtacttccaacccccgggtcggccgaccatttaggtgcgactccacccggcc

SEQ ID NO: 42792 - protein, 154 aa, Zea mays
  misc_feature: Ceres CLONE 1441776-F
  misc_feature: SWISSPROT Homolog: EC 1.5.99.12 Cytokinin dehydrogenase
MAIVYVLLVALITAASHAPHGAHGQTWHGDLAALAAAGKLRSDPNATLAASTDFGNITAALPAAVLFPSYPADVAALLPPAHTTVAWPYTISLCGRRPLPDGARALALRRRGRSKCPPLRRAVPTEAHHQRGRAERAGTSNPRVGRPFRCDSTR

SEQ ID NO: 42793 - DNA, 753 bp, Zea mays
  misc_feature: Ceres CLONE 1441785-F
  misc_feature: Encodes the peptide sequence at SEQ ID NO. 42794
  misc_feature (1)..(1): n is a, c, t, g, unknown, or other
  misc_feature (2)..(2): n is a, c, t, g, unknown, or other
  misc_feature (37)..(37): n is a, c, t, g, unknown, or other
  misc_feature (71)..(71): n is a, c, t, g, unknown, or other
nncctggctccctctccctttccttcccccccccccntgcgggagtggtggccccggggggggagtggggnccccggctgttttttatactggagctccccgcggtggcggccgctctagactagtggatcccccgggctgcaggaattcgcacgagaccattacctagaacatcctaatcgagaagaaaaccactcgaacacaaactcaggcagggcaaaaggaacccgcaccatccgaggctcaagcagagaagtgatcatcatcatcagaagaagaagatgtgcccaaccaagaagggggtgaccggagagccgagctcgccatgcagctcggcatcagcctcgagcttgcgggagcaccgccagaggggtgtggacggtcgccgccgaagcggccagcggggcggaccaagttccgggagacgcggcacccggtgttccgcggcgtccggcgccggggcatcgccgggcggtgggtgtgcgaggtgcgcgtgccggggaggcgcggctgcaggctctggttcggcaccttctacactggtcaaggggcggcccgcgcgcacgaggcccccatggttggtcctcgccggcgcgggcgccctgctggcttaatttcatcacactcggcctgggctccctcgggggccccggccctcggggggccagcccttgtccgagggcccgcccacccccgttcgaggaaggtgcgggggaacaacttccttggcgccagcagggggggcccccgaga

SEQ ID NO: 42794 - protein, 142 aa, Zea mays
  misc_feature: Ceres CLONE 1441785-F
  misc_feature (37)..(90): Pfam Name: AP2 Pfam Description: AP2 domain
MQLGISLELAGAPPEGCGRSPPKRPAGRTKFRETRHPVFRGVRRRGIAGRWVCEVRVPGRRGCRLWFGTFYTGQGAARAHEAPMVGPRRRGRPAGLISSHSAWAPSGAPALGGPALVRGPAHPRSRKVRGNNFLGASRGGPR

SEQ ID NO: 42795 - DNA, 764 bp, Zea mays
  misc_feature: Ceres CLONE 1441794-F
  misc_feature: Encodes the peptide sequence at SEQ ID NO. 42796
  misc_feature (8)..(8): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (20)..(20): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (72)..(72): n is a, c, t, g, unknown, or other
ggggggtntggtcnntgngngtgcgccgcgcccccccccgccccggggtgttgtgtgggctcaccccnnntntctccccccccaaaactgggactccaccgcggtggcggccgctctagactagtggatcccccgggctgcaggaattcgcacgagaccattacctagaacatcctaatcgaaaagctcgtctgcgtttgccatttctgtgcaaggtagcttgcacccatcgtgaagccgagggagcggcgacacattggtacctgctgtgctgcagtgctctcgtcctggtcggagatggacgctgaggccggcgaggcgggggtgcagcagccggccggggcggcgtccacgagcaccgcggcggtgccgttcgacaggtcgtcgtcgcggctaggcgcgccgggtgccgagagcttcaacggcgcgctcagggagctcagggatcctgcggtctcagctgcacgaagcggcggactgctgcgccaaggcgtttcctcagccccgacaagaaaaagatgattcctggagggtacaaaggggtacatatggcgatggcggggggagctggtgatcgaaccccctgggggaccagtttccccccaggctttgacccccagctggcagggagaggaactgaaagcccccacagaaccgtaacgaaaaggaccacctttcttggaaaaccaaaggctttttggacatggcggagccagttccgcccttttttcctccggaagagctttctggccccggtacccaag

SEQ ID NO: 42796 - protein, 74 aa, Zea mays
  misc_feature: Ceres CLONE 1441794-F
MDAEAGEAGVQQPAGAASTSTAAVPFDRSSSRLGAPGAESFNGALRELRDPAVSAARSGGLLRQGVSSAPTRKR

SEQ ID NO: 42797 - DNA, 619 bp, Zea mays
  misc_feature: Ceres CLONE 1441797-F
  misc_feature: Encodes the peptide sequence at SEQ ID NO. 42798
  misc_feature (619)..(619): n is a, c, t, g, unknown, or other
tggagctccccgcggtggcggccgctctagaactagtggatcccccgggctgcaggaattcgcacgagaccattacctagaacatcctaatcgaaaaaatcaaaaatcaaccgaacttgccagccccgccgcccctccctgcctccatcgcgcactagggtttttcctcgctctcacgttcggccgttccccaccacttgcgcgttgtgccgcgacgctccggccatggcgtggggggaggacgaggccatcggtcccgacgtggcctcggcgggtcttcacgtctcggagcggatcggccgcgacgccgccgcgcagcccgacctggaggaggcccttgaagcctcgcgctacgcgtcccacccctactcctcgcaccccaaggaggcaagccctgcgcgacctgtggtcagctgcgtgtgtactgatagacgcgcacgcttgagttgttgatgtgtcagtgtccggtttgggcgaatgttaccgttgtattcagggttcctgcagttgtcctgggggattcgtgtcattgtttttcccagtagaatgggggtgacgaggaatcgaaagatgaaggtgggagaaaacatggcgagcagtgatttcatctgattatttn

SEQ ID NO: 42798 - protein, 75 aa, Zea mays
  misc_feature: Ceres CLONE 1441797-F
MAWGEDEAIGPDVASAGLHVSERIGRDAAAQPDLEEALEASRYASHPYSSHPKEASPARPVVSCVCTDRRARLSC

SEQ ID NO: 42799 - DNA, 845 bp, Zea mays
  misc_feature: Ceres CLONE 1441801-F
  misc_feature (68)..(68): n is a, c, t, g, unknown, or other
gggcggtttgcggccgcggggccgcgggggacgaggatggggggggggggggcgcggggcccccgtgntggttagccccctaaaactggtgctccaccgcggtggcggccgctctatactagtggatcccccgggctgcaggaattcgcacgagaccattacctagaacatcctaatcgaaaagaccgatctgtccgatctctctgccgagccagcccactccaagttttcccgccctttcgtccgcttgcgagggagggggccggcggggcgcgatctattcgtgctggccgctcgcttcctctccctctcggggggggccgcctccttccattcgaacgagttccccctgaagaataacaaatagagggagggcgggggtggcccgtccgtccgctccctgccggcgggcgggcccgggtggctttcccccctcccgacatcaaaggaacgggacgcgccgccgggcccgggggcagggcccagtcccaacggcaaggtcaatgcctccgagcgaggaaccaaccctgtggccgaacaggcgaagtggcctctccccccctgggcaggggaaacccttgggccgcgccccgcccctacaagaatccttcccagcggcggcggggcagtgaccggaccgccctccaacgagaggggtggcgggctgaggcacaggggaagggaacctggaaccgggaaggaaagagaggaggagcgcgggcgaaacaaaaaaagccgtggccgcgcagaggaaagggaagtggccatcaccaataccaagacgcggcgcccggcccacaacggggggtgggggtggcggacaccgcaccgagagcgtggcgcgg

SEQ ID NO: 42800 - DNA, 600 bp, Zea mays
  misc_feature: Ceres CLONE 1441804-F
  misc_feature: Encodes the peptide sequence at SEQ ID NO. 42801
ccccgcggtggcggccgctctagaactagtggatcccccgggctgcaggaattcgcacgagaccattacctagaacatcctaatcgaaaaacagctccaggccacgagaccgtccagcgcgcgggcaggcgcgccgctaaactaaacccgaccaaatgccgcctctcctcacctcctcctccgtaccggcgctgccgctggccgcgtggtccaggtaccgcctcagggttgcggcttccaacgccgcctccgccccggacggggccggcgccactgccagatgcaccagcaccggcgggttcccgtccttccttcccggggcggcggagcgcatccgcgacggcgctgccatccgcctggccaagcgaatcgagcgcgtgcccgtccagaccagtttctcgggtagcgcgatatcgagcagctgtgtgaggccgctcaagcagcaacaggacggtgaccgggtcgtgctgcttcatggattccaccgttctgttctaaaatggagatacacctacccattggtcgaagaaggccggatttgaagccttggcctgtggaacatccttgggggggggcttccctgaattggaaaaaccggcc

SEQ ID NO: 42801 - protein, 128 aa, Zea mays
  misc_feature: Ceres CLONE 1441804-F
MPPLLTSSSVPALPLAAWSRYRLRVAASNAASAPDGAGATARCTSTGGFPSFLPGAAERIRDGAAIRLAKRIERVPVQTSFSGSAISSSCVRPLKQQQDGDRVVLLHGFHRSVLKWRYTYPLVEEGRI

SEQ ID NO: 42802 - DNA, 633 bp, Zea mays
  misc_feature: Ceres CLONE 1441805-F
  misc_feature: Encodes the peptide sequence at SEQ ID NO. 42803
ggagctccccgcggtggcggccgctctatacctagtggatcccccgggctgcaggaattcgcacgagaccattacctagaacatcctaatcgaaaaattggaagcgcaaatgtctgctccgcctcgtcgcccctgcacggattactggtttcttatatggaaaaagtggaggaattaattgtggagtcgggtggtgagatctgattttagattggttgattagcccggttggtagaagcagtcggtggtggtggtggtggtgcactgcttctacctcccctgcatctctgctcgggtgtgtgtgaagcgcgggctctatataagtacgactcagatctgagacgatgccacctcgtccgccccagtctagtccgattcaaacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaac

SEQ ID NO: 42803 - protein, 57 aa, Zea mays
  misc_feature: Ceres CLONE 1441805-F
  misc_feature (36)..(55): SWISSPROT Homolog: EC 4.1.1.35 UDP-glucuronate decarboxylase
  misc_feature (35)..(56): SWISSPROT Homolog: EC 5.1.3.2 UDP-glucose 4-epimerase
MAQKETNGSNGEHISTRPPPTPSPLRFSKFFQANLRILVTGGAGFIGSHLVDRLMEN

SEQ ID NO: 42804 - DNA, 674 bp, Zea mays
  misc_feature: Ceres CLONE 1441808-F
  misc_feature: Encodes the peptide sequence at SEQ ID NO. 42805
aaagctggagctccccgcggtggcggccgctctagaactagtggatcccccgggctgcaggaattcgcacgagaccattacctagaacatcctaatcgaaaagtgctctctcagaggtgggctggcttctcctccccctcttatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggcggcggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctaccgcggcggcggcggcggctggagggactgatgtg

SEQ ID NO: 42805 - protein, 159 aa, Zea mays
  misc_feature: Ceres CLONE 1441808-F
  misc_feature (10)..(81): Pfam Name: RRM_1 Pfam Description: RNA recognition motif. (a.k.a. RRM, RBD, or RNP domain)
  misc_feature (48)..(154): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGGGYGGGRGGGGYGGGRRDGGYGGGGGYGGRREGGGGGYGGGGGYGGRREGGGGGYRGGGGGWRD

SEQ ID NO: 42806 - DNA, 664 bp, Zea mays
  misc_feature: Ceres CLONE 1441811-F
  misc_feature: Encodes the peptide sequence at SEQ ID NO. 42807
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctc

SEQ ID NO: 42807 - protein, 35 aa, Zea mays; identical to SEQ ID NO: 36216
  misc_feature: Ceres CLONE 1441811-F

SEQ ID NO: 42808 - DNA, 663 bp, Zea mays
  misc_feature: Ceres CLONE 1441812-F
  misc_feature (443)..(443): n is a, c, t, g, unknown, or other
aaagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgncgttcgcgtgcaacgcccacgcgccgcgagcgtccacgtgccaggcgctcgtctcctacgcgccgccaacggggacgccacgcccacgctggccgccgtgcgggcgctcttcagttccgcttccaacgggggttggtgggcggcaaagggctcccgttcctcaagccgcccagggggcccgcgccggggccgttgcgggtccccctgccctgccttggtc

SEQ ID NO: 42809 - DNA, 653 bp, Zea mays
  misc_feature: Ceres CLONE 1441814-F
  misc_feature: Encodes the peptide sequence at SEQ ID NO. 42810
ctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgaacgttctttcggcgtgtcacgatctccggtc

SEQ ID NO: 42810 - protein, 35 aa, Zea mays; identical to SEQ ID NO: 36216
  misc_feature: Ceres CLONE 1441814-F

SEQ ID NO: 42811 - DNA, 664 bp, Zea mays
  misc_feature: Ceres CLONE 1441828-F
  misc_feature: Encodes the peptide sequence at SEQ ID NO. 42812
  misc_feature (447)..(447): n is a, c, t, g, unknown, or other
  misc_feature (453)..(453): n is a, c, t, g, unknown, or other
  misc_feature (462)..(462): n is a, c, t, g, unknown, or other
caaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgnccgtgnttcctgatnctcagccccgtgctggtcccccgcgcgctgctcatcgggacggccgtcatgggggtcctcacgtcgggccccctggggctcgggggcctgtcctccctcaagtggcttgccaacacgggcggggaggggttccaccccaacccggaatacggtgaagaaggcccccccccaggatggcgaaaggcccggcccaacccggcca

SEQ ID NO: 42812 - protein, 136 aa, Zea mays
  misc_feature: Ceres CLONE 1441828-F
  misc_feature (81)..(81): Xaa is any aa, unknown, or other
  misc_feature (83)..(83): Xaa is any aa, unknown, or other
  misc_feature (86)..(86): Xaa is any aa, unknown, or other
MADRDRSGIYGGAHATYGQQQQQGGGGRPMGEQVKGMLHDKGPTASQALTVATLFPLGGLLLVLSGLALTASVVGLAVATXVXPDXQPRAGPPRAAHRDGRHGGPHVGPPGARGPVLPQVACQHGRGGVPPQPGIR

SEQ ID NO: 42813 - DNA, 656 bp, Zea mays
  misc_feature: Ceres CLONE 1441832-F
  misc_feature: Encodes the peptide sequence at SEQ ID NO. 42814
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctcacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggc

SEQ ID NO: 42814 - protein, 142 aa, Zea mays; identical to SEQ ID NO: 41418
  misc_feature: Ceres CLONE 1441832-F
  misc_feature (9)..(98): Pfam Name: MtN3_slv Pfam Description: MtN3/saliva family

SEQ ID NO: 42815 - DNA, 668 bp, Zea mays
  misc_feature: Ceres CLONE 1441837-F
  misc_feature: Translation starting site: 303
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccaccctcggcgtccgcggctcctagccgggccgccctgagccgccgccgcgccgcaccgtcgc

SEQ ID NO: 42816 - DNA, 660 bp, Zea mays
  misc_feature: Ceres CLONE 1441843-F
  misc_feature: Encodes the peptide sequence at SEQ ID NO. 42817
  misc_feature (415)..(415): n is a, c, t, g, unknown, or other
  misc_feature (488)..(488): n is a, c, t, g, unknown, or other
ggagctccccgcggtggcggccgctctagaactagtggatcccccgggctgcaggaattcgcacgagaccattacctagaacatcctaatcgaaaagtacgtctccgtcgagatggccgccccgctccggcggagcctcccctcccttggccgcgcgcttctcacgccggcgccggcgcggatgctctccgcggaggcctctgatgccctcgttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatgggatggacatctactggggatccatatgcntatgtcggtgaagcaggactttacgttgacagtgcaaagtcagcaaaggcgtttgccgaaaaacatggatggnaattatgtggttcggaaccgcatgccacttcttctggagcctaaggcctacgctgagaacttcaggtggaagggccctccaaaacggaccaagccttgacctccgaacctctgggaatgctaacattggcccaaagggccttttcccccccggccccaattttttttgccct

SEQ ID NO: 42817 - protein, 139 aa, Zea mays
  misc_feature: Ceres CLONE 1441843-F
  misc_feature (54)..(140): Pfam Name: ETC_C1_NDUFA4 Pfam Description: ETC complex I subunit conserved region
  misc_feature (126)..(126): Xaa is any aa, unknown, or other
MAAPLRRSLPSLGRALLTPAPARMLSAEASDALVEIKPGEIGMVSGIPEEHLRRKVLIYSPARTASQQGSGKVGRWKINFLSTQKWENPLMGWTSTGDPYAYVGEAGLYVDSAKSAKAFAEKHGWXLCGSEPHATSSGA

SEQ ID NO: 42818 - DNA, 662 bp, Zea mays
  misc_feature: Ceres CLONE 1441844-F
  misc_feature: Encodes the peptide sequence at SEQ ID NO. 42819
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaa

SEQ ID NO: 42819 - protein, 144 aa, Zea mays
  misc_feature: Ceres CLONE 1441844-F
  misc_feature (49)..(144): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGG

SEQ ID NO: 42820 - DNA, 639 bp, Zea mays
  misc_feature: Ceres CLONE 1441845-F
  misc_feature: Encodes the peptide sequence at SEQ ID NO. 42821
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaaccattcctttctctccctctcgccgtcgtcgccacctccacttggccccgctcatcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgtttggagcggatggcgcaagatgcatgtctgcgagggcgccggcggtcaaggggtccgggcatctcgtcccgcagggcaccggagggaggtcttctgtgagtggaattgtagcccacgtgtttgagctactgggtttctgggcgctatctgtgcnacactggcaagatggggtctcagtgcttgtccattcagaggttgtgagattctcctcgcacctgaaaatagggtgacttgggtcaatggggccctgaaatccttccagaagagttattccattaaggctttttgccaacccaagtgggttttaacccccagga

SEQ ID NO: 42821 - protein, 115 aa, Zea mays
  misc_feature: Ceres CLONE 1441845-F
  misc_feature (91)..(91): Xaa is any aa, unknown, or other
MQSAAWRRHLLDHHLSPSTSAAIAAFRSASQPGLAPQGLFGADGARCMSARAPAVKGSGHLVPQGTGGRSSVSGIVAHVFELLGFWALSVXHWQDGVSVLVHSEVVRFSSHLKIG

SEQ ID NO: 42822 - DNA, 655 bp, Zea mays
  misc_feature: Ceres CLONE 1441863-F
  misc_feature: Encodes the peptide sequence at SEQ ID NO. 42823
ggactccccgcggtggcggccgctctagaatagtggatcccccgggctgcaggaattcgcacgagaccattacctagaacatcctaatcaaaaaatgctgcctacccatacatgcatctatgcttagcttctttgcttagacgcagatttctcctgataaaaagatctaagccatgaaggggtttccagctgctactaatcataatgttattgcttgccagggagttgcactgcgaaataccagcataactagcagatgcaccgaacgctacaccacagtcccccaaaaaagcaacacaacatgagcaaacctccccgcacgcctctgagccaacattaccacctcaacttccacgccatcgggaattaccatattcacagccacacaaaccgatggtatcaccaagatcatcaccgccaaggacgacgtgcctcccagtaacatcctgcgctggacacccttggaatgacgatcaaccgcactacggtgtgaactacactccttgaaattggatactcaaccgtggacgctacaaaacacatacatatgcccaccactaccagggcaaatttcttgtcctacagcttaaagttctatagtcgtacgtcgactgcgagattcacccatggtcgctgatactcacatctgaacctg

SEQ ID NO: 42823 - protein, 29 aa, Zea mays
  misc_feature: Ceres CLONE 1441863-F
MPTTTRANFLSYSLKFYSRTSTARFTHGR

SEQ ID NO: 42824 - DNA, 646 bp, Zea mays
  misc_feature: Ceres CLONE 1441864-F
  misc_feature: Encodes the peptide sequence at SEQ ID NO. 42825
tcaccgcggtggcggccgctctagaactagtggatcccccgggctgcaggaattcgcacgagaccattacctagaacatcctaatcgaaaaatatgcgtattaggctgttcacgcacgcgacggtggagccgttcatcatcgccaccaagaggcagatgagcgccatgcacccgatccacaagctgctggagccgcacttcaaggacaacatgcagatcaacacgctggccaggagcatcctgctgagcgcgggcggcatcctggagaggaccatgtacccggggaagtacgccatggagatgtcctcggccatctactccgagtggaggttcacggagcagtccctgcccaacgagctcgtcaagaggggcatggcgtccaagatgggcggcggcgccatcgccctgcacgtggaggactacccgtacgcggtggacggcatggacgtgtggcgcgccatcgagggctgggtcaggacctactgcgcccacttctaccactccgacgccgcggtggccgccgacgcggagctgcaggcgtggtgggacgacgtccgccgcgtcggccacggcgaccgccagcgcgacccggcgtgctggctggacctcgactccgtggccaacctcgccgagtcgctgtccacgc

SEQ ID NO: 42825 - protein, 184 aa, Zea mays
  misc_feature: Ceres CLONE 1441864-F
  misc_feature (1)..(183): Pfam Name: Lipoxygenase Pfam Description: Lipoxygenase
  misc_feature: SWISSPROT Homolog: EC 1.13.11.12 Lipoxygenase
MRIRLFTHATVEPFIIATKRQMSAMHPIHKLLEPHFKDNMQINTLARSILLSAGGILERTMYPGKYAMEMSSAIYSEWRFTEQSLPNELVKRGMASKMGGGAIALHVEDYPYAVDGMDVWRAIEGWVRTYCAHFYHSDAAVAADAELQAWWDDVRRVGHGDRQRDPACWLDLDSVANLAESLST

SEQ ID NO: 42826 - DNA, 655 bp, Zea mays
  misc_feature: Ceres CLONE 1441865-F
  misc_feature: Encodes the peptide sequence at SEQ ID NO. 42827
aaagctggagctccccgcggtggcggccgctctagaactagtggatcccccgggctgcaggaattcgcacgagaccattacctagaacatcctaatcgaaaaacatctacccacccatctcctctccctcgttcaccagacagtccgccactcctttagtaccttgtgatttgtacgtctacgacatcactggtcttctggtcgactaccacacatgttgtaacgctatcgtgggtgcatcatgtcgggcgttcctcctgctcgccggcgtgctgatggtcttagcagccacggcctgggcgtacgacggattggtctaacgggaccccccggaggacctgcggtggtgcaagcatgcgtgcgattggccttacggaaaggacaccccgcggaaaagggaatgccacagcgagtgccgcgagcggcaccagccttctgacgcggacgaggacggcgactgcgatctggactcctacatctcccgctacgggaggagcgagtgccggctccagtgcctgcaccaccacgacggccacccgtgttacacccagaagtgcatgaggcgatgtctccgccgcggactggccgtctacatgtatcatgagtacggtctcggcaacaatagcgcgttcaagtgccaggagacgtgctatcg

SEQ ID NO: 42827 - protein, 32 aa, Zea mays
  misc_feature: Ceres CLONE 1441865-F
MRRCLRRGLAVYMYHEYGLGNNSAFKCQETCY

SEQ ID NO: 42828 - DNA, 636 bp, Zea mays
  misc_feature: Ceres CLONE 1441879-F
  misc_feature: Encodes the peptide sequence at SEQ ID NO. 42829
  misc_feature (622)..(622): n is a, c, t, g, unknown, or other
  misc_feature (636)..(636): n is a, c, t, g, unknown, or other
aagctggagctccccgcggtggcggccgctctagaactagtggatcccccgggctgcaggaattcgcacgagaccattacctagaacatcctaatcgaaaaaccaaatcactcccaccgtgtccacggcaaccagcacacttttccctttggcggatcgaaggaaggaaggaggacatgggtggcggcatggaggggcacaaaaaccggtggatcgaagagtggaacgccggccgcgagaacctcgagttcaatttccgctggacccgccgcagcctcgccgtcgtcggcctcttcggcctcgctggccccatcctcgtctacaagggcatcgcccgcgaattcccaatccactatagcgagcccctcttgtcgtgccactgtccctttcccctttctccaaacccgaagataaattttctgtttgttcctgctggggtggatccagcatatgcaggaccaggatgcacgccggccatacaggaagttcctgtaagcggcgtccatggctgcaagacacgtccatccctcgaccgaggctgcgaggaggggagtttccattcacactgcgtcggtattgttttagtctgactctgacggagcagtttgcaatgctgaactantggcgcgtgatcan

SEQ ID NO: 42829 - protein, 137 aa, Zea mays
  misc_feature: Ceres CLONE 1441879-F
MGGGMEGHKNRWIEEWNAGRENLEFNFRWTRRSLAVVGLFGLAGPILVYKGIAREFPIHYSEPLLSCHCPFPLSPNPKINFLFVPAGVDPAYAGPGCTPAIQEVPVSGVHGCKTRPSLDRGCEEGSFHSHCVGIVLV

SEQ ID NO: 42830 - DNA, 659 bp, Zea mays
  misc_feature: Ceres CLONE 1441887-F
  misc_feature: Encodes the peptide sequence at SEQ ID NO. 42831
aaagctggagctccccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcaatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctaagggatcgccgtctactactgccgcgcgctcgcactccc

SEQ ID NO: 42831 - protein, 110 aa, Zea mays
  misc_feature: Ceres CLONE 1441887-F
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADS

SEQ ID NO: 42832 - DNA, 630 bp, Zea mays
  misc_feature: Ceres CLONE 1441901-F
  misc_feature: Encodes the peptide sequence at SEQ ID NO. 42833
tggagctccccgcggtggcggccgctctagaactagtggatcccccgggctgcaggaattcgcacgagaccattacctagaacatcctaatcgaaaagcatcacacagcttgcaaggcgccccatctctcaaaccatccgaacccccctcgccgctcactcccaagctaatccccgccggcagcgatggcccgcacgaagcagacggcgcgcaagtcgacgggcggcaaggcgccgcggaagcagctggcgacgaaggcggcgcgcaagtcggcgccggccacggggggcgtgaagaagccgcaccggttccgcccgggcaccgtggcgctgcgggagatccgcaagtaccagaagagcacggagctgctgatccggaagctgccgttccagcggctggtgcgggagatcgcgcaggacttcaagacggacctccggttccagtcctccgccgtggccgcgctgcaggaggccgccgaggcctacctcgtgggcctcttcgaggacaccaacctctgcgccatccacgccaagcgcgtcaccatcatgcccaaggacatccagctcgcgcgccgcatccggggcgagagggcctgagcacccccccgtctctgctgcgcttccttcgctt

SEQ ID NO: 42833 - protein, 136 aa, Zea mays; identical to SEQ ID NO: 6923
  misc_feature: Ceres CLONE 1441901-F
  misc_feature (58)..(132): Pfam Name: Histone Pfam Description: Core histone H2A/H2B/H3/H4

SEQ ID NO: 42834 - DNA, 644 bp, Zea mays
  misc_feature: Ceres CLONE 1441903-F
  misc_feature: Encodes the peptide sequence at SEQ ID NO. 42835
acaagctggagctccccgcggtggcggccgctctagaactagtggatcccccgggctgcaggaattcgcacgagaccattacctagaacatcctaatcgaaaaaccagtcccgccaccaccaccctctgtcttcgcctccgctgccgattcgaaagcacccgtcctgtcccctcgcaaaaccctagctccagccaccatgaagagcaaggctgacacctcctagaaggacgagggcaggctccgggcgggcggcaccgccggaaaccacaagaaggccgccggcgagcggcaagcccaagcgcccgccctccgccttcttcgtcttcgtgtcagaattcaggcaggagtatcatgcgctgcaccctggcaacaacagcgttgccaccgtgagcaacgaaccatggcaaaagtggcgtgctatgtcagatcaagagaatccaccatatgtggaccaagctggacagaataagctggactatgagaagactcaggcaaactttgataagaaagatagcacaagctcaaagaaggctaagactgacgatgatgatggctctaagtcagaggttgataacgaggatggcagcagtgaccaggaaaaccatcaccatgagtaaacagtctccaaggtcacgaggtagca

SEQ ID NO: 42835 - protein, 65 aa, Zea mays
  misc_feature: Ceres CLONE 1441903-F
MSDQENPPYVDQAGQNKLDYEKTQANFDKKDSTSSKKAKTDDDDGSKSEVDNEDGSSDQENHHHE

SEQ ID NO: 42836 - DNA, 658 bp, Zea mays
  misc_feature: Ceres CLONE 1441904-F
  misc_feature: Encodes the peptide sequence at SEQ ID NO. 42837
aaagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcaaccagatcactggtcgggtggaggacgacgacacatggggaaggggagggtgggtgcatcatggtgggcgttcctcctgctcgccggcgtgctgctggtcgtaacacccacggccggggcggacgacggactggtctaacgggaccgcaaggaggacctgccgtggtgcaagcaggcgtgcgagtggcagtaccgaaaggacacccctcggaagagggaatgcgagagcgagtgccgctagcggcaccatcaagctgacgcgggcaaggacggctacagcggcgtggacgcctacgtctcccgctccgggaggggcgagtgccggcgccagtgcctgcgccgccacgagggccagccgtgggagacccatgagtgcatgaagcggtgccgccgccgcggactggccgtccacatggagcaagactacggtcgcggcagctagagcgcgggcaagtgccgggagaggtgcgagcgccacca

SEQ ID NO: 42837 - protein, 34 aa, Zea mays
  misc_feature: Ceres CLONE 1441904-F
MGKGRVGASWWAFLLLAGVLLVVTPTAGADDGLV

SEQ ID NO: 42838 - DNA, 641 bp, Zea mays
  misc_feature: Ceres CLONE 1441913-F
  misc_feature: Encodes the peptide sequence at SEQ ID NO. 42839
ggagctcaccgcggtggcggccgctctagaactagtggatcccccgggctgcaggaattcgcacgagaccattacctagaacatcctaatcgaaaaatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacgtactatccgtcagaggctctcaagcataatggctctttgtatgctcatgtttacttcgcccgttcgggttatcctgtggaccctacagatccagaatatgagcagaaat

SEQ ID NO: 42839 - protein, 150 aa, Zea mays
  misc_feature: Ceres CLONE 1441913-F
MSQPAATVAAAAQPQGRGPAGRQGGLGQSIAGIVRMAVFWYFASKFFGPKRPPADPGMLMSNLFQKGEPMDMWMYLSENEKFNDFANEDALIWHEANIPYAVWGPTSTRTRSLTYYPSEALKHNGSLYAHVYFARSGYPVDPTDPEYEQK

SEQ ID NO: 42840 - DNA, 649 bp, Zea mays
  misc_feature: Ceres CLONE 1441920-F
  misc_feature: Encodes the peptide sequence at SEQ ID NO. 42841
  misc_feature (604)..(604): n is a, c, t, g, unknown, or other
  misc_feature (616)..(616): n is a, c, t, g, unknown, or other
aagctggagctccccgcggtggcggccgctctagaactagtggatcccccgggctgcaggaattcgcacgagaccattacctagaacatcctaatcgaaaacttttttcaacttcgtcgaaaccctaaccctcccggcgaagtcgccatgtcgaacccgaagggctccaagatgctccagttcatcaactaccgcatgagggtgacgatccaggacggccgccagctcgtgggcaagttcatggcgttcgaccgccacatgaacctcgtcctcggcgactgcgaggagttccgccgcctcccgccctccaagtcctccaaggccaccggcgaacgcgaggagcgccgcacgctcggcctcctcctgctccgcggcgaggaggtcgtctcctgaaccgtcgagggcccgccgccgcccgacgagtcgcgcgccaaggccgcggcggcgggcggagccctcgccggccctggcgtcggccgcgccgctggcccgcgcgtgcccaccggcccgctgctccaggcagctccaggccttgctggccctgtgcggggcgtgggtggacccgcccccgcatgatgcagccccagatctcgcgcccgcgatngcccacctgtcngcccagccgtgtcctacccgcagtcgtgccgcc

SEQ ID NO: 42841 - protein, 81 aa, Zea mays
  misc_feature: Ceres CLONE 1441920-F
  misc_feature (7)..(82): Pfam Name: LSM Pfam Description: LSM domain
MSNPKGSKMLQFINYRMRVTIQDGRQLVGKFMAFDRHMNLVLGDCEEFRRLPPSKSSKATGEREERRTLGLLLLRGEEVVS

SEQ ID NO: 42842 - DNA, 654 bp, Zea mays
  misc_feature: Ceres CLONE 1441921-F
  misc_feature: Encodes the peptide sequence at SEQ ID NO. 42843
  misc_feature (654)..(654): n is a, c, t, g, unknown, or other
aagctggagctccccgcggtggcggccgctctagaactagtggatcccccgggctgcaggaattcgcacgagaccattacctagaacatcctaatctaaaaaaaaaactagcgcttactgttttgcacggccatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacgatgaggtcgaagaagacgagggaagcatggacgacggcagcgccgaagaggatgatgccgagctgtccgacggaggggctctcggctcgccgcggcgacgcgccttctccgctccaggtgaaccaagggtttgcgcagaggctttcaggtattggacgtatggagataaatgggggaaatggagtgaggtcaatccaagaggggcagcaatggcatttatgtaaccatggaatcgagattgggcgtccatcacccagaggggatgaacctggtaccatccccagagan

SEQ ID NO: 42843 - protein, 95 aa, Zea mays
  misc_feature: Ceres CLONE 1441921-F
  misc_feature: SWISSPROT Homolog: EC 2.1.1.33 tRNA (guanine-N(7)-)-methyltransferase
MRSKKTREAWTTAAPKRMMPSCPTEGLSARRGDAPSPLQVNQGFAQRLSGIGRMEINGGNGVRSIQEGQQWHLCNHGIEIGRPSPRGDEPGTIPR

SEQ ID NO: 42844 - DNA, 600 bp, Zea mays
  misc_feature: Ceres CLONE 1441924-F
  misc_feature: Encodes the peptide sequence at SEQ ID NO. 42845
  misc_feature (446)..(446): n is a, c, t, g, unknown, or other
aagctggagctccccgcggtggcggccgctctagaactagtggatcccccgggctgcaggaattcgcacgagaccattacctagaacatcctaatcgaaaaatctggcctcaagcccctcaggcctcagctcaccaccacgaaccaaccgacagaaagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccaattatgaggaagatagccgacaaggttgcttcgtcagggtactttgttgtggtaccagatttgtttcatggggatccttatgcacctgagaatgttgagaagccactttcctgtngctggataaaagtcacatactccgggaaaaaaagggtttaaaaaaccaaacacagtttttggggcccctaaaagaaaaaaggaaggttcctttttaacccccgggattccggggggcaaggggtgttgggatggcaaacccttggaacccgctc

SEQ ID NO: 42845 - protein, 106 aa, Zea mays
  misc_feature: Ceres CLONE 1441924-F
  misc_feature: SWISSPROT Homolog: EC 3.1.1.45 Carboxymethylenebutenolidase
  misc_feature (94)..(94): Xaa is any aa, unknown, or other
MASSQCCDNPPALNPACGEGKVVDSFGGLKAYVAGPEDSKAAVVLVADVFGFEAPIMRKIADKVASSGYFVVVPDLFHGDPYAPENVEKPLSCXWIKVTYSGKKRV

SEQ ID NO: 42846 - DNA, 646 bp, Zea mays
  misc_feature: Ceres CLONE 1441943-F
  misc_feature: Encodes the peptide sequence at SEQ ID NO. 42847
aagctggagctccccgcggtggcggccgctctagaactagtggatcccccgggctgcaggaattcgcacgagaccattacctagaacatcctaatcgaaaaaatgactaccgacgacgcacgcggatatcccgcctactgcagattttgaaaactgaactgaaagatggcctcggcacagctttcccgtgaggaaaatgtgtacgtggcgaagctcggttaccacgcggagaggtaccaggagacggttgagttcatggaaaaagtacccaagactgttgactctgaggacctcactgaggacgagcgaaacctcttgtccgttcgatacaaaaacgtacattgcccccggcgcgccctcatggcgcattatctcctccatcgggcagaaggaggaccgccgaggcaatgaggacccagtaactctcctcaaggattatcgtggccagattgaccctgacctgcaccggatctgtgatcgcatcctcaagctgcttgagacccatcttgtgccgtcttccactgcccccgagtccaacgtcttctatctcacgattaagggtgattactacagataccttgctgagttcaacactggagcggagagaaacgacaccgctgaagacactatggtggcatacaaggct

SEQ ID NO: 42847 - protein, 150 aa, Zea mays
  misc_feature: Ceres CLONE 1441943-F
MCTWRSSVTTRRGTRRRLSSWKKYPRLLTLRTSLRTSETSCPFDTKTYIAPGAPSWRIISSIGQKEDRRGNEDPVTLLKDYRGQIDPDLHRICDRILKLLETHLVPSSTAPESNVFYLTIKGDYYRYLAEFNTGAERNDTAEDTMVAYKA

SEQ ID NO: 42848 - DNA, 629 bp, Zea mays
  misc_feature: Ceres CLONE 1441958-F
  misc_feature: Encodes the peptide sequence at SEQ ID NO. 42849
tggagctccccgcggtggcggccgctctagaactagtggatcccccgggctgcaggaattcgcacgagaccattacctagaacatcctaatcgaaaaccaagaagaaaggagcatagaacataagaggagagaccgcactacacacctcacgcctgaagttcagatctaagccttctcgtcctcgcccaaggacaacgataaacatctaagaaccaaacaaaaacagagcacgaccatcggtctctaagcaaaacgcgcagcacgccgggcgctccacgcacgtaggctagcagagcgcgcatggggcttctggaccagctgtgggacgacacggtggccgggccgcgcccggactccggcctcggcaagctccgcaagcacgcgtccttctccccctcgtcggccgcgccgtcgccgaccgcggagggcgcggcgccgcccgccgtgacgcggagcatcaccatgctgcggccggcggcgctgtccgtcgccacgtcgccgcgcagcgagtccagctccgcgccgtcgtcgccgtcgcccgcaagcggcgctccggactcgcccttcggcgcagcgacgacgcccaggggagagggctggaagaagctgcgccggaaaggcaggatgg

SEQ ID NO: 42849 - protein, 109 aa, Zea mays
  misc_feature: Ceres CLONE 1441958-F
  misc_feature (7)..(108): Pfam Name: Auxin_repressed Pfam Description: Dormancy/auxin associated protein
MGLLDQLWDDTVAGPRPDSGLGKLRKHASFSPSSAAPSPTAEGAAPPAVTRSITMLRPAALSVATSPRSESSSAPSSPSPASGAPDSPFGAATTPRGEGWKKLRRKGRM

SEQ ID NO: 42850 - DNA, 621 bp, Zea mays
  misc_feature: Ceres CLONE 1441960-F
  misc_feature (621)..(621): n is a, c, t, g, unknown, or other
ggagctccccgcggtggcggccgctctagaactagtggatcccccgggctgcaggaattcgcacgagaccattacctagaacatcctaatcgaaaaacgatatccacgtctgcgcaaatgattctaatcactcgattgccaatcaacggcccacgttggtcgactttcatcgcctcttccctcaaattctctgaaataggaatcgtctcgactcgctccctcgtttctttcgcctccgaacacttctgctcgaaccttgtctcccgtcgcctctcttcgttcccgtcgtagcgtccctcttccacctcttctctccccgcttccttgtctaaatcgattcatcacccattgctttcgtccttactgcagtgtccattttggttgtttggtgaaatttgtcgctatcttcgtcgactctagttcgtcgtccatttcttaaagttcaaataggcctgctttgtccccttttttctcccgtcccgaggtacgcgattgcagcagatccggcttcctccgcttcagatctccttcaatcgtcgtcttccacttcgcgtttccctctccgtactcatatggctttgtctgcatgaatgctttactggtcgcgaagccctttgtttn

SEQ ID NO: 42851 - DNA, 607 bp, Zea mays
  misc_feature: Ceres CLONE 1441963-F
  misc_feature: Encodes the peptide sequence at SEQ ID NO. 42852
  misc_feature (527)..(527): n is a, c, t, g, unknown, or other
  misc_feature (531)..(531): n is a, c, t, g, unknown, or other
tggagctccccgcggtggcggccgctctagaactagtggatcccccgggctgcaggaattcgcacgagaccattacctagaacatcctaatcgaaaaattttcgagctcaagctcaatcacttcggattggcggcgggcacgcgccggacgaaatggaagcggcaccatccgcccgcgccttctccccgtcctcgtctccctccgcgggggctagacccagccttcccctcgcgggcctggcctcgcgctcgcggcgcgcccgggtgctcgcggcgccgcccccgccccgcgccgtcgcctcctcccgcgcgccgctggtggtctccagcccgccaccgccggaggactccggcacgcacaaccccgcgcacgccaaggtcgaccgctccggccgcttctgcagcccccgcgccgcacgggaactcgcgctgatgatttccctacgcgcgtgtctggaggaacccgatgtcgtccggctcttcgatcgcaggatcagcgcaagacgagaaccccgggtttgttttcnacanggcatgccctatgagttacaaccatatgagcttttgcgggggaccccctcgaggttggaccgaggaggaagctaaa

SEQ ID NO: 42852 - protein, 150 aa, Zea mays
  misc_feature: Ceres CLONE 1441963-F
  misc_feature (125)..(125): Xaa is any aa, unknown, or other
  misc_feature (126)..(126): Xaa is any aa, unknown, or other
MEAAPSARAFSPSSSPSAGARPSLPLAGLASRSRRARVLAAPPPPRAVASSRAPLVVSSPPPPEDSGTHNPAHAKVDRSGRFCSPRAARELALMISLRACLEEPDVVRLFDRRISARREPRVCFXXGMPYELQPYELLRGTPSRLDRGGS

SEQ ID NO: 42853 - DNA, 606 bp, Zea mays
  misc_feature: Ceres CLONE 1441965-F
  misc_feature: Encodes the peptide sequence at SEQ ID NO. 42854
ggagctccccgcggtggcggccgctctagaactagtggatcccccgggctgcaggaattcgcacgagaccattacctagaacatcctaatcgaaaaacattcacatcgcactctcctccagcctccaggcttggcaagcgtgcttcaacatgaccacatccatgtcgaacagcgccgctagcgagaagcaagcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctcggcgagttcagggcgttccacgcgcgcggcggcggcggcgtggacgacgacgccgagctccgcgccgccttcgacgtctacgacgtcgacggcgacggccgcgtcacggcggccgagctgggcaaggtgctcgcgcgcatcggcgagggcggatgcagcgccgaggagtgcgagcggatggtcg

SEQ ID NO: 42854 - protein, 148 aa, Zea mays
  misc_feature: Ceres CLONE 1441965-F
  misc_feature (106)..(134): Pfam Name: efhand Pfam Description: EF hand
  misc_feature (29)..(57): Pfam Name: efhand Pfam Description: EF hand
  misc_feature (69)..(97): Pfam Name: efhand Pfam Description: EF hand
  misc_feature: SWISSPROT Homolog: EC 2.7.11.1 Non-specific serine/threonine protein kinase
MSNSAASEKQAQQAGHRQRPPAASAADAEMQRVFCRIDADGDGRISASELAAVTRAISPPASSSHGRREVAAMMDELDTDRDGFVDLGEFRAFHARGGGGVDDDAELRAAFDVYDVDGDGRVTAAELGKVLARIGEGGCSAEECERMV

SEQ ID NO: 42855 - DNA, 739 bp, Zea mays
  misc_feature: Ceres CLONE 1441966-F
  misc_feature: Encodes the peptide sequence at SEQ ID NO. 42856
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (16)..(16): n is a, c, t, g, unknown, or other
  misc_feature (17)..(17): n is a, c, t, g, unknown, or other
tgccttgttnnntggnngttgttgtttccccccacaatctcctccctccacccccttttccccttttttcccactagcaccgtctaagctggagctccccgcggtggcggccgctctatactagtggatcccccgggctgccggaattcgcacgagaccattacctagaacatcctaatcgaaaaattttacctcagtcaactaccaattttctcgcccagacatacagaattacagagtcgaagtgcgctgtggcctgtggactcccccctccccaactccggcgaagggagcagaaacgttggcgtgttggttgggtgccgtcggcctggacgaggcaatgaagaagaatgtggaggctacggtgctggagatcctccggggctccgatatggagtccgtgacggagtacaaggtccgcgccgctgccatcgaccgagtcggcatcgacttctccataccccgaccgcaagctcttcgccccgcgcgttgttgaggaattcctactttcaatcttctcccatgaggaggccaaggtggatgaggagggccttctctggcaggccgcaacaagggctagcaactcggaaccagcgaggactaaatatgcatgactgatgagcaagcgaggaatgtaaggtaaagggaggtccgcgcaagaagaagaaggcccggatgaacgcagggtggaagctttatgcctggcggaccgccctattccgaaggtcagctagggggg

SEQ ID NO: 42856 - protein, 51 aa, Zea mays
  misc_feature: Ceres CLONE 1441966-F
MKKNVEATVLEILRGSDMESVTEYKVRAAAIDRVGIDFSIPRPQALRPARC

SEQ ID NO: 42857 - DNA, 606 bp, Zea mays
  misc_feature: Ceres CLONE 1441968-F
  misc_feature: Encodes the peptide sequence at SEQ ID NO. 42858
tggagctccccgcggtggcggccgctctagaactagtggatcccccgggctgcaggaattcgcacgagaccattacctagaacatcctaatcgaaaaaagccggatgcatgccggcagctagtttcttctctgtcccttattccccactccaagtgtttgtctggtcagtaggtaagattacggatggggatccagcacctaccgcacctgggctggttttctagtctggaaggagagcaccatgacacgctcgtgctggaatatattgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggttgtggcagaagaagaaggttgatatcaagcagtagattttacatctagtttaccaagaattggacactgccttagctatgttttgaattcatgtcac

SEQ ID NO: 42858 - protein, 119 aa, Zea mays
  misc_feature: Ceres CLONE 1441968-F
  misc_feature (39)..(119): Pfam Name: Ribosomal_S21e Pfam Description: Ribosomal protein S21e
MGIQHLPHLGWFSSLEGEHHDTLVLEYIALAVVPPTVTMQNEEGKTVDLYVPRKCSATNRIITAKDHASVQINIGHLDANGLYDGHFTTFALSGFVRAQGDADSSLDRLWQKKKVDIKQ

SEQ ID NO: 42859 - DNA, 627 bp, Zea mays
  misc_feature: Ceres CLONE 1441972-F
  misc_feature: Encodes the peptide sequence at SEQ ID NO. 42860
acccgcggtggcggccgctctagaactagtggatcccccgggctgcaggaattcgcacgagaccattacctagaacatcctaatcgaaaaagattcggagcttcgggggaaaaaggcaggcacagtatcgtcgaacatgctgccaggtcgccacccggcgcgccgggccgacaccaccgggacggggccgctcctgccggacgccactcgcgcggtggtgtcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgtcgcatctctttcggccgtgccgcggtatactggctcgcgcagatgctcggcgccgtggtcgcgtcgttgctgctaacgctcgtctccggcggcacggtaattcgacttaatttcgccacgtgtccatgtcaaatactacagtactattttacgtttgattattataaataaaggttccagttaggcatacaaag

SEQ ID NO: 42860 - protein, 155 aa, Zea mays
  misc_feature: Ceres CLONE 1441972-F
  misc_feature (20)..(154): Pfam Name: MIP Pfam Description: Major intrinsic protein
MLPGRHPARRADTTGTGPLLPDATRAVVSEFVATAMFVFAAEGSVYGLWKLYKDTATPGGLLAVAIAHTLALVAAVAVASNASGGHVNPAVTFGLLVGRRISFGRAAVYWLAQMLGAVVASLLLTLVSGGTVIRLNFATCPCQILQYYFTFDYYK

SEQ ID NO: 42861 - DNA, 752 bp, Zea mays
  misc_feature: Ceres CLONE 1441974-F
  misc_feature: Encodes the peptide sequence at SEQ ID NO. 42862
  misc_feature (16)..(16): n is a, c, t, g, unknown, or other
  misc_feature (21)..(21): n is a, c, t, g, unknown, or other
atggatttgtaattancggtngacgttaactcaggccactggttatgtgttcacccgttgcgggtggagggggtttccattaactacctaacaggagctccacgcggtggcggccgctctagaactagtggatcccccgggctgcaggagttcgcacgagaccattacctagaacatcctaatcgaaaaaaattcaaaccaacgctaccgtgcaaccaaaccaaccaaccccattcctccgccggccgccggcagccgcccgcgatgtcgaaggccgcggcagcgtccctcccgccgccgccgccagaggtggcgcaccttgtggagcagctccagcgccaccacctcgccccggacgcgtccctcctctccagctccgcgcactccgacctcctccaggcgcgcgaggaggtcgcggcggagcgcgcgctgtacctccgaggcactggcggtgtacgcggaggcggtggccatggtggaggagtaccatgcggttgccggcgacgggaaaaagctcaactggctccccgcagggtgtacgaatctttggagcacccggttggccgtgggcaaaagcacccaccaagggcttagggttcccattggctcctctcagggaacgggggaggttccctgcagccagggaagatcggaaaaaaccctgaaaaccacccctattccctagaaaaggtctccattttccgataagaccacccccccttccacaaaagggtcggcgagaaccacctcat

SEQ ID NO: 42862 - protein, 109 aa, Zea mays
  misc_feature: Ceres CLONE 1441974-F
MSKAAAASLPPPPPEVAHLVEQLQRHHLAPDASLLSSSAHSDLLQAREEVAAERALYLRGTGGVRGGGGHGGGVPCGCRRREKAQLAPRRVYESLEHPVGRGQKHPPRA

SEQ ID NO: 42863 - DNA, 634 bp, Zea mays
  misc_feature: Ceres CLONE 1441976-F
  misc_feature: Encodes the peptide sequence at SEQ ID NO. 42864
ggagctccccgcggtggcggccgctctatacctagtggatcccccgggctgcaggaattcgcacgagaccattacctagaacatcctaatcgaaaaatataaacccaacctcgaagattcgtctctcccgaaaccctagctcacttaacgccgccgcggagctgctccgcgcccccgacgccggtgattaggagcaggagcaagaggggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattaaaagagattcatcaattggtactgaagtgttgtttttttgtcttgttgcctatctggagtttatttaactaaaatcatcagttgtgtccttgagaatcgggcacttaatgtatcaaaaaaaaaaaaaaaaaagcttatcgataccgtcg

SEQ ID NO: 42864 - protein, 60 aa, Zea mays; identical to SEQ ID NO: 195
  misc_feature: Ceres CLONE 1441976-F
  misc_feature (3)..(42): Pfam Name: Ribosomal_L29e Pfam Description: Ribosomal L29e protein family

SEQ ID NO: 42865 - DNA, 633 bp, Zea mays
  misc_feature: Ceres CLONE 1441980-F
  misc_feature: Encodes the peptide sequence at SEQ ID NO. 42866
ggagctccccgcggtggcggccgctctagaactagtggatcccccgggctgcaggaattcgcacgagaccattacctagaacatcctaatcgaaaaattaccggaagagaaaaaaataactcggaaaagaaggagacgccgaaaattcgaaaggggagggggaaagcaaagctgatggcggaggcccaggggaaagcaaagcaaatggcggaggccccgagcaagatcgaatccatgaggaagtgggtcgtcgagcacaagctccgagccgtaggttgcctctggctaggtgggatcagcagttcgatcgcctacaactggtcgcggcccaatatgaagcctagcgtcaagatcatccacgcaaggttgcatgcgcaagctctaaccctcgctgcattagttggttctgcatgcgtggagtactatgaccagaagtatggttcttctgggccaaaggtggacaaatacacaagccaatacctgggcccattcgcataaagattaaaggtcgccatgtttggtccctgcatgccggattacattttgggctcatctcggggttgctccaggacccgccccatggatgcctggagctttattccttttttttttgtcttccaaaattacaaaaag

SEQ ID NO: 42866 - protein, 107 aa, Zea mays
  misc_feature: Ceres CLONE 1441980-F
  misc_feature (14)..(81): Pfam Name: HIG_1_N Pfam Description: Hypoxia induced protein conserved region
MAEAQGKAKQMAEAPSKIESMRKWVVEHKLRAVGCLWLGGISSSIAYNWSRPNMKPSVKIIHARLHAQALTLAALVGSACVEYYDQKYGSSGPKVDKYTSQYLGPFA

SEQ ID NO: 42867 - DNA, 619 bp, Zea mays
  misc_feature: Ceres CLONE 1441982-F
  misc_feature: Encodes the peptide sequence at SEQ ID NO. 42868
ggagctccccgcggtggcggccgctctagaactagtggatcccccgggctgcaggaattcgcacgagaccattacctagaacatcctaatcgaaaagacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaaggttcatttcatccttaagcacaagaatcctaagac

SEQ ID NO: 42868 - protein, 154 aa, Zea mays
  misc_feature: Ceres CLONE 1441982-F
  misc_feature (24)..(154): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTNKVHFILKHKNPK

SEQ ID NO: 42869 - DNA, 783 bp, Zea mays
  misc_feature: Ceres CLONE 1442012-F
  misc_feature: Encodes the peptide sequence at SEQ ID NO. 42870
  misc_feature (70)..(70): n is a, c, t, g, unknown, or other
  misc_feature (71)..(71): n is a, c, t, g, unknown, or other
ttttgtctgtcggtgggggggcccgcgggtcgccccccccccccgggggtgggatgaaaagtcccccccnnaaaaaaaccccccaaaactggagctccaccgcggtggcggccgctctaacctagtggatcccccgggctgcaggaattcccacgagaccattacctagaacatcctaatctaaaaagcagaatccaatccaatccccagcgcgcgccgccccctctaatccctcctccgcaaggcagacagaggccggcgttcactcgggcatccgcgggacggacggggagcaaagcctcagcggcgagtgcgggcgatgaggtcttcggaggcgtcgtcgcggctcgtgcaggagctcgtgctgtacgccgccagcgccgcgctcagctgcctcgtcctcttcgctggcctccgccacctcgaccccaacggcgccgcttcccgtaaggcgcagccagcagaagaaggagagtcgccaagggcctcgggccggccccttcggcgtccacccaggccttaatgaggacccggattggcggggggaaagtcatgccaacccccgaacgggcattcgaccgttcgcaattccgacctccctcggggcggccctggaaaccaaaagcaagccagggcggctccctaccaaccccggcctatccgggccccctggcgcccggcccccgagagccccttcccccccgtggcgaaagccctcccacccccccccccaggaacggggctgcccccctccgctcactggggccccgccccgcgccccac

SEQ ID NO: 42870 - protein, 67 aa, Zea mays
  misc_feature: Ceres CLONE 1442012-F
MRSSEASSRLVQELVLYAASAALSCLVLFAGLRHLDPNGAASRKAQPAEEGESPRASGRPLRRPPRP

SEQ ID NO: 42871 - DNA, 619 bp, Zea mays
  misc_feature: Ceres CLONE 1442017-F
  misc_feature: Encodes the peptide sequence at SEQ ID NO. 42872
gctctattactagtggatcccccgggctgcaggaattcgcacgagaccattacctagaacatcctaatcgaaaaatatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgttccagatctacgccattcgccaggccgtctccaaggggctcgtcgcctactaccagaagtacgtcgaagaagccgccaaagaaggagggcaagggacatctttcacccggaacgaccgcaccccttctcgttgcccgaacccaggcgcttgcaagccgaaaaaagttcggtgggccccggccccccgcgccagggttcaaaaaatcctaaccgttg

SEQ ID NO: 42872 - protein, 153 aa, Zea mays
  misc_feature: Ceres CLONE 1442017-F
  misc_feature (17)..(149): Pfam Name: Ribosomal_S9 Pfam Description: Ribosomal protein S9/S16
MSTVLQRPTPGTVQCFGRKKTAVAVAYTKPGRGLIKVNGVPIELIRPEMLRLKAFEPILLAGRSRFKDIDMRIRVRGGGKTFQIYAIRQAVSKGLVAYYQKYVEEAAKEGGQGTSFTRNDRTPSRCPNPGACKPKKVRWAPAPRARVQKILTV

SEQ ID NO: 42873 - DNA, 650 bp, Zea mays
  misc_feature: Ceres CLONE 1442018-F
  misc_feature: Encodes the peptide sequence at SEQ ID NO. 42874
aaagctggagctccccgcggtggcggccgctctagtactagtggatcccccgggctgcaggaattcgcacgagaccattacctagaacatcctaatcgaaaaaagggccgcagcggcaggccacgcatctctctcccttccttctccccgttctccgtgcaatctcggccgtttccgctcccgccatcgccatggaggaggccaaggttgtggagtccaaggacgggacgatctcagttgcttcagcatttgctggtcatcaggaagctgtgcaagacagggaccacaaatttttatcaaaggcagtggaggaagcataccaaggagttgactgcggcgatggaggaccatttggtgcagttgttgtccataatgatgaagtaatagttagctgccataacatggttttgaagaacactgatccaactgcgcatgctgaagtaactgcgataagagaggcttgcaaaaagcttgggaaaattgagctgtcggattgtgaaatttatgcatctttgtgagccatgcccaatgtgttttggtgctgttcatctttcccgggattaagagggttggtgtagtggagcccagggcagatgcttgcaattggccatgggaatttgatgaatttccattgctgaatgctcccagaa

SEQ ID NO: 42874 - protein, 108 aa, Zea mays
  misc_feature: Ceres CLONE 1442018-F
  misc_feature (28)..(108): Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
MEEAKVVESKDGTISVASAFAGHQEAVQDRDHKFLSKAVEEAYQGVDCGDGGPFGAVVVHNDEVIVSCHNMVLKNTDPTAHAEVTAIREACKKLGKIELSDCEIYASL

SEQ ID NO: 42875 - DNA, 865 bp, Zea mays
  misc_feature: Ceres CLONE 1442036-F
  misc_feature: Encodes the peptide sequence at SEQ ID NO. 42876
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (64)..(64): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
cctgggttgcgtttnccctnnttgcccccctctagcgtgtggtgcggcgcggagcccccgaganaannnnnngggnnnnnntctaaactggcactccccgcggtggcggccgctctatactagtggatcccccgggctgcaggaattcgcacgagaccattacctagaacatcctaatcgaaaactcatgttcctctcctttccttccctcccaacctcggtcaccagtccatcgatcctcgaatcgctcgcctgcactgcactgcaaggtacatacgccatgaagctgagcatgcctttcttcggctcgtcttcctcctcctccggcaagaagaggaaggggtcaaagaccggcggctcctcttccttcgtctccaccgcgtcgtcgtcctcattccgacgagcggcgcgtcgccctcagccgtaaggacgacgcccgcggcaccggtcttccccggcccccggcgcgtccgcccccccaaccccgaaaccccgccctgcggtaagcacccccgctcgccccgtcagcaatactctcggtgcaccccccggcacggaaccctggcaagggcgggagccctggccgcccggggcggcggccctggccggtccggcgggaacacacgccttgaaccccccgtgtcggcctcggttcttatgggcggggaggggcgcgccgcgggggccccgcgcgccggctaacccaccgccccctttcgtccctccctacaaccccggaaagagcaaagaggggccccgaagccctccacgcatccgctcgctttgtgggggggagggtcatggaaggctttaaaacgtggcgcagcggggcaggagcgcacgcgagccagcgggcgagctttcc

SEQ ID NO: 42876 - protein, 79 aa, Zea mays
  misc_feature: Ceres CLONE 1442036-F
MFLSFPSLPTSVTSPSILESLACTALQGTYAMKLSMPFFGSSSSSSGKKRKGSKTGGSSSFVSTASSSSFRRAARRPQP

SEQ ID NO: 42877 - DNA, 790 bp, Zea mays
  misc_feature: Ceres CLONE 1442037-F
  misc_feature: Encodes the peptide sequence at SEQ ID NO. 42878
  misc_feature (13)..(13): n is a, c, t, g, unknown, or other
  misc_feature (47)..(47): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
gcgtgttcttggnaagccgaaatacctaccctcaccccatatccccntcgcgaaggggcagtatttnnngtnnnntttnnnnnnnntaatactggagctccaccgcggtggcggccgctctttaactagtggatcccccgggctgcaggaattcgcacgagaccattacctagaacatcctaatcgaaaaacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgcttcggctcgaaccggttcctcatccttccttgctctccgtatgccttaggctctttgatgggtactaggtttccgttggtccgcaagccagaggaaagaaccctttctggtagaattccgggtttggttggtcccaaggtgccccccggaggggcaacttggagaatttgtactgaattttggaaataatgggggaatactgagccctggaaggacctttttatgtaaaaaaaacaaaacaaaaaataagccttttccggtattccctctccgaaccctcccaggggggggggcccccggcgcaccacaaatctccccccttaaagagggcggcgccctgaactgacggcgc

SEQ ID NO: 42878 - protein, 62 aa, Zea mays; identical to SEQ ID NO: 6893
  misc_feature: Ceres CLONE 1442037-F
  misc_feature (3)..(61): Pfam Name: Ribosomal_S30 Pfam Description: Ribosomal protein S30

SEQ ID NO: 42879 - DNA, 666 bp, Zea mays
  misc_feature: Ceres CLONE 1442051-F
  misc_feature: Encodes the peptide sequence at SEQ ID NO. 42880
aaagctggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagacta

SEQ ID NO: 42880 - protein, 142 aa, Zea mays
  misc_feature: Ceres CLONE 1442051-F
  misc_feature (58)..(140): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQT

SEQ ID NO: 42881 - DNA, 630 bp, Zea mays
  misc_feature: Ceres CLONE 1442068-F
  misc_feature (219)..(219): n is a, c, t, g, unknown, or other
  misc_feature (239)..(239): n is a, c, t, g, unknown, or other
  misc_feature (267)..(267): n is a, c, t, g, unknown, or other
aagctggagctccccgcggtggcggccgctctagaatagtggatcccccgggctgcaggaattcgcacgagaccattacctagaacatcctaatcgaaaaataggcactagcacctcctcgcctccacctccgtcctcttcgatcccgtccaatcccccgcgccccggcgcccctctccgccggcggctttgctgggtccagcgctcctcctcctctanggatgtctggttggggctgncgcggaaggaaactagtaaagggaaagnaaagggaaaggtttaaggaaaagcgcaacggcagcggcaccaccaatgccctcccacccggatctgggacccccaaatctccaaccttccggaaatgcaaattcccggccggaaggggagggcaaaacccttttcgaaaccccccagggcaacccccttggaaaaagggaaaaggggaaccccgggcccccccccccgaaattttttggggggaaaaccccccgggcgttttcaaaaccccccaaagttttttttccaaccggggggggaaaccgcccaaaaacaaaaaaaccttttttggggggggaaaaatcccaccggggggagaaacccccgaggagaacgcgcgcctctttatggggg

SEQ ID NO: 42882 - DNA, 545 bp, Zea mays
  misc_feature: Ceres CLONE 1442074-F
  misc_feature: Encodes the peptide sequence at SEQ ID NO. 42883
  misc_feature (106)..(106): n is a, c, t, g, unknown, or other
  misc_feature (179)..(179): n is a, c, t, g, unknown, or other
  misc_feature (261)..(261): n is a, c, t, g, unknown, or other
  misc_feature (285)..(285): n is a, c, t, g, unknown, or other
  misc_feature (341)..(341): n is a, c, t, g, unknown, or other
ggagctccccgcggtggcggccgctctagaactagtggatcccccgggctgcaggaattcgcacgagaccattacctagaacatcctaatcgaaaaatgctatgcngcttcctccacatacaagaccaccgcagatcaaaacacacatctctctcactcactcactcgcctcactccanctggacatccatccatggagctcttcgcagcagcagcatcagccgaggatcagaagccgtgcagcagcaggctgttcagcangaagaagagcggcggcaaggcggncatgggcgtgcgacgcaccgacaagggccggtcgtccttctccggggcgtgcgcgncgctcgtcaaggagcagcgcgcgccgatctacatcatgcgccgctgcctcacaatgctggtgttgctggccaaatacccctgacccctgacccctcggggtccctgatcaatggccccggaactgaaggggaaccccctgccggaaccgacaaaaaaccaaaagggaaaaaaagaaaaaaaaaagggaaacccccccccccccc

SEQ ID NO: 42883 - protein, 76 aa, Zea mays
  misc_feature: Ceres CLONE 1442074-F
  misc_feature (53)..(71): Pfam Name: DVL Pfam Description: DVL family
  misc_feature (23)..(23): Xaa is any aa, unknown, or other
  misc_feature (31)..(31): Xaa is any aa, unknown, or other
  misc_feature (50)..(50): Xaa is any aa, unknown, or other
MELFAAAASAEDQKPCSSRLFSXKKSGGKAXMGVRRTDKGRSSFSGACAXLVKEQRAPIYIMRRCLTMLVLLAKYP

SEQ ID NO: 42884 - DNA, 670 bp, Zea mays
  misc_feature: Ceres CLONE 1442078-F
  misc_feature: Encodes the peptide sequence at SEQ ID NO. 42885
  misc_feature (422)..(422): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaatctataaataggacctagacgatcaatcgcaatcgcatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggntatgatgccaccgatgacaatgatgccgatgccgaatatgatgccatcgatgatggtgccgactatgatgtcaccaataacgatactaggtaatgatgccaccgatgatgatgccaaacatggtttcaccaatgatgatgccgagtatgatgccttcgacgatgacgccagntaatgatgccaccgataatgatgccaagtatgataccaccgatgatgatgccgagcatggtgtcatcaatgataat

SEQ ID NO: 42885 - protein, 111 aa, Zea mays
  misc_feature: Ceres CLONE 1442078-F
MAAKMFALFALLALCATATSATHIPGHLSPLLMPLATMNPWMQYCMKQQGVANLLAWPTLMLQQLLASPLQPCQMPMMMPGYDATDDNDADAEYDAIDDGADYDVTNNDTR

SEQ ID NO: 42886 - DNA, 635 bp, Zea mays
  misc_feature: Ceres CLONE 1442080-F
  misc_feature: Encodes the peptide sequence at SEQ ID NO. 42887
  misc_feature (402)..(402): n is a, c, t, g, unknown, or other
  misc_feature (508)..(508): n is a, c, t, g, unknown, or other
  misc_feature (517)..(517): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaaactcatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaanccagacttcctccagtgcgccgtctatgactcccgacaagccgacgcgcgtctcatcgggcgtgaagtacatcgtgtcgaggaagatcttcaactccctgccggcngaagaacancggctgtggccctcccacgcccacaaaatcagtcaggcctgggacaaacccccccttggcggggcttcctgaaaaagcggacttgnaccacattgcccccccctttgggaaaattctg

SEQ ID NO: 42887 - protein, 158 aa, Zea mays
  misc_feature: Ceres CLONE 1442080-F
  misc_feature (26)..(152): Pfam Name: DUF1264 Pfam Description: Protein of unknown function (DUF1264)
  misc_feature (81)..(81): Xaa is any aa, unknown, or other
  misc_feature (117)..(117): Xaa is any aa, unknown, or other
  misc_feature (120)..(120): Xaa is any aa, unknown, or other
  misc_feature (148)..(148): Xaa is any aa, unknown, or other
MASSDGKPLPTPASVGGGGGSSTAPPGQPTTVASKVLDMGAAAMQSLRPVKQAKQHMCTFALYAHDPKRQVETHHYVSRLXPDFLQCAVYDSRQADARLIGREVHRVEEDLQLPAGXRTXAVALPRPQNQSGLGQTPPWRGFLKKRTXTTLPPPLGKF

SEQ ID NO: 42888 - DNA, 538 bp, Zea mays
  misc_feature: Ceres CLONE 1442083-F
  misc_feature: Encodes the peptide sequence at SEQ ID NO. 42889
aaagctggagctccccgcggtggcggccgctctagaactagtggatcccccgggctgcaggaattcgcacgagaccattacctagaacatcctaatcgaaaaatgcccacgcgctcgcctatctcatagtccttccccattccgcctctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaagactacatgatgctctacacgacgaatatacaaacatgttccacccccagaagccccccccgcaccgaactaactccggggaaaagcaaagttttcttaaacaaaaaaaaaaagggtgttttttttctccgccgggcgggggagg

SEQ ID NO: 42889 - protein, 88 aa, Zea mays
  misc_feature: Ceres CLONE 1442083-F
MAGQERRTIDLEEGWAFMQKGITKLKNILEGKPEPQFSSEDYMMLYTTNIQTCSTPRSPPRTELTPGKSKVFLNKKKKGVFFLRRAGE

SEQ ID NO: 42890 - DNA, 669 bp, Zea mays
  misc_feature: Ceres CLONE 1442085-F
  misc_feature: Encodes the peptide sequence at SEQ ID NO. 42891
aaagctggagctccccgcggtggcggccgctctagaactagtggatcccccgggctgcaggaattcgcacgagaccattacctagaacatcctaatcgaaaaatacggcataccacactagagccgccgccgccgccgccgctgccgtttcgcgcagcgtaccctagccctcgtcagcggaggattcgagctccgccagccatgacgtacaagcggaggaatggcggacgcaacaagcacgggcgcggtcacgtcaagtacatccactgctccaactgtgccaagtgctgccccaaggataaagctatcaagcggttcttggagaagaacattgttgagcatgctgccgtgagacatgtgcaggaggcctgtgtacatgatggatatgttctacccaaattgtatgcaaaggatcatcactgtgtctcatgcgcaatccatgcgcacattgtccgtgtccgctctcgtgagaacaggaggaaccgtgagcccccgcagcgcttcagacgccgggatgatggcccaaggcctggtcagggcccgcctcgcccaggaggtgcatctcctgcacctgcaccagctgctgctcctcgtactgaagttcaggaagtagttacggggcttagtcctgggaaacataacctgtttcgagaaaccattgttactgtt

SEQ ID NO: 42891 - protein, 156 aa, Zea mays
  misc_feature: Ceres CLONE 1442085-F
  misc_feature (1)..(114): Pfam Name: Ribosomal_S26e Pfam Description: Ribosomal protein S26e
MTYKRRNGGRNKHGRGHVKYIHCSNCAKCCPKDKAIKRFLEKNIVEHAAVRHVQEACVHDGYVLPKLYAKDHHCVSCAIHAHIVRVRSRENRRNREPPQRFRRRDDGPRPGQGPPRPGGASPAPAPAAAPRTEVQEVVTGLSPGKHNLFRETIVTV

SEQ ID NO: 42892 - DNA, 664 bp, Zea mays
  misc_feature: Ceres CLONE 1442091-F
  misc_feature: Encodes the peptide sequence at SEQ ID NO. 42893
aaagctggagctccccgcggtggcggccgctctagaactagtggatcccccgggctgcaggaattcgcacgagaccattacctagaacatcctaatcgaagaaaccgcccacttccccaaaacctgccacgcttgaacggctctcaatcccaaccctaacagcaccgtctctcggatctgatctgatctgatcctccaattcgttcgtccacgtctcgccatggatgcagccccgcgcgtcacgcctaagaattatgcgacctggtggtgtgcacggctgattggtcgctgcttcagtcatgagaggggaggacgaggaacttgttgatcagaagaaatatcttgaggaacgatgcaagccgcaatgtgtaaaatcactttacgaatatgagaaatgcgtcaagagagttgagaatgatgatactggtcacaaacactgcactgggcaatactttgattactggtcatgcatcgacaaatgtgtagcaccaaagctctttaagaagctcaaataaaaaaaaaaaaaaaaaatttttgggtttaatttgtgttctcagccctgatgtttagtctgctagcactctgtgggtgctgttgtcgcaagatcaccaccatgtcaattatttccgtgcccttgtcgcactctgtgtgctgttgcttgaaa

SEQ ID NO: 42893 - protein, 71 aa, Zea mays
  misc_feature: Ceres CLONE 1442091-F
  misc_feature (9)..(71): Pfam Name: UCR_hinge Pfam Description: Ubiquinol-cytochrome C reductase hinge protein
MRGEDEELVDQKKYLEERCKPQCVKSLYEYEKCVKRVENDDTGHKHCTGQYFDYWSCIDKCVAPKLFKKLK

SEQ ID NO: 42894 - DNA, 677 bp, Zea mays
  misc_feature: Ceres CLONE 1442093-F
  misc_feature: Encodes the peptide sequence at SEQ ID NO. 42895
  misc_feature (523)..(523): n is a, c, t, g, unknown, or other
  misc_feature (524)..(524): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaaatctgaagctgcttgactcccacctagtgccnntctctactgctgctgaatcaaaggtcttctacctcaagatgaagggtgactatcacaggtatctggcggaaattangactggtgctgagaggaaaggatctgctgagaacaacatggtgggcctataggctgctacagactttgctctggcta

SEQ ID NO: 42895 - protein, 153 aa, Zea mays
  misc_feature: Ceres CLONE 1442093-F
  misc_feature (3)..(154): Pfam Name: 14-3-3 Pfam Description: 14-3-3 protein
  misc_feature (112)..(112): Xaa is any aa, unknown, or other
  misc_feature (137)..(137): Xaa is any aa, unknown, or other
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGNLKLLDSHLVPXSTAAESKVFYLKMKGDYHRYLAEIXTGAERKGSAENNMVGL

SEQ ID NO: 42896 - DNA, 697 bp, Zea mays
  misc_feature: Ceres CLONE 1442105-F
  misc_feature: Encodes the peptide sequence at SEQ ID NO. 42897
  misc_feature (403)..(403): n is a, c, t, g, unknown, or other
  misc_feature (443)..(443): n is a, c, t, g, unknown, or other
  misc_feature (447)..(447): n is a, c, t, g, unknown, or other
  misc_feature (459)..(459): n is a, c, t, g, unknown, or other
  misc_feature (478)..(478): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcgaaaaaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggtaaaacctcccccgcgctccggccatgcgccggcgccgcagccgcttgccatcgagcagccatggctcacgatcgacgctctgtgtgtctgcgtgcgtggtttgcaggcaacggaggggatgaacgtgaaggaggagtgccancgctggtcatggagatgaagtggaagaagtgcaccgcttncgtntgtaacagatcnaacaaagcgtcgcgcgccngtgctggtggaccaggtgggcggccccggggaaaggtacaaaggagcctcgtggccccccttcccgggaaaaaatgggccttacccccgtttttnaattttaattttttcccccgtgaaaaaagggaaaaaaaaagaaaatttttttttttccccgtggaccgggggggggtaaaaaagaagggggcaaaaaacctggggccccaaattaaaaaggggg

SEQ ID NO: 42897 - protein, 60 aa, Zea mays
  misc_feature: Ceres CLONE 1442105-F
  misc_feature (55)..(55): Xaa is any aa, unknown, or other
MAMAYKMVKPPPRSGHAPAPQPLAIEQPWLTIDALCVCVRGLQATEGMNVKEECXRWSWR

SEQ ID NO: 42898 - DNA, 656 bp, Zea mays
  misc_feature: Ceres CLONE 1442112-F
  misc_feature: Encodes the peptide sequence at SEQ ID NO. 42899
aaagctggagctccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttctgcggtggcgagcaactcatgtggggacttacttcctgcggaactactacaacctgctgcaacaacccacgatgtcgtccaccagttctacagctaatccagtcccatggtccgcgtcgacgacctcagcggaaacgacgctgctgccaaccacctgatggacatacacttactcatcatgtctttgaacttcccccaattgagatccagactgccaattttgatgactcatggcgacgataaggagctagttatgggctccggtctagtgtcaacccaagggtacaggccaccaaagtgaatttatccaggaagttcttcccttgacacacgagagaaaggtttaatttggccattaaacatttaccttcacattcccttaccccagaacatgtgggattctgtgccccagtaaatgcgcccagtaagacttccaaagacaattttggccaccaaaactcagtttgtgagaaacaccttc

SEQ ID NO: 42899 - protein, 64 aa, Zea mays
  misc_feature: Ceres CLONE 1442112-F
MVRVDDLSGNDAAANHLMDIHLLIMSLNFPQLRSRLPILMTHGDDKELVMGSGLVSTQGYRPPK

SEQ ID NO: 42900 - DNA, 634 bp, Zea mays
  misc_feature: Ceres CLONE 1442120-F
  misc_feature: Encodes the peptide sequence at SEQ ID NO. 42901
aaactggagctccaccgcggtggcggccgctctagaactagtggatcccccgggctgcaggaattcgcacgagaccattacctagaacatcctaatcgaaaaacttctagtgccacccaccaacttccccttccccgtcgcatcgcatcgagagcggggctgtaccgtgcgagactctactgctcgatcgccatggccgccgcgctcaggtgcccggcctccgtcagggtctcgggccccgccgccgcgtggctcgccaaggtgcgccaggcgtccagagtcgtctcggtgagcgaggcccggcagagcctcggcggcggcgtcgccgtgcgggggtcactgttctcgccaagcccgcagggagcccaggaaccccggccgacaaggtgcaggatctgtactgtactaaaccaccatgcggaccgcgagagccccccttactggccctctccgccaactaaaggaaaacccggctggggaacctcttccccttcccaaaaagggttcaaaggccccccggaaaacgggtgggggggtccccgggggtttttggggttttttcaaaacccccccccaccccaaggggacccctgaaaagggctttttaagctcttttcttcggaaaaccccggcc

SEQ ID NO: 42901 - protein, 133 aa, Zea mays
  misc_feature: Ceres CLONE 1442120-F
MAAALRCPASVRVSGPAAAWLAKVRQASRVVSVSEARQSLGGGVAVRGSLFSPSPQGAQEPRPTRCRICTVLNHHADRESPPYWPSPPTKGKPGWGTSSPSQKGFKGPPENGWGGPRGFLGFFQNPPPPQGDP

SEQ ID NO: 42902 - DNA, 658 bp, Zea mays
  misc_feature: Ceres CLONE 1442125-F
  misc_feature: Encodes the peptide sequence at SEQ ID NO. 42903
aaagctggagctccccgcggtggcggccgctctagaactagtggatcccccgggctgcaggaattcgcacgagaccattacctagaacatcctaatcgaaaaaaaaatgaaccacgatttctcttcagttctttccttgcgtgcacggctgctcgtcaattccgctgccgaaattatgccgttgccttctggttcccacgacaaaagcggcattaccccggtcgctttataaattggactttcttactttcggcacggccaccggacagctccccacaaaaccgtcagttctcttttcccctgtaaatcgcaaattcgtcttccctgcccatctatcgcttggacacctctgcaagggagcacatggctctcaagaaggccaaggagatcatcgcgtcctccccgggcgacctacctctccgaaagggcaaggagaccgacgcctcccaccccgtcgtcgtcttcagcaaaacttactgtcctttctgcacccgagtgaaacaattgctagcaaagttgggggcaagttacaaggctattgagttggatgaggaaaatgatggccctgagctgcagtcagctctcgctgaatggactggccagagaactgttcacaatgtcttcatgaaaggtgagcgcattggtggctgtgacacac

SEQ ID NO: 42903 - protein, 98 aa, Zea mays
  misc_feature: Ceres CLONE 1442125-F
  misc_feature (31)..(93): Pfam Name: Glutaredoxin Pfam Description: Glutaredoxin
  misc_feature: SWISSPROT Homolog: EC 1.11.1.15 Peroxiredoxin
MALKKAKEIIASSPGDLPLRKGKETDASHPVVVFSKTYCPFCTRVKQLLAKLGASYKAIELDEENDGPELQSALAEWTGQRTVHNVFMKGERIGGCDT

SEQ ID NO: 42904 - DNA, 808 bp, Zea mays
  misc_feature: Ceres CLONE 1442126-R
  misc_feature: Encodes the peptide sequence at SEQ ID NO. 42905
  misc_feature (584)..(584): n is a, c, t, g, unknown, or other
  misc_feature (802)..(802): n is a, c, t, g, unknown, or other
attgggtaccgggccccccctcgaagtcgacggtatcgataagcttttttttttttttttttgcacaactcgatcatgaattatgaacattgcgtgaaacggttttggtggcacaaattagcaacccaggcacagcttgagaaaggaccatgctatttacaggattttacaacagctacaactgcggggttcatcaggaaaactgaaagaaacactaaataccagacgtttgttgctggctggaaaagctgagttattatcctcgcctctacaacacctaaatcagaacgaccttctcagcgagaagaatagacgccactccgatcaggtgctataaactaggtcaggtcagaaagccgtgcaaagattattcttcaagtttgacgagcattcctgctgaatggtaattgctgggctacaaagccgacttctctttggctcagatattctaacacgtgttattgctgccgccaatgcgtcaactatgccacactcatcctgatcctctgacctttggcttgcgtctgacaatgagtcacattctgatttgtgtctgccccatggaattttgggtgctataaccnttgttagggagacacaaattagcagctaccaccttcaggggggcattctgtgtaaaaacacgacccatgggtggactaagaacttcatcagcagtcattctacaagagacatctcgatttagcattcgccccaataagatcccgtccaagaactgatattgatttcccatgggggtgcttgctgaaatcaaagttcaaagtgttctttatggactccnaaaaca

SEQ ID NO: 42905 - protein, 58 aa, Zea mays
  misc_feature: Ceres CLONE 1442126-R
MNYEHCVKRFWWHKLATQAQLEKGPCYLQDFTTATTAGFIRKTERNTKYQTFVAGWKS

SEQ ID NO: 42906 - DNA, 644 bp, Zea mays
  misc_feature: Ceres CLONE 1442144-F
  misc_feature: Encodes the peptide sequence at SEQ ID NO. 42907
aagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcga

SEQ ID NO: 42907 - protein, 161 aa, Zea mays
  misc_feature: Ceres CLONE 1442144-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKG

SEQ ID NO: 42908 - DNA, 871 bp, Zea mays
  misc_feature: Ceres CLONE 1442162-R
cgaattgggtaccgggcccgccctcgaggtcgacggtatcgataagcttttttttttttttttttgagagtcggccaccgggggccaggtactcctttgccccccccgggaagttgctgggtagtgaacccccagcatccaagcccaatcctccgggggggcgcttaattcaatttcacattctgatgctggcaaatagggtcacaaatggaaggaggaaaccatgcttgtacaaagttccagtttactaccctcaccacacacgcacgcacgagtacatatataattctctcttcaacaagtgaaaaaaaggcctaacacctttgcaaaaccttttcttgcttctcgcccacaacaaggggaatcatccccgccggattcctggtttgcgctgttcctaaactcccgggggctgcaacctgcccctgcaaaaacaaatgcctcccgtacccatagaaagggcaaccaaccagggggattccccccccaattgccttcattgcaaaaattggattccggaaaatcgaccacgacattaaccctgccaccccgactttaaggttgcctgcaacgttaaacgtcactgctgttgttgaagggatgacaaagaaaatggagaagttaaggcaaaacgcatgcacccccaaacttaggatgatagcccccgcaggaacgatggaatcatgtgggtaaaaccagttcattacacctcccccttcaagcaccatcgtcgggtagacccagtatcagggggggcaaagggtgcccatgtaataacaccgggttaaatgctgcacaaccttgtttccgtggaagacagggactctgcccaagaaggttctttttaaaaagaacacccgtgccgccaacc

SEQ ID NO: 42909 - DNA, 636 bp, Zea mays
  misc_feature: Ceres CLONE 1442162-F
  misc_feature: Encodes the peptide sequence at SEQ ID NO. 42910
ccccgcggtggcggccgctctagaactagtggatcccccgggctgcaggaattcgcacgagaccattacctagaacatcctaatcgaaaagtcgtctgcctctcccttccttccgcagttgagttccccccgtcggtcccgcccccggtccccttccagcgaccctccatgtcggctatgaggtgaggttgaggccaggtctactctccgcgacagtggtcgacgccgtcgccaatgagtagtttgcgccttcttcaccttctcggatcgaaattcagtgcactaatcttggctgagatggaggactgctgccatgcctctgccggtctgagcaccctgcgcgcggtgctcaccatcgtccagtgtcgtggcttccatgcgaccgtcctcatcatgagctagtggatcttgcagagactggattttacgttccgtctcacggtgtcctgcggccacttcagctgtgcgttcatttgtagctaaaatttcaatcgatgtgattcaggttataccctctgatttcggtttgacccgcaggaccgctggcaaaggatatttccaaatgtccctcggggtttctggcttaacctttggtgttaggtcaattgtccacccttgacactaaaatccccagac

SEQ ID NO: 42910 - protein, 34 aa, Zea mays
  misc_feature: Ceres CLONE 1442162-F
MEDCCHASAGLSTLRAVLTIVQCRGFHATVLIMS

SEQ ID NO: 42911 - DNA, 621 bp, Zea mays
  misc_feature: Ceres CLONE 1442166-F
  misc_feature: Encodes the peptide sequence at SEQ ID NO. 42912
  misc_feature (402)..(402): n is a, c, t, g, unknown, or other
  misc_feature (403)..(403): n is a, c, t, g, unknown, or other
aagctggagctccccgcggtggcggccgctctagaactagtggatcccccgggctgcaggaattcgcacgagaccattacctagaacatactaatcgaaaagtaccatgcatgtgttcaaaacggaaagtctgatctgaagccagcagacgtgaaaccgacagcacgtacgtacgtgtgagggctgagggctgctcggcggccatgggacaatggtgctttaagaaacgcgcagctctggtgattattgtggccattagctcgctgcagctgctcctgataactgctcaagaagctggaggagaccacgaggtgtggtcgtcgtcatcctcgccggccggtggtcgtggtggcagcgccgtcgtcttcccgacggcgcggatggggccggacaggcgtcacnnttcctgttcgggggacgaggcggtggtggtgtaccagagcagcaccaaccctctgcccagcggcatcccggcctacaccgtgcagatcatcaacgactgcggcggagggtgcaccgtgtacgacgtgcacgtctcctgcggcgacttcgcctccacggagctcgtcgacccggccaagttccagcgcgtcgccttcgacgactgcgtcgtcaagggcg

SEQ ID NO: 42912 - protein, 139 aa, Zea mays
  misc_feature: Ceres CLONE 1442166-F
  misc_feature (67)..(67): Xaa is any aa, unknown, or other
MGQWCFKKRAALVIIVAISSLQLLLITAQEAGGDHEVWSSSSSPAGGRGGSAVVFPTARMGPDRRHXSCSGDEAVVVYQSSTNPLPSGIPAYTVQIINDCGGGCTVYDVHVSCGDFASTELVDPAKFQRVAFDDCVVKG

SEQ ID NO: 42913 - DNA, 614 bp, Zea mays
  misc_feature: Ceres CLONE 1442180-F
  misc_feature: Encodes the peptide sequence at SEQ ID NO. 42914
  misc_feature (614)..(614): n is a, c, t, g, unknown, or other
aagctggagctccccgcggtggcggccgctctagaactagtggatcccccgggctgcaggaattcgcacgagaccattacctagaacatcctaatcgaaaacatttaaccaataagcattcattcattagtctcagccagtcgagctcgtcggtcgccatcgccacctctaaccgccgccgtcgccgccggcccgcagtggtgccacaaaaccggtgacccctactccccctctttcctctcccctctctcccgctctgcctctcccttcgccacttctaccctgctgagggtgtcgcctatggatctcccccgtcctccgtgtgggtgcgcagcggcggtggtgcgcctggcggcagctgatgcgcacaacaaagtgttccctagttaagtgtgccgagccggaggggatggcagtcgacgcagctttgcggctgttgtggcaaccggtgcgtcggtgcccctctggaggggtttgcgcagaggctagggcagtggagacggcggaggctacctgctttgacctgggatcctggcctttcgatgtgctggatggcatcttgggcgaaaaccttggcgatggtgacatccgtggacgccacttccccctgttgn

SEQ ID NO: 42914 - protein, 84 aa, Zea mays
  misc_feature: Ceres CLONE 1442180-F
MRTTKCSLVKCAEPEGMAVDAALRLLWQPVRRCPSGGVCAEARAVETAEATCFDLGSWPFDVLDGILGENLGDGDIRGRHFPLL

SEQ ID NO: 42915 - DNA, 630 bp, Zea mays
  misc_feature: Ceres CLONE 1442185-F
  misc_feature: Encodes the peptide sequence at SEQ ID NO. 42916
  misc_feature (630)..(630): n is a, c, t, g, unknown, or other
ggagctccccgcggtggcggccgctctagaactagtggatcccccgggctgcaggaattcgcacgagaccattacctagaacatcctaatcgaaaaaacgaagaaccgaatgcccagtcctgaatcacgtcttcacccgtgctcgtgcgctgagcccatcccttccgcctccacgctccccacgtgcaccgtgcacagcaccacacagccaggtccccatggcggcggcggctgcggttgcgtctgccacgactgcggaagacgaaccgcgcctgctgcgcctggaggagcaggcggagcacggcggcggcggcgcctgggaatacctctgcctcgcccgccggctcctcgcccgccgccccgctcacgtcctccgcgtcggcctcgccctcctcaacaacgcctccacgcgctccggccttgcctcagaacagtggacgctctacgagcaggtggccacggcggccatggattgccaacgtctccatgtggcaaaggactgtattggagtcctttcaaaacaatttcctgggagcacacgggttgcccggctagaagctcgtctgtttgaagcataaggtgaatgggctgaagctgagagagcctacgcgctaatcctggaaaacaatn

SEQ ID NO: 42916 - protein, 119 aa, Zea mays
  misc_feature: Ceres CLONE 1442185-F
MAAAAAVASATTAEDEPRLLRLEEQAEHGGGGAWEYLCLARRLLARRPAHVLRVGLALLNNASTRSGLASEQWTLYEQVATAAMDCQRLHVAKDCIGVLSKQFPGSTRVARLEARLFEA

SEQ ID NO: 42917 - DNA, 615 bp, Zea mays
  misc_feature: Ceres CLONE 1442197-F
  misc_feature: Encodes the peptide sequence at SEQ ID NO. 42918
ggagctccccgcggtggcggccgctctatacctagtggatcccccgggctgcaggatttcgcacgagaccattacctagaacatcctaatcgaaaaaaagaaaaatggtggactagaaacttccaaatcgaacggcacacaaaaatcacaacccggaaagggaccagcagcgcaaaggtgagcgagctttccttcggaactcagaactctcgtgctcacctcatccgttcgacaaatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgatgtatgtgtatgcgcagaagacgctccccgccaaagaagaagaagccggtgtccaaaaagaagctgaagagggaaaagctgaagcaaggggtctctgcgccggggagagtaaacgggcatgctgccgatcctcccgtcccgagctcctattcgcatgattattaaagaaaaaaatttatttttatatcccc

SEQ ID NO: 42918 - protein, 96 aa, Zea mays
  misc_feature: Ceres CLONE 1442197-F
  misc_feature (10)..(80): Pfam Name: S1FA Pfam Description: DNA binding protein S1FA
MADQFVDSANNVIIEEVNKGLNPGMVVLLVVASFLLLFFVGNYAMYVYAQKTLPAKEEEAGVQKEAEEGKAEARGLCAGESKRACCRSSRPELLFA

SEQ ID NO: 42919 - DNA, 747 bp, Zea mays
  misc_feature: Ceres CLONE 1442199-F
  misc_feature (564)..(564): n is a, c, t, g, unknown, or other
ttcccctcctcccttattattttcttccttttttcgttctctcgggaggctcttgtttgtgtcccccctgtttgccaccttccatcatgcgcctcccagcggtggcggccgctctttaatagtgcatcccccggggtgcaggatttcgcacgagaccattacctacaacatcctactcgaaaagaaaaagaaaaaggagaggcccgcgactgtagtgggattgtgggaagatgcctcgggatggcgcgcaggcggcgccgccaccggagcgcggcgagatggactaggtggtagaggcggacccggatacggaggcggcaggatcaggaggagaggtgggcgaggctgctgccggagctgcctctcctacgtggtgcggtgtgtctaggcgtccggttgctagtggtggccggcccgaaaggacgtcttttcttgtgccctgcctgtgcccccggtggtaggaggccgctgtctctcacgggggcccactggccggatttcgccaacatcaccttccccaccctctctcatccatccatgggccaagggtagataccatatgcntcggctttccccatctgggaataaagaacaactcccaccttgcaaccctctacctttgatttcccctccatttaaccctgcggactacaagggtaaattttactccagagccttgccgaggcgcccatctaccgtaggcgcgttcccccacttatccccgtcggcccttttcgtcgccccccc

SEQ ID NO: 42920 - DNA, 639 bp, Zea mays
  misc_feature: Ceres CLONE 1442204-F
  misc_feature: Encodes the peptide sequence at SEQ ID NO. 42921
tggagctcaccgcggtggcggccgctctacaactagtggatcccccgggctgcagtaactcgcacgagaccattacctagaacatcctaatcgaaaagccctcccaaaccctcgcgccgccgctccccagcacatcgctcccagcgcgccaaatcggcggcaacctcggacccttcactcacccagctatggcggagcgaggcggcgagcgtggcggagaacgcggcggcgagcgtggcggttttggccgcgggttcggtcgcagcgggcgcggcgaccgtggtggtcgccgtggtggccggcgcggcggccgccagcaggaggaggagaagtgggtgcccgtcaccaagcctcgggcgcctcgtgaaggagaaccggatcaaccagattgaagagatctacctgcactcgctgcccgtcaaggaagcaccagatcgtggaaacccctccgcccgggggttcaaggacacaggtgatgaaaaattcacccccctccaaaaaaacaaaccccgccccggggaaacgcaccgcgtttcaaaggggttttcctcctccctccggggaaaggggaaaggccccccttcggggccccgggcgtcaagggggcccccagggaaggggctcccccccccgccctcg

SEQ ID NO: 42921 - protein, 67 aa, Zea mays
  misc_feature: Ceres CLONE 1442204-F
MAERGGERGGERGGERGGFGRGFGRSGRGDRGGRRGGRRGGRQQEEEKWVPVTKPRAPREGEPDQPD

SEQ ID NO: 42922 - DNA, 630 bp, Zea mays
  misc_feature: Ceres CLONE 1442208-F
  misc_feature: Encodes the peptide sequence at SEQ ID NO. 42923
tggcggccgctctagaactagtggatcccccgggctgcaggaattcgcacgagaccattacctagaacatcctaatcgaaaaaccaccgatctggtctcactgcatcctcctcccctcaccgtccaagagcgccggtccgatgggtcgtccgccaagcaccactggtgctccggccttccgcttcctcccttccgaggtggcggagatggaggcgcgcttgctgcagctcaacaacggcatccccacccgcgccatgctccagactctcgccgataagttctccgcctcgcccgagcgcgccggcaaggtggccatccagcccaagcaggtgtgggacttgttttcagaacaggcgttactcgcatcggggccagaccaccagggtcgtgccctcccccccggcttaaaatgaccccctcgggggccgatcacccccagcacgccgcttaagcctcccgcttttggggcccctcagccctccttctgggccctgttggccccccaggggtccccccctccaaaagaaagggggggggttcccttttttctgggatttttggggcccaaaagagggaggagaaggggttccattggttcccccaaatagtgggggcgcaaaaacatttttt

SEQ ID NO: 42923 - protein, 90 aa, Zea mays
  misc_feature: Ceres CLONE 1442208-F
MGRPPSTTGAPAFRFLPSEVAEMEARLLQLNNGIPTRAMLQTLADKFSASPERAGKVAIQPKQVWDLFSEQALLASGPDHQGRALPPGLK

SEQ ID NO: 42924 - DNA, 634 bp, Zea mays
  misc_feature: Ceres CLONE 1442225-F
  misc_feature: Encodes the peptide sequence at SEQ ID NO. 42925
  misc_feature (634)..(634): n is a, c, t, g, unknown, or other
ggagctccccgcggtggcggccgctctagaactagtggatcccccgggctgcaggaattcgcacgagaccattacctagaacatcctaatcgaaaaacaaaaagaaaaaggaaattcctctcaacatcaccagaccacgacctccctgccgagctccctccctctccgttggtgatggcatctcagagctccaagaccgcggacaccgccgcgcctccgccggaggttgcagccaccggagaggcggctccgggcgcggcttctcaacaccggcacaaaaccctaacgctgctgcaaccgcagtgggcggggccacggatctagagaagagatgcgccccgccgaccggtttgggatgccagtactgatgtcagaagaggaaaaacccagcaatccccgcggagagatttgggacctgctccttcattgtaaagggagaagaaaaagaaaatgtccgggcttaaaaggtttggccttgccctcccccccttttttaaaagaaggaacctcaaaaaaaaggcccctttggaaacaattttggccaaaccccaaaatgtccaaaaggggggaaaaaaaaaaaaaaaaaaggcccccacccccccccaatttttcaaaaaaccctctggggggaaan

SEQ ID NO: 42925 - protein, 100 aa, Zea mays
  misc_feature: Ceres CLONE 1442225-F
MRPADRFGMPVLMSEEEKPSNPRGEIWDLLLHCKGRRKRKCPGLKGLALPSPPFLKEGTSKKRPLWKQFWPNPKMSKRGEKKKKKRPPPPPNFSKNPLGG

SEQ ID NO: 42926 - DNA, 749 bp, Zea mays
  misc_feature: Ceres CLONE 1442226-F
  misc_feature: Encodes the peptide sequence at SEQ ID NO. 42927
  misc_feature (8)..(8): n is a, c, t, g, unknown, or other
  misc_feature (19)..(19): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
gttgcttnttctgtgctcntattttgtgtgaggctatcagcgcggcggccgtgttcagggggggnnccnngnnngnnncgnnnnnncccactggagctccccgcggtggcggccgctctatactagtggatcccccgggctgcaggaattcgcacgagaccattacctagaacatcctaatcgaaaagtagcggaagcggggcacacacagagaagccaatggcgctgtccctctccctcgcgcgccccgcgcccctcgccgtttccgccggcgcaggagccaggaagctacccgcagccagcctagcattcccggcgaaatccttcttcggcgcgccgctggccgccaccgcggcctccgtcgcgtcgccgctcccgcgcaagccggccacctccaccacctcgctcgaggtcgtcgcggcggggaagaacgggtacaagatgaagacgcacaaggcgtcggcgaagcggttccgggtgacggggaggggcaagaacctgcggcggtgccccggagaacaccacttgcttcccaaaaagaaccccaaccgccaaagaagaggctctccaaaaatgggtgcaaagccaacaagaagtgactaccaaacaatggttacggggtgcactggcccttaccctcaaaggggaaattagggcaagcaaaacctgaagatcttacggtggcccttccaaaaaacatccatttaaggtttcgtgttcccacccaaaaattgggaaattttttgggg

SEQ ID NO: 42927 - protein, 144 aa, Zea mays
  misc_feature: Ceres CLONE 1442226-F
  misc_feature (75)..(132): Pfam Name: Ribosomal_L35p Pfam Description: Ribosomal protein L35
MALSLSLARPAPLAVSAGAGARKLPAASLAFPAKSFFGAPLAATAASVASPLPRKPATSTTSLEVVAAGKNGYKMKTHKASAKRFRVTGRGKNLRRCPGEHHLLPKKNPNRQRRGSPKMGAKPTRSDYQTMVTGCTGPYPQRGN

SEQ ID NO: 42928 - DNA, 702 bp, Zea mays
  misc_feature: Ceres CLONE 1442230-F
  misc_feature: Encodes the peptide sequence at SEQ ID NO. 42929
  misc_feature (11)..(11): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (37)..(37): n is a, c, t, g, unknown, or other
  misc_feature (45)..(45): n is a, c, t, g, unknown, or other
  misc_feature (67)..(67): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
tttttcttgcncncgcnncgggtccctgggtgggtantattaatnatcatacgcgaagaaagaggtngtgttnnnnnnnggnnnnnntaaagctggagctccccgcggtggcggccgctctagaatagtggatcccccgggctgcaggaattcgcacgagaccattacctagaacatcctaatcgaaaaaccaaaaatcatcctccggacgaaatcagcggcggcggagatgggagcggagtgccggtacgaggtggcgcaggcggcgtacatcaagctggcgcagcacgcactgaagcacccggcgaccgccatcaacggcctcctcgtcggtcgcctcgtcgagccttcgtcctcaccggccgtcgtctcggtcattgacgccgtgccgctttctcaccacccgcaccatcagccgctgctccccacgctcgagctcgcgctcaccctcgtcaaagacacttcgcaacccagggcgaagccccgccgtcgtcggggactataccgccaacccgcgttgggataaccccgaattcccgccaggccccaaagggcgtcggaaaaccccattcttcccgatactttccccccgcttcccgggggggtttgttgggcccaaaaaacaaagaaacccttggaaggaagggccccccaaaagggggaaaggtttttccgggagggcggggggaattcccagtttcc

SEQ ID NO: 42929 - protein, 98 aa, Zea mays
  misc_feature: Ceres CLONE 1442230-F
  misc_feature (4)..(99): Pfam Name: UPF0172 Pfam Description: Uncharacterised protein family (UPF0172)
MGAECRYEVAQAAYIKLAQHALKHPATAINGLLVGRLVEPSSSPAVVSVIDAVPLSHHPHHQPLLPTLELALTLVKDTSQPRAKPRRRRGLYRQPALG

SEQ ID NO: 42930 - DNA, 872 bp, Zea mays
  misc_feature: Ceres CLONE 1442235-F
  misc_feature: Encodes the peptide sequence at SEQ ID NO. 42931
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (824)..(824): n is a, c, t, g, unknown, or other
  misc_feature (872)..(872): n is a, c, t, g, unknown, or other
gttggacggcgttccccttttttttcgccgctctcgtttccccccgcgcgggtgaagtgttnnnnnnttggggtccctttaaaacgggagctccccgcggtggcggccgctctttactagtggatcccccgggctgcaggatttcgcacgagaccattacataggaacatcctagatcgaaaaccaacaaattcccgagacgccattctcaccatccacacaaagccacagcccaagagcactagagcagagtcgtcggtctcctcgggcatggcggggttcaaggtgacgcggatctgggaggggcccgggaagccggggtcgggcaggcccgaggagacgctggcgctgggctcgcgtgggactggccccccggcgcccggggggccgcgcggcagtcgggtgaccagcgggccgggcgcggctggcggcgcgggccgccgcggccgggagccgggggggcgcgctggggccagggggcgggggggctcgctgcgcgccccgcgccggcgcgcccgcccgctggcggcgggggggggtcgggcccccggggggccccccgcccccggccggccgtgagtggcgttggcggagcgcgggagtccgccccgctgggcgcagccgcccgccccggcgagccccggcacggcggcgcggcgcgggcgcgccgcgcgcccgcgaacggaccgcggtccgcgccgcgcgcgccggcccgcgcggtgggcggaccgccgggggcgcgcgttgcggcccggctgcgcgcggtcggcgcgcgtgcgcgctacggcgggtcgcgcgcggcgtaccgggcacggtcgcggtgncgcgcgcggcgcggccgtctgcccagcgcgcggcccggcgcccgcctn

SEQ ID NO: 42931 - protein, 102 aa, Zea mays
  misc_feature: Ceres CLONE 1442235-F
MAGFKVTRIWEGPGKPGSGRPEETLALGSRGTGPPAPGGPRGSRVTSGPGAAGGAGRRGREPGGRAGARGRGGSLRAPRRRARPLAAGGGRAPGGPPAPGRP

SEQ ID NO: 42932 - DNA, 849 bp, Zea mays
  misc_feature: Ceres CLONE 1442236-F
  misc_feature: Encodes the peptide sequence at SEQ ID NO. 42933
cttttttttcttgtctttcttctccccccacgcccccgtccctcgccggctaggaaaaaaaagtataattttttccccccccccacactgtacctccccccggtggcggccgctctataatagtggatcccccgggctgcaggaattcccacgagaccattacctagaacatcctaatcgaaaaatggaccgcatccctgtctctctctcttctccccctcccccccaatctccgaggcgagctcgagctcccaaaccctacgccttactggggagtctattccgccacctccaccgatgtctctcacccgcagcggattcgacccgcctgccccccaaatctccctcccccgttagacaagccccgccaggcccgccccctgaaggcgctccgcggttctcgcacacggccccgcatgcccctcacccgcctccccccccgtctccacagcctcccgccggcccgcccccggcccccccaatgaaggccccacccccaccgccccccctctgcccacaacccccgcgcccaaacactccctctccccccccttctctacttgccgccgccccccccgaccccaccctcttcctttccacccgccctcccccccccttccccgcagtctgccctcccgtttatggccgcctctcccctcccccctcttcctcccccctccccgccgtctccgtctgccccggccgcttttctccccttccgcacgccctctcatcccaccaccagatgcgccctatccgccctctttccccccttcctcctcgatggcgccgcccccctccgcccttcacgtgcccgagtacgtattccgtcccgctgcccatccaccg

SEQ ID NO: 42933 - protein, 221 aa, Zea mays
  misc_feature: Ceres CLONE 1442236-F
MDRIPVSLSSPPPPQSPRRARAPKPYALLGSLFRHLHRCLSPAADSTRLPPKSPSPVRQAPPGPPPEGAPRFSHTAPHAPHPPPPPSPQPPAGPPPAPPMKAPPPPPPLCPQPPRPNTPSPPPSLLAAAPPDPTLFLSTRPPPPFPAVCPPVYGRLSPPPSSSPLPAVSVCPGRFSPLPHALSSHHQMRPIRPLSPLPPRWRRPPPPFTCPSTYSVPLPIH

SEQ ID NO: 42934 - DNA, 638 bp, Zea mays
  misc_feature: Ceres CLONE 1442256-F
  misc_feature: Encodes the peptide sequence at SEQ ID NO. 42935
aaagctggagctccccgcggtggcggccgctctattctagtggatcccccgggctgcaggaattttcacgagaccattacctaaaacatcctaatcgaaaaatcgttgccggctgccccgcgctcccgttccccttccgcgatcaccaccactccgtcccatccctcgcctgccttcacacgggtgcgccgcccgttcaacggccacgccgcgccacgccgcgccgctcaactgccccggcaaccgcccttccttcccgagctcgggatcgacgtcacccgcacctcgcgcccgttccgggatccgcatcaggcccctccccgtccccaaccccattccgcagcaggcgaccagcacaacatcccgaaacccccgccaccccccgcacgcacaaggttattatgtctgggatggcatctgatgattcacctgcccaagtgaatgatgaatgagatgtttcagacaaacaagttgaagttcaagaccaaaatgaagtgggtgggatgccctcacgacaagaggaggaggcggcaattaagaaaaagtatcgaggaatattgcccacaaagactccgcttatatctaaggatcatgaacgtgcttactctgattctgctgattgggctctaagaaagcaa

SEQ ID NO: 42935 - protein, 45 aa, Zea mays
  misc_feature: Ceres CLONE 1442256-F
MPSRQEEEAAIKKKYRGILPTKTPLISKDHERAYSDSADWALRKQ

SEQ ID NO: 42936 - DNA, 714 bp, Zea mays
  misc_feature: Ceres CLONE 1442257-F
  misc_feature: Encodes the peptide sequence at SEQ ID NO. 42937
  misc_feature (17)..(17): n is a, c, t, g, unknown, or other
  misc_feature (83)..(83): n is a, c, t, g, unknown, or other
  misc_feature (85)..(85): n is a, c, t, g, unknown, or other
gtgtgtggttgttcttnatccccgagccgcccccggacgagggggaagggggggggggggaaaaggaaaaagggccccgcccntnccatacctggagctcaccgcggtggcggccgctctacaactagtggatcccccgggctgcagttacccgcacgagaccattacctagaacatcctaatcgaaaaattttttcctcctttccccacttcgctctgtcctcccatgcgccggattaccactgaccacttcacagtcacagtagtacagagcagcagagtggagaagtagactctaggtgagatggcggccgtggtggcggcgatggaggcaggggtggtggcggtggcaagcgggaggggatgcagcagccggctggtgcggggcctctactggggcctgcgcgcggttctgcggcggctgcggtcggagcgagccaggcgcggcaggaggttcagcttccactacgacgcgctcagctacgcgctcaacttcgaagacggccgcgccgcccccgtcccgggcccccggcgcggccgaacctcgtcccttgcccccgggggaaaacgaacggcgctacgggtgtaatcgggcgttccgacccaacccgccgccccaagaaccccagaatgggggcccctccctgtcccttggccccccggaacccccgggtttgggctcttttttctcaccctcgcgcctcggggggggcg

SEQ ID NO: 42937 - protein, 94 aa, Zea mays
  misc_feature: Ceres CLONE 1442257-F
MAAVVAAMEAGVVAVASGRGCSSRLVRGLYWGLRAVLRRLRSERARRGRRFSFHYDALSYALNFEDGRAAPVPGPRRGRTSSLAPGGKRTALRV

SEQ ID NO: 42938 - DNA, 645 bp, Zea mays
  misc_feature: Ceres CLONE 1442263-F
  misc_feature: Encodes the peptide sequence at SEQ ID NO. 42939
aagctggagctccccgcggtggcggccgctctagtactagtggatcccccgggctgcaggaatttgcacgagaccattacctagaacatcctaatcgaaaaacgcgtgatttctttcttgtctgttgtctcccggtccaccttttcaccgcccgggccttgctctccttcgacttgccttccctttccttgcacacaccaccagacgaaatcacccaagtcgcgtgcttccattcccagcccaaccgaagcgaagcacgccaccggcctcgaagggatcagcttctctagcactcatcctcgtggccttgttcctcctcttctataagggactgcgtcggagtggagatccgtgccgacatagtccgactttgtcgctcgctgcctacgattgatggcctcaccttcaccaaccgagttcagtagggaagcagctcgtcagtctctcatcgcaatctcccagaccattccggagacaccttcacccgagacggtgaaggcaccgatctccattgcagaaaacgggaagctgggcgatggggcggataagttcagatcaaagctgatgtccatcacagacctgtcttctgatgccccacctgcgcagtgccctcccgaggatattgctgcttgatcgtgtgatttt

SEQ ID NO: 42939 - protein, 79 aa, Zea mays
  misc_feature: Ceres CLONE 1442263-F
MASPSPTEFSREAARQSLIAISQTIPETPSPETVKAPISIAENGKLGDGADKFRSKLMSITDLSSDAPPAQCPPEDIAA

SEQ ID NO: 42940 - DNA, 761 bp, Zea mays
  misc_feature: Ceres CLONE 1442265-F
  misc_feature: Encodes the peptide sequence at SEQ ID NO. 42941
  misc_feature (30)..(30): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
gcgccgggtggcgcccgcgcggcgcacagncaactttccagcggcgcgcggacgtcactgggggatttnnnntatacnnnnttcatactggagctccccgcggtggcggccgctctattctagaggatcccccgggctgcaggaattcgcacgagaccattacctagaacatcctaatcgaaaaaggcggagtaagacagactctggccgggaggaaggagatcctgatctgttcttggagtggggaggcgaggagaggagaggaggaagatggcggcgcaggagcacgagcacgagcacgagcacgagaagcagcaggcgaagacgagcaccacgagctcgctcccctccagcagcgagcgctcctccagctccgcccccaacaaccttagggaaggaggcgtggagagcgacgaggagatacggcgggtgccggagctgggcggctgctgtcggcgtcggcgccggcggcggcgggcgcgggcaaggaggacggcgcgcgggcggtggcccgcgggggcgcaggggcacccccccgccgcccggaagaagcgcggccgcgccccgggggacaaggagcagaaccggctgaagcggccgccgcggaaaccggcgggccggcgcaaccagggcgcggggagcggaaagagggcgtaccctgacgggaactggagggccccgggccaaaggaaccggggagcttccgcaaaggcgcaaacctcgaggacagcgggggtggtcccccccccccaaaaaccaaa

SEQ ID NO: 42941 - protein, 163 aa, Zea mays
  misc_feature: Ceres CLONE 1442265-F
MAAQEHEHEHEHEKQQAKTSTTSSLPSSSERSSSSAPNNLREGGVESDEEIRRVPELGGCCRRRRRRRRARARRTARGRWPAGAQGHPPAARKKRGRAPGDKEQNRLKRPPRKPAGRRNQGAGSGKRAYPDGNWRAPGQRNRGASAKAQTSRTAGVVPPPQKP

SEQ ID NO: 42942 - DNA, 642 bp, Zea mays
  misc_feature: Ceres CLONE 1442271-F
  misc_feature: Translation starting site: 119
ggagctccccgcggtggcggccgctctatactagtggatcccccgggctgcaggaattcgcacgagaccattacctagaacatcctaatcgaaaacctcaccccccgtcgtcccaggcatggccccaacgagagcgctgcccgccctctggttgtccatggccgccgccgccagctatgtcgtcggagaaaagtactgcaggttgtgctatctgaagggcagttccatggtccccactatccaagcccagggcgacgtcgggctgctggaccgccgctgccttgccggctacgacttctcccacggcgacgtcgttgttttcaggtcagctgctgcgcgcagccggactctccttggcgtttcttcggttggatgggtcggccggcccgctgatgccatcccgttcgcatcgcaggttgtcgacggatcatgggatgaagatggtccagaggctgatcgcgctgccgggggattggatccagatcccggagaagcgggacatccggcaggtccccagcggccactgttgggtggaaggggacaatgccggcaacagctgggactcgagacactatggccccgtaagggcattctccctacaatcattcttagcagattttcgtcaatctgttcagtttcttt

SEQ ID NO: 42943 - DNA, 652 bp, Zea mays
  misc_feature: Ceres CLONE 1442274-F
  misc_feature: Encodes the peptide sequence at SEQ ID NO. 42944
ggagctccccgcggtggcggccgctctagatactagtggatcccccgggctgcaggaattcgcacgagaccattacctagaacatcctaatcgaaaaaaccaaaatccctcctgccttcgcttcccttccacaccttccgccctctctctctctctctctctctctctctctctctctcatcaggtcagcaggtctcgtgcgcgcccggctttcctctcctcgcgccgcacgacgcgagcgcggtcggcgatggccaaggcgcgcaggtcgccgttcgccgccgctgagcggttcctcggcttcccccgcggcgggccgtcgccgggggccgtggtgccggcgcccgccgccttcgacgacctgccggacctcgccgaggccgacgtctggtactcggccgccgccgccgccgccaccaacgacccggggagtccacgccccacggcgtccaagcaggtggaggcggtgaaagggaggcgcggccccccgcagggcggcctgacccgggcgttccgggacgggcccgggcggaaggggggggggtcggctcccttcaaggaggcccgcggggcccgccccgtttccggttcccggaaccggaacccccccccttcctttccaaaaatggaaaagggggggcccaaaaacacc

SEQ ID NO: 42944 - protein, 134 aa, Zea mays
  misc_feature: Ceres CLONE 1442274-F
MAKARRSPFAAAERFLGFPRGGPSPGAVVPAPAAFDDLPDLAEADVWYSAAAAAATNDPGSPRPTASKQVEAVKGRRGPPQGGLTRAFRDGPGRKGGGSAPFKEARGARPVSGSRNRNPPPSFPKMEKGGPKNT

SEQ ID NO: 42945 - DNA, 651 bp, Zea mays
  misc_feature: Ceres CLONE 1442275-F
  misc_feature: Encodes the peptide sequence at SEQ ID NO. 42946
aagctggagctccccgcggtggcggccgctctataactagtggatcccccgggctgcaggaattcgcacgagaccattacctagaacatcctaatcgaaaactcgtcactcacgaacgcacgaattcaccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcaacaggtcaaggggctgctgcggctggacttcgccgtcgcagcgcagaactgctgggtgcgcaagggcggcgccttcaccggcgagatcagtgctgagatgctggtaaaacctgcaggtgccctgggtcattttggggaccttctgagcgcaaagcctctgtgggtgaaacccggtgatttttgttgctgaataaagttgcattatgcccctcactcaagggcctccagggtaattgccttgcctttggggaaaaccccttggagccaaaaagagggccgggaaccacacaatgggaatgttggttg

SEQ ID NO: 42946 - protein, 113 aa, Zea mays
  misc_feature: Ceres CLONE 1442275-F
  misc_feature (6)..(112): Pfam Name: TIM Pfam Description: Triosephosphate isomerase
  misc_feature: SWISSPROT Homolog: EC 5.3.1.1 Triose-phosphate isomerase
MASRKFFVGGNWKCNGTGEDVKKIVTVLNQAEVPSEDVVEVVVSPPFVFLQQVKGLLRLDFAVAAQNCWVRKGGAFTGEISAEMLVKPAGALGHFGDLLSAKPLWVKPGDFCC

SEQ ID NO: 42947 - DNA, 731 bp, Zea mays
  misc_feature: Ceres CLONE 1442276-F
  misc_feature: Encodes the peptide sequence at SEQ ID NO. 42948
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (20)..(20): n is a, c, t, g, unknown, or other
  misc_feature (68)..(68): n is a, c, t, g, unknown, or other
  misc_feature (69)..(69): n is a, c, t, g, unknown, or other
  misc_feature (74)..(74): n is a, c, t, g, unknown, or other
  misc_feature (75)..(75): n is a, c, t, g, unknown, or other
  misc_feature (86)..(86): n is a, c, t, g, unknown, or other
gtggattgggnnggntgtgnaacatatttctttcttctccttgtgtttttatttgtatcttcccccanntttanngtgtggccttntaatactgggactccccgcggtggcggccgctctagactagtggatcccccgggctgcaggaattcgcacgagaccattacctagaacatcctaatcgaaaatgtggattggacagacagaggtacatgcatcctttttggtgatgctgctggtgctgtgttggtacaggcatgcagcgctgatgaagatggcttgctaggtttttgtgttcaaagtgatggcaatgggcaaaaacacctaaatgccgcaacggcaaacgatgagtcaatcttgtccaataccaatggtgttcctggatttccgccaaagaaggcaacctactcatgcattcagatgaacggaaaggaagttttccgctttgctgtccgatgtgtgccacagtccattgagaaggcactccaagaagctggtttgcccgcctccagtatagactggttgttgctacatcaagcttaatcagcggattattgatgcggctgccagtcgattagatatccccgtctgacaaggtcattttcaaaatcttgcccaacttatggccaataccaggcggcggcatcccttcccggtttagccttttggattgagggcctgtctccgcagggggccaagggttgaaagggcttggccgtatatttaatttg

SEQ ID NO: 42948 - protein, 40 aa, Zea mays
  misc_feature: Ceres CLONE 1442276-F
  misc_feature: SWISSPROT Homolog: EC 2.3.1.41 Beta-ketoacyl-acyl-carrier-protein synthase I
MNGKEVFRFAVRCVPQSIEKALQEAGLPASSIDWLLLHQA

SEQ ID NO: 42949 - DNA, 661 bp, Zea mays
  misc_feature: Ceres CLONE 1442277-F
  misc_feature: Encodes the peptide sequence at SEQ ID NO. 42950
  misc_feature (661)..(661): n is a, c, t, g, unknown, or other
aagctggagctccccgcggtggcggccgctctagaactagtggatcccccgggctgcaggaattcgcacgagaccattacctagaacatcctaatcgaaaatctgttcccctcccaagaaaccccacatttgcatgggcaagcacctacctgccgccgccaccgccgccgccgccgccgcggttcgctcgtacgcccgcagccttcgcgtcccatccgataccgccgcatccgccgggagggcagataagacgccgtctgccccgctggatacgcccaggaaatccgctgccgccgctgccgcggccagctccgggcgggccgaggtgcgggatttggcggcggcgtgcgggctagaggcggacgagagggttccgctcgcggaggtggtgtcggactgcacgaggcggtggttccaggacgcactcaaggaggcgcgcgccggcgacatcaccatgcaggtgctcgtcggccagatgtaccgcagcggatacggtgtcaacaagaacgagcacaaggcaagagtttggatggagaaagcatcaagatatcggtctacagtatggaaaagtagcaaataaacgtccaggggaacaatgcccagtgactccggactcaggccccgaatgaatgctaaaggaaaacatgcaaaataaaaaaan

SEQ ID NO: 42950 - protein, 148 aa, Zea mays
  misc_feature: Ceres CLONE 1442277-F
MGKHLPAAATAAAAAAVRSYARSLRVPSDTAASAGRADKTPSAPLDTPRKSAAAAAAASSGRAEVRDLAAACGLEADERVPLAEVVSDCTRRWFQDALKEARAGDITMQVLVGQMYRSGYGVNKNEHKARVWMEKASRYRSTVWKSSK

SEQ ID NO: 42951 - DNA, 785 bp, Zea mays
  misc_feature: Ceres CLONE 1442282-F
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (48)..(48): n is a, c, t, g, unknown, or other
  misc_feature (375)..(375): n is a, c, t, g, unknown, or other
  misc_feature (432)..(432): n is a, c, t, g, unknown, or other
  misc_feature (535)..(535): n is a, c, t, g, unknown, or other
  misc_feature (544)..(544): n is a, c, t, g, unknown, or other
  misc_feature (632)..(632): n is a, c, t, g, unknown, or other
  misc_feature (633)..(633): n is a, c, t, g, unknown, or other
  misc_feature (702)..(702): n is a, c, t, g, unknown, or other
nggggtggcccnnnnncncnntcttttcccccttatttgagccccccnccccatactggggctccccgcggtggcggccgctctagaatagtggatcccccgggctgcaggaattcgcacgagaccattacctagaacatcctaatcgaaaaaactactccgtcactttgtttgccaagctcctcctcgatccatcgttgagtgttccggccggcggcaccgagctcgcaggggctagcccacgtgacggaaggaatggcggatcgtgactgtagcggtttcaatggcggcgtcaatggtagttatgggcggtaggtttatcagggaggaggagggagccccatgggtgagtcggtgaggggcatgtttcaccanaaggggtcgacggcgtcgcagggagtgatggtggttccgttgttggagcggggttgnctgcccttggggttgttgggggtggggctgagtgccccccatcccccccttgggaggggcccatccgggggtactctgaatttccactgtggagatgggaccncaaccgtcntgcccgaaatggactgcggcggcccggtgtcccccgcgaattaacggcggtgtagggtgggcatcgggaggcgtggggcttttttaanngggtggaaggggggacgctggcgagcccgagcgggtgtttgattgcccacccaaaggggaattcatacnccaggtgggtccgccaaccctcccgctatgcacgcaccagcccccgagcggttatccaccaggctgaaactatccaccacacc

SEQ ID NO: 42952 - DNA, 665 bp, Zea mays
  misc_feature: Ceres CLONE 1442284-F
  misc_feature: Translation starting site: 395
  misc_feature: SWISSPROT Homolog: EC 3.4.21.92 Endopeptidase Clp
aagctggagctccccgcggtggcggccgctctagaactagtggatcccccgggctgcaggaattcgcacgagaccattacctagaacatcctaatcgaaaaagattagtcacactcttcgcaagcacacaaaaaaaaaaaacccccaaatagcgtaaggataagcctcgccggcgacgaaatcagggtttcatcgaacaagaagatggctcacgcttgcgtctccacatcagcttcctctctcaggtttacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcctatggtgcaagagcgtttccagagtatcataagccagctcttccaatataggaattattcgttgtggtggtgctgtggatgatgatatggccaacataatcgtagctcagcttctttacctcgatgctgttgatcctactaaggatattgttatgt

SEQ ID NO: 42953 - DNA, 663 bp, Zea mays
  misc_feature: Ceres CLONE 1442286-F
  misc_feature: Encodes the peptide sequence at SEQ ID NO. 42954
aaagctggagctccccgcggtggcggccgctctagaactagtggatcccccgggctgcaggaattcgcacgagaccattacctagaacatcctaatcgaaaaaacaagaagtaaaattgcaattggaggtcacaatgggagaatccaccgtcaagctcacaatcaaattcggaggaagatcgatacctctctcggtatcacctgacgctacaaccaaagaactaaagtctcttcttcaacccatcaccaacgttcttcctcgtggccagaaactcatcttcaaaggtaaggtcttggtagagacttcgactctgaagcaatctttggtgggagatggtgcgaagattatgttaatggcttctcaaggtcttcatcaaggggaagctagtacaaggccaatatctagaactgttgtggatcagaacaaacctggtcttgttgtagacaagaaccgtgctgatcggtggaaagctacaggggttattgctttagctcaagccaatttgaaggaaatacctgaagaagtgtgggaatgtggatctgcagctagagtgcttgacgttagtgagaacttcattcgagaagtacctgttcgaatcagctcttttgtctctatgcataaactgtttcttcaagggaatggtctgtctgatgaatcaattc

SEQ ID NO: 42954 - protein, 176 aa, Zea mays
  misc_feature: Ceres CLONE 1442286-F
  misc_feature (8)..(78): Pfam Name: ubiquitin Pfam Description: Ubiquitin family
  misc_feature: SWISSPROT Homolog: EC 3.1.3.16 Phosphoprotein phosphatase
MGESTVKLTIKFGGRSIPLSVSPDATTKELKSLLQPITNVLPRGQKLIFKGKVLVETSTLKQSLVGDGAKIMLMASQGLHQGEASTRPISRTVVDQNKPGLVVDKNRADRWKATGVIALAQANLKEIPEEVWECGSAARVLDVSENFIREVPVRISSFVSMHKLFLQGNGLSDESI

SEQ ID NO: 42955 - DNA, 644 bp, Zea mays
  misc_feature: Ceres CLONE 1442289-F
  misc_feature: Encodes the peptide sequence at SEQ ID NO. 42956
aaagctggagctccccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggccc

SEQ ID NO: 42956 - protein, 118 aa, Zea mays
  misc_feature: Ceres CLONE 1442289-F
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGIAVDYG

SEQ ID NO: 42957 - DNA, 667 bp, Zea mays
  misc_feature: Ceres CLONE 1442291-F
  misc_feature: Encodes the peptide sequence at SEQ ID NO. 42958
  misc_feature (606)..(606): n is a, c, t, g, unknown, or other
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccnacctcggcgtccgcggctcctagccgggccgccctgagccgccgccgcgccgcgccgtcgc

SEQ ID NO: 42958 - protein, 113 aa, Zea mays
  misc_feature: Ceres CLONE 1442291-F
  misc_feature (102)..(102): Xaa is any aa, unknown, or other
MLLTSCRQGRGMASLSCARADGVVRSGALPAKLLLCASCCFPTAAPVADGEVQVLACRQHLHRLPRRQDLRRQRPRRRHPQLVGLHQQPRQRGLVAVQRRVXPRRPRLLAGPP

SEQ ID NO: 42959 - DNA, 504 bp, Zea mays
  misc_feature: Ceres CLONE 1442315-F
  misc_feature (196)..(196): n is a, c, t, g, unknown, or other
  misc_feature (215)..(215): n is a, c, t, g, unknown, or other
  misc_feature (216)..(216): n is a, c, t, g, unknown, or other
  misc_feature (356)..(356): n is a, c, t, g, unknown, or other
caaagctggagctccccgcggtggcggccgctctagaactagtggatcccccgggctgcaggaattcgcacgagaccattacctagaacatcctaatcgaaaagtcaatgcaagtttgtccattcgcattggtctgaatactgtagctactagcgcgagtgccactgtgccgcagctgcctgctcgccataactgncagctgtgtcatcaagctnnatagctcctcactctgatcactagtactagcagactacgaaggcgtgcagatcagaaaaatgcaggggctactactgaccctgcacaaaaatgccgaatgcagacatggggcccctccgggccacccaaaggaataccgnatggttccggtgtgactgacccttttaaggggaaccatccccgggggggaaaggcgattttttttcggggtcccccccgccccgggggggggcgcccaagtggggggggcccatgggggcggggggcccaaaaatggtgcccacaacc

SEQ ID NO: 42960 - DNA, 659 bp, Zea mays
  misc_feature: Ceres CLONE 1442325-F
  misc_feature: Encodes the peptide sequence at SEQ ID NO. 42961
tggagctcaccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcaagcatggcattcatgctgatggtcagatgcccggtgacaagaccattgggggaggtgatgatgctttcaacaccttcttcaatgagactggcgctgggaagcacgtcccccgtgctgtttttgttgaccttgagcccactgtcatcgatgaggtgaggactggcacctatcgccagctcttccatcctgagcagctcatcagtggcaaggaggatgcaaccaacaacttcgctcgtggtcactacaccattgccaaggagattgttgacctgtgccttgaccgcatcaggaagcttgcagaatattgcactggtctccagggcttcctcgtcttcaacgctgttggtggaggaacg

SEQ ID NO: 42961 - protein, 145 aa, Zea mays
  misc_feature: Ceres CLONE 1442325-F
  misc_feature (49)..(145): Pfam Name: Tubulin Pfam Description: Tubulin/FtsZ family, GTPase domain
MRECISIHIGQAGIQVGNACWELYCLKHGIHADGQMPGDKTIGGGDDAFNTFFNETGAGKHVPRAVFVDLEPTVIDEVRTGTYRQLFHPEQLISGKEDATNNFARGHYTIAKEIVDLCLDRIRKLAEYCTGLQGFLVFNAVGGGT

SEQ ID NO: 42962 - DNA, 674 bp, Zea mays
  misc_feature: Ceres CLONE 1442326-F
  misc_feature: Encodes the peptide sequence at SEQ ID NO. 42963
  misc_feature (462)..(462): n is a, c, t, g, unknown, or other
  misc_feature (481)..(481): n is a, c, t, g, unknown, or other
aagctggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgccgcgggcgggaccgactatgggacggacgacagctagatctcccccgacgagatcctcttcgagggctgcgactacaaccactggctcatcaccatggaacttcccggacccaaagccgtcncgcgaagagatgatcgagnacatacctccagactctcgccaaggtcgccgggaagttatgagggagcccaagaaagggatgtatgcttttaatacaacaaattatggttggttttcaggctggaatggacccaaggaattgccaaaaaaatttccgggtttgcccgggagaaaattttcattttgcccggatccaattttttttccaaaaac

SEQ ID NO: 42963 - protein, 77 aa, Zea mays
  misc_feature: Ceres CLONE 1442326-F
MALALRLRRVLAAASTAAPLLRPSTSVARPCPLVPLASPVAPLPLPPWRFLPGGGAGFRSTAAAAAAGGTDYGTDDS

SEQ ID NO: 42964 - DNA, 667 bp, Zea mays
  misc_feature: Ceres CLONE 1442327-F
  misc_feature: Encodes the peptide sequence at SEQ ID NO. 42965
aaagctggagctccccgcggtggcggccgctctagaactagtggatcccccgggctgcaggaattcgcacgagaccattacctagaacatcctaatcgaaaaagaccaccactgcgccattggccagctagagccaaccagaagagcttgcagttactgagagtgtgtgtgagagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgcccaaggagcacgggcccaagccggagaagccgcccaaggagcacaagccgacgccgcccacgtacaccccgagccccaaacccacgccgccgacgtacactcccaccccgacgccccccaagccgacgccacccacatacactcccgcccctacgccccacaaacccacaccaaaacccactcccactcctccgacgtacaccccgacccccaagcctccgacacctaagccgaccccgccgacgtacactccaagccccaaacctccgacgcccaagccgaccccaccgacgtacaccc

SEQ ID NO: 42965 - protein, 162 aa, Zea mays
  misc_feature: Ceres CLONE 1442327-F
MGGSGRAALLLALVVVAVSLAVEIQADAGYGYGGGYTPTPTPATPTPKPEKPPTKGPKPDKPPKEHGPKPEKPPKEHKPTPPTYTPSPKPTPPTYTPTPTPPKPTPPTYTPAPTPHKPTPKPTPTPPTYTPTPKPPTPKPTPPTYTPSPKPPTPKPTPPTYT

SEQ ID NO: 42966 - DNA, 667 bp, Zea mays
  misc_feature: Ceres CLONE 1442335-F
  misc_feature: Encodes the peptide sequence at SEQ ID NO. 42967
aagctggagctccccgcggtggcggccgctctagaactagtggatcccccgggctgcaggaattcgcacgagaccattacctagaacatcctaatcgaaaaactcgctctctcccctctggctctgagtggcgctagtgggcgaccgccgccgcgtccctccgtcaggtgcccaggtgtagcctcgtcggcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaagaaacttatt

SEQ ID NO: 42967 - protein, 133 aa, Zea mays
  misc_feature: Ceres CLONE 1442335-F
MSVLTCVIESMGSSCSRSHSFDEAEAAENAKSADIDRRILQETKAEQHIHKLLLLGAGESGKSTIFKQILYEGAKELAQVEPDSSKYVLSPDNQEIGEKLSEIGARLEYPSLNKERVQDVRKLWQDPAIQETY

SEQ ID NO: 42968 - DNA, 655 bp, Zea mays
  misc_feature: Ceres CLONE 1442350-F
  misc_feature: Translation starting site: 285
  misc_feature: SWISSPROT Homolog: EC 2.7.7.27 Glucose-1-phosphate adenylyltransferase
aagctggagctccccgcggtggcggccgctctagaactagtggatcccccgggctgcaggaattctctcaaaaccgatacctacttcctgcaattcgaaaaatatgatgcccataactattcctaccgggcatcaatggcgatttacgtctccaacaaagatgcgcttttcgacctctctcaagtcaaaacatactctattacttgactttggatctgaaatcctccccagagctgtactacatcataacgcgcaagaatgcgtttttaccgactattgctagcatgttcgaacaatcaaatcattctttgatgcaaacttggacctcactaaacaaccttccaagtttgatttttacaatacaaaaacacctttcttcactgcaccccgatgcttgcctccgacgcatgtggacaattgcagcaagaagtatgcatttatcacagcatggttgcttactgagagaatgcgacatcaaccattctgtgatgggactctgctcacgggtcggctctggatgtgaactcaaggactccgtgatgatgggaccggacatctctgaaactgaataataagcttcccagctactgatagctgggaaggtcccaattggaactggaaggaacaccaagataaggaactgtgtcattgacat

SEQ ID NO: 42969 - DNA, 750 bp, Zea mays
  misc_feature: Ceres CLONE 1442357-F
  misc_feature: Encodes the peptide sequence at SEQ ID NO. 42970
  misc_feature (10)..(10): n is a, c, t, g, unknown, or other
  misc_feature (41)..(41): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (561)..(561): n is a, c, t, g, unknown, or other
tgtgttgggnttccccccttcatcttgcctacggggtcggnggttgggnnnntaacatgggactccccgcggtggcggccgctctagaatagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggtcccgcgcacaagcgctcgacggcggccaactcgtaccggctggtgctgctggaaccggccgagggacgggggaacgncgctgccgcccccgccctgggccaagccagagcctggcctctgttctggccgggtggcccgccgccctggaacgggcggcgggcaaggggaaagaaaaaaggcttgctgggggggtgggtccggcgcttgggaaaccccggaaaaacgggggggccccaaaaggagacaccgggtggcccccgctaaaa

SEQ ID NO: 42970 - protein, 163 aa, Zea mays
  misc_feature: Ceres CLONE 1442357-F
  misc_feature (3)..(50): Pfam Name: F-box Pfam Description: F-box domain
  misc_feature (102)..(102): Xaa is any aa, unknown, or other
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRGNXAAAPALGQARAWPLFWPGGPPPWNGRRARGKKKGLLGGWVRRLGNPGKTGGPQKETPGGPR

SEQ ID NO: 42971 - DNA, 647 bp, Zea mays
  misc_feature: Ceres CLONE 1442361-F
  misc_feature: Translation starting site: 339
  misc_feature: SWISSPROT Homolog: EC 1.2.1.12 Glyceraldehyde-3-phosphate dehydrogenase (phosphorylating)
aaagctggagctccccgcggtggcggccgctctagaactagtggatcccccgggctgcaggaattcgcacgagaccattacctagaacatcctaatcgaaaaatgggtaattcctcgctcccggattcagcgtcgggtttctctctctctctctacaattatcactacctgctgctccctcatgcaccgtgctcaaatctgaccaaagtggttctgctgactgttttttgtgtttttttggggtctctcgatcttctctggatgcaggcaaattaagatcggaatcaacggcttcggaaggatcggcaggctcgtggccaggtcgccctcagagcgagatgtcgagctcgtcgccgtcaacgacccctcatcacacggactacatgacctacatgttcaagtacgacaccgtccacgccactggaagcacagcaacattccctcagggatccaagacccttctcttcggggacaacccggtcaccgtctttggcttcaggaaacctgaagaaaatcccggggggaagcttggccctaaaaattccgggaatccaccggggtttttccttaaaaaaaaagggttgttcccttcccagggggggccaaaaaagttttttttttccccacaaaaaaaccccccttttttg

SEQ ID NO: 42972 - DNA, 656 bp, Zea mays
  misc_feature: Ceres CLONE 1442362-F
  misc_feature: Translation starting site: 219
aaagctggagctccccgcggtggcggccgctctagaactagtggatcccccgggctgcaggaattcgcacgagaccattacctagaacatcctaatcgaaaaataattgagcatcgcagagatgggcgtcttcgtagtcgcctacctcggcggttcaaacctttccgccttcgcgcaattccttccggcggccgccgctcgacccgtacgacgacaccatgagggagtgcatttcgatccacatcgaccaggccggtatccaggtcggaaacacgagcggggagctgtactgccttgaacatggaattcgggctgacggtcagatgaccggtgacaagaccattgggggaggtgatgatgctttcaacaccttcttcactgagagtggtgctggaaaggacgtgccccgtgctgtttttgttgacgcttgaacccgctgtcatctatgaggtgagaaatggaatctaccggcaggtcttccaccctgagcaactcatcagtgggaaggaggatgcatccaagaactttggccgtggtcactacaccattgggaaggagattgttgacctgtgccttgatcgcatcaggaagcttgccgacaactgcactggtctccaaggcttcgtcgccttcaaggctgctgctggaggaacggc

SEQ ID NO: 42973 - DNA, 655 bp, Zea mays
  misc_feature: Ceres CLONE 1442365-F
  misc_feature: Encodes the peptide sequence at SEQ ID NO. 42974
ggagctccccgcggtggcggccgctctataactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtgcccttgctgctgctggtcctgggcgtgctggtgtcgtgctccttcgcggcgggcagcttggaccaggagctggacatcacgtggggcgacgggcggggcaaggtcctggacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcatggcggcgcgcacgacgagatcgacttccagttcctgggcaacgtgtccggtgagccctacacgctgcacaccaacgtgttcacgcgggggcaggggcagcgggagcagcagttccgcctctggttcgaccccaccgccgacttc

SEQ ID NO: 42974 - protein, 144 aa, Zea mays
  misc_feature: Ceres CLONE 1442365-F
  misc_feature (28)..(144): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MATSSRRVPLLLLVLGVLVSCSFAAGSLDQELDITWGDGRGKVLDNGRLLTLSLDRTSGSGFQSRHEYLFGKIDMQLRLVPGNSAGTVTAYYLSSHGGAHDEIDFQFLGNVSGEPYTLHTNVFTRGQGQREQQFRLWFDPTADF

SEQ ID NO: 42975 - DNA, 694 bp, Zea mays
  misc_feature: Ceres CLONE 1442375-F
aaagctggagctccccgcggtggcggccgctctagaactagtggatcccccgggctgcaggaattcgcacgagaccattacctagaacatcctaatcgaaaagcttcatgccctacctaatcccggcgagtggcaacatatgaggcaatctcatgtctccgcccctcgctggagcagatcgttgcccacccgacgtggatctgctgcggtaaacagctagcggatcctgcgagctagcttgatccgtccgcactcccatcgggatcgatgagtgggaacgcgcctgacccgcgtaggctgacccgggcgcttaagcatcagccgcatcgacgaggaatgggttccgaagaacatcctgcagctcttgatggggttcgtcaaggaccctccctatcgtcaggacgggtcgctgccgagtcccaggtggtacagcttccacgcagatctcccgtcagcgctgacggagcccttctgctacgacgtttccccagtgctgctgctccgacggttccacgcgactccgagttcactcgcggtggaacgggtaaccaccggcgcgcccatgttaagggcatcttcccttaagtattggggggccttgacgcccctccttttggggtccccaaatctcccccgcgcccccttccagttgccctccaggggattttccaccctccttgacgccctgggtccc

SEQ ID NO: 42976 - DNA, 655 bp, Zea mays
  misc_feature: Ceres CLONE 1442382-F
  misc_feature: Encodes the peptide sequence at SEQ ID NO. 42977
aagctggagctccccgcggtggcggccgctctagaactagtggatcccccgggctgcaggaattcgcacgagaccattacctagaacatcctaatcgaaaaaccggaggaaggaagtgagaagaccagaaggtgactaagagagatagagagtgtgtgtgatcggtacaaggatcaccgatgtgcctgcgcgtgctgcttcaccgaatcgagtcagatcctgtccgaatcccagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattgcaacgggctttgggcatatcgcaattgctaatgatgatgtgtacaagttagctgagaatatcaaatccaagggtggtaagatcacccgcaaaacatgctcctgtcgagggaggatccactgttattgccttcgcacaggatcc

SEQ ID NO: 42977 - protein, 138 aa, Zea mays
  misc_feature: Ceres CLONE 1442382-F
  misc_feature (24)..(132): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MATGSEASKAAEAVVDWHKHDSKRMLHAVYRVGDLDRTIKYYTECFGMKLLRKRDVPDEKYTNAFLGFGPENTNFAVELTYNYGVDKYDIATGFGHIAIANDDVYKLAENIKSKGGKITRKTCSCRGRIHCYCLRTGS

SEQ ID NO: 42978 - DNA, 628 bp, Zea mays
  misc_feature: Ceres CLONE 1442395-F
  misc_feature: Encodes the peptide sequence at SEQ ID NO. 42979
aaagctggagctccccgcggtggcggccgctctagaactagtggatcccccgggctgcaggaattcgcacgagaccattacctagaacatcctaatcgaaaacatttcgctagctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgagtgggcgtggtggttcctccttcggcagtggctttggtgctggctctgatgtccgccctggtgacaggaactgctcctgcgacgcacacaacttcgccagccgatccaactgcttcaggtgctctgcctacaaggaggaggctgccggcgcctttgatagtgacatgtcacgctcacgcggctacgccggcttcggcagcagcgctgccgcccgtaccaaccgccccggttgaaagtctggagactggatctgcaccaggtccggatgcaacgagcacaacttcactagcaggatggaatgtctcaggtgcaacgcgccacaggact

SEQ ID NO: 42979 - protein, 120 aa, Zea mays
  misc_feature: Ceres CLONE 1442395-F
  misc_feature (4)..(33): Pfam Name: zf-RanBP Pfam Description: Zn-finger in Ran binding protein and others
MNRKPGDWDCRACQHLNFSRRDACQRCSEPRGVGDRSGGGGDLSGRGGSSFGSGFGAGSDVRPGDRNCSCDAHNFASRSNCFRCSAYKEEAAGAFDSDMSRSRGYAGFGSSAAARTNRPG

SEQ ID NO: 42980 - DNA, 650 bp, Zea mays
  misc_feature: Ceres CLONE 1442397-F
  misc_feature: Encodes the peptide sequence at SEQ ID NO. 42981
aaagctggagctccccgcggtggcggccgctctagaactagtggatcccccgggctgcaggaattcgcacgagaccattacctagaacatcctaatcgaaaaactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcacacgcgctgacggtggcaacactgttcccgctgggcgggctgctgctggtgctgtcggggctggcgctgacgcttatcgatggtggggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaggcgcaccgcaggatggcggaggccgcggcgcacgcgggcc

SEQ ID NO: 42981 - protein, 152 aa, Zea mays
  misc_feature: Ceres CLONE 1442397-F
  misc_feature (44)..(151): Pfam Name: Oleosin Pfam Description: Oleosin
MADRDRSGIYGGAHATYGQQQQQGGGGRPMGEQVKGMLHDKGPTASHALTVATLFPLGGLLLVLSGLALTLIDGGGLAVATPVFLIFSPVLVPAALLIGTAVMGFLTSGALGLGGLSSLTCLANTARQAFQRTPDYVEEAHRRMAEAAAHAG

SEQ ID NO: 42982 - DNA, 640 bp, Zea mays
  misc_feature: Ceres CLONE 1442399-F
  misc_feature: Encodes the peptide sequence at SEQ ID NO. 42983
  misc_feature (607)..(607): n is a, c, t, g, unknown, or other
  misc_feature (640)..(640): n is a, c, t, g, unknown, or other
ggagctccccgcggtggcggccgctctagaactagtggatcccccgggctgcaggaattcgcacgagaccattacctagaacatcctaatcgaaaaaccccgacggtgaattccccattcacatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcaggcagcagtgcgtccaggcttgcgagcgccggcgacagcagcgcgacggcagccgtgactccaacgtcgacgaggacgacagcgaccggcggtgccagatgacatgccggcgccacatcgatcggcaagcgaagcagtggtgcgtgcagcgctgcgagcgtccgcaacaggaggaagacgccgccgccgacgacgacnacagcggccggtgccagaagagatgccagcacn

SEQ ID NO: 42983 - protein, 92 aa, Zea mays; identical to SEQ ID NO: 24023
  misc_feature: Ceres CLONE 1442399-F

SEQ ID NO: 42984 - DNA, 605 bp, Zea mays
  misc_feature: Ceres CLONE 1442403-F
  misc_feature: Encodes the peptide sequence at SEQ ID NO. 42985
tggagctccccgcggtggcggccgctctagaactagtggatcccccgggctgcaggaattcgcacgagaccattacctagaacatcctaatcgaaaaaaagcacctcgcacgatcgccttcgccaagcgcgccgctctctctctatttctctctcgcacgagccgcgccggagccgccaccacgcgcgcgggagacagagaccgcagccgcagccaccgacgggcggaatacgaatggcggggccggggggaggagcacgaggaggacctttgcatctggccggcggcggatgagcatgacactggacggaataaggcggcggacattagtggaatggatgaacaacacgtaatggctgctgcttgcccctacataatttggcctttgggggctcatattgatcatcacggagtgatactcgcgcccatgaccataagttaaggaggactccttggtttctatccatctgatgggtctgagcaacctctattgttcctgcaggggttactgtcattctggccagccggaacgggcgaaaagatgcagactggatgacttgcaaaacccgattgataaacctgaaaacctatacgggggaaggaag

SEQ ID NO: 42985 - protein, 146 aa, Zea mays
  misc_feature: Ceres CLONE 1442403-F
GAPRGGGRSRTSGSPGLQEFARDHYLEHPNRKKAPRTIAFAKRAALSLFLSRTSRAGAATTRAGDRDRSRSHRRAEYEWRGRGEEHEEDLCIWPAADEHDTGRNKAADISGMDEQHVMAAACPYIIWPLGAHIDHHGVILAPMTIS

SEQ ID NO: 42986 - DNA, 647 bp, Zea mays
  misc_feature: Ceres CLONE 1442413-F
  misc_feature: Encodes the peptide sequence at SEQ ID NO. 42987
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaatcgcgtgttggccgtaccgctctgttcctccgtcccctcctccttccggctctcgctgtcacatgtcttgtggtatgggggctctctgatccccatggtgcaccgccgcgggatcgaccacggcaatgattgatcgcgaacgagcacaggacatgtacgttaatagtgaggcacctctcgggtgcttccccccaaatatttctctctataactctccagagaagataattggtgttgaaggttttcctgaaaataatgaaaaagcgaatgatattgttgctgctgaaaaaatctggtaggcgactccaaaccatggccttagctcgtccatctaccaacaacaattttatgcctgcccatatatttattcacattatcaaatcgtgcctcagccactaccttaaggttttgatgaccaattttatcacataaatagggaccacgctttcactattgagaacacgggtcaatatcttcgctgcaagatgctccactcaagtcacccccatgatgcacagcttcaggaattgcgtattttctggtn

SEQ ID NO: 42987 - protein, 57 aa, Zea mays
  misc_feature: Ceres CLONE 1442413-F
MIDRERAQDMYVNSEAPLGCFPPNISLYNSPEKIIGVEGFPENNEKANDIVAAEKIW

SEQ ID NO: 42988 - DNA, 646 bp, Zea mays
  misc_feature: Ceres CLONE 1442415-F
  misc_feature: Encodes the peptide sequence at SEQ ID NO. 42989
aaactggagctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctcaaaagcacacggctccctctggtttcccgcctcctcttcacctccttcgcgtcccgacgctccctcatggccgccgctgccgcagcagcagcagcagtttcctccccgattgctccacgcgctgtggccgccgcgacctcccgccgggggttcgtcacgtttggtggaggcgccgcccgctcctcgcccacgctgcggaccgagccgcagattctctggtgtgcaaacccatgttgccgctgttgaacaagcagttgtaaaagatgctacgaagctggaagctccagttgttgttgttacaggtgcctctacagggattggaaaggcaactgctctagcccttggaaaagcaggatgcaaggttctggtaaattatgctcggacttcaaaagaggctgaagaggtctccaaagacatacaagcatctggcggtgaggctctcacctttggaggagatgattcaaaagaagctgatgtagactctatgat

SEQ ID NO: 42989 - protein, 214 aa, Zea mays
  misc_feature: Ceres CLONE 1442415-F
  misc_feature: SWISSPROT Homolog: EC 1.1.1.100 3-oxoacyl-[acyl-carrier-protein] reductase
TGAPRGGGRSRTSGSPGLQEFARDHYLEHPNRKILLRIRVPSRLQKYSACISKAHGSLWFPASSSPPSRPDAPSWPPLPQQQQQFPPRLLHALWPPRPPAGGSSRLVEAPPAPRPRCGPSRRFSGVQTHVAAVEQAVVKDATKLEAPVVVVTGASTGIGKATALALGKAGCKVLVNYARTSKEAEEVSKDIQASGGEALTFGGDDSKEADVDSM

SEQ ID NO: 42990 - DNA, 654 bp, Zea mays
  misc_feature: Ceres CLONE 1442426-F
  misc_feature: Encodes the peptide sequence at SEQ ID NO. 42991
aagctggagctccccgcggtggcggccgctctagaactagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagcgacggcaggcatggtgagccgtgaaaatttgcacctggtgctggacccggcgtctctgggcgcgccttgggccgacccgtccgccgcagagatcccgccgcagctcctcgccgcgctgggagagtacctctcctccgcccgcggcgacgtcgagacggaggcggacgacgagttcatgatgcacgagttcaaggtgcggcggtgcgcgcgcgcgcggagccacgactggacggcgtgcccctacgcgcacccgggggaggccgcgcggcggcgggacccgcgccgcgtggcctacgcgggggagccgtgcccggacttccggcgccgcccgggcccgggcgccgcgtgcccgcgcggggccgcctgcccgctcgcgcacggcaccttcgagctgtggctccaccccgtccgctaccgcacgcgcccctgccgcgcgggcgctgcctg

SEQ ID NO: 42991 - protein, 145 aa, Zea mays
  misc_feature: Ceres CLONE 1442426-F
  misc_feature: The sequence is a functional homolog of SEQ ID NO 324 in the 10/666,642 US patent application
MVSRENLHLVLDPASLGAPWADPSAAEIPPQLLAALGEYLSSARGDVETEADDEFMMHEFKVRRCARARSHDWTACPYAHPGEAARRRDPRRVAYAGEPCPDFRRRPGPGAACPRGAACPLAHGTFELWLHPVRYRTRPCRAGAA

SEQ ID NO: 42992 - DNA, 872 bp, Zea mays
  misc_feature: Ceres CLONE 1442442-F
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
ggcaagggggggattgccgggattcgtattgcgcccttcgggtgggggtggggggggggcaccccccgtgaaaaaannnnnnnaaaaactggagctccaccgcggtggcggccgctcttcactagtggatcccccgggctgcaggatatcgcacgagaccattacctagaacatcctaatcgaaaagattgggtccaacaccagccgccgccatgtcgaagcgaggcaggggaggttcggcggggaacaagttccgcatgtcgctgggtctgccggggttttgccccgccgaaccgggtggaaaacctgggcgccggggaaaccaaacccacccggggggggggggccccccacacaagggaaaaagccccgcccctcgcccgggggatgggtgggccgttgtggctacgccccctctcccgggggctacgccacccggagcgagcgcgcggacggcgaggggacgaggtagcagcagcgttggcggtcgagggcggctcccccggcaggagtccgccctgggaccggcgccccgtcaccccccggcccacccccatgcagacgcgcatccgcggccacgctaggcgaccccgccaactcattaggcgctgtctagcccgacatcggaggccgccgggtggggccgcacaagtgggtcgacgtggcctggacacggcgcgagtgcaagtaaacgccctgtcccccagtgtgagggcccggctatgggcgggtcacacggtgggctaacaccgccctggcgcacctttcgtcgctgtgtctttcccctctgcctcccggcgcccgcctcacccgctggtcctcgtgggggcttaccaccctcccccagctggtttccccggggcggtctgccc

SEQ ID NO: 42993 - DNA, 609 bp, Zea mays
  misc_feature: Ceres CLONE 1442445-F
  misc_feature: Encodes the peptide sequence at SEQ ID NO. 42994
tccccgcggtggcggccgctctagaactagtggatcccccgggctgcaggaattcgcacgagaccattacctagaacatcctaatcgaaaaaaaagccaggaactccaaaggtccgagtttgggttcggaagccaacccacaccactccaccacaccctactcgagcgaagcgagccagcaatggtgcatcgcagccgtgggccgtgaccggcgtcgccggagactggaacaacaatggctgtcgtggcgcgcgccggtcttgcgatgcccccagcagttgtgccggcggcggcggccgcggccgcggcggaggaggagatgcggtggcggcagctagacagcggcgtgagcgcggtgtcgttcgggttcgtggccaccgccatcctcgtgtccatgttcctcgccatggccatcctcgagcacttccttcgccccccggcccacatgctcgggcacgcgccgccccgggggatccgccgccgactccgcttcttcctcggccgcggcggtgagcgtggcgacgcccccggctcggatctcgaggcggcgaggaagctccaaggccacgcgcccctcgagatacctgtctatcccaaaggcgtctcggt

SEQ ID NO: 42994 - protein, 124 aa, Zea mays
  misc_feature: Ceres CLONE 1442445-F
MAVVARAGLAMPPAVVPAAAAAAAAEEEMRWRQLDSGVSAVSFGFVATAILVSMFLAMAILEHFLRPPAHMLGHAPPRGIRRRLRFFLGRGGERGDAPGSDLEAARKLQGHAPLEIPVYPKGVS

SEQ ID NO: 42995 - DNA, 733 bp, Zea mays
  misc_feature: Ceres CLONE 1442448-F
  misc_feature: Encodes the peptide sequence at SEQ ID NO. 42996
  misc_feature (65)..(65): n is a, c, t, g, unknown, or other
  misc_feature (66)..(66): n is a, c, t, g, unknown, or other
  misc_feature (733)..(733): n is a, c, t, g, unknown, or other
ccgccccgcccggcgggttttcccatgaggcggccctcctgcgctcccctgtcccccaccccctnntaaataccccccaaaagtggagctcaccgcggtggcggccgctctttcactagtggatcccccgggctgcaggatctcgcacgagaccattacctagaacatcctaatcgaaaaattagctcagacatggttctcggcctctacaccttcgccgacatcgacgccgacggagcaccccgcctcgaggttgccgatggcgaggagttcgtccgtgtcgatcgcgttgtcgagcttgccctcggtccccgggtgctgaaggcccctggaaccctttacctcaccaccaggagggtgatttgggtcagcgatggcggcgagggctacgctgtggacttcgttgccatctcgctccacgccgtgtcgcgtgatcccgaggcgtatccatacccctgcatctacacacagatcgagacggaagctatttctgacgaggagtctgatatgtcagattctgaaaaaaatggagaactcgagctctcaaaagttatggaaatgcgcatcataccttcagaccctggtgaattggaggaactcctttgaagcattctgccaattgcgcctgactttaacccctgatccctagtggctgagagtggaggaaacaacattggcctgggtttcaatgggcgattgaggggttaacggaagcattccgcgtacgatgggn

SEQ ID NO: 42996 - protein, 137 aa, Zea mays
  misc_feature: Ceres CLONE 1442448-F
  misc_feature (44)..(119): Pfam Name: ICln_channel Pfam Description: Nucleotide-sensitive chloride conductance regulator (ICln)
MVLGLYTFADIDADGAPRLEVADGEEFVRVDRVVELALGPRVLKAPGTLYLTTRRVIWVSDGGEGYAVDFVAISLHAVSRDPEAYPYPCIYTQIETEAISDEESDMSDSEKNGELELSKVMEMRIIPSDPGELEELL

SEQ ID NO: 42997 - DNA, 614 bp, Zea mays
  misc_feature: Ceres CLONE 1442455-F
  misc_feature (180)..(180): n is a, c, t, g, unknown, or other
  misc_feature (181)..(181): n is a, c, t, g, unknown, or other
  misc_feature (186)..(186): n is a, c, t, g, unknown, or other
  misc_feature (190)..(190): n is a, c, t, g, unknown, or other
  misc_feature (200)..(200): n is a, c, t, g, unknown, or other
  misc_feature (201)..(201): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (234)..(234): n is a, c, t, g, unknown, or other
  misc_feature (241)..(241): n is a, c, t, g, unknown, or other
  misc_feature (242)..(242): n is a, c, t, g, unknown, or other
  misc_feature (260)..(260): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (386)..(386): n is a, c, t, g, unknown, or other
  misc_feature (504)..(504): n is a, c, t, g, unknown, or other
ggagctccccgcggtggcggccgctctagaactagtggatcccccgggctgcaggaattcgcacgagaccattacctagaacatcctaatcgaaaagatcgtggttgcgccatccctcactctcctccgaagccatcgtccacgtcccagcctccccggactctaggggcagaagctgcnnagcgntcgnagtatgggtnngaaggcgcgcgccacggggnnnnggnnnnnccnaaaaagnncccccgccgggtgggggnaaaaggggggccctttccccccctttttaaaaaaaaaaaaccnnnnnnnttttccggggaccgtccttggatcaagcggtccaagtcgaaccagtacgagactacgttcgctgggtggcagatcgnaggggggggtgaaaacacccaaagggaagggaaccgttccgccgggtggggtaacttggcgggggaaaagccgggaaagtggcccccttaaatttcctaaaacaaaagaggggccccnaggggaacccggagagagcagggggggcccccccaactaacccgctttgggaattctggggggggcaaaagggtccccccccccgccccccccgcaattggggggaaaaa

SEQ ID NO: 42998 - DNA, 608 bp, Zea mays
  misc_feature: Ceres CLONE 1442472-F
  misc_feature: Encodes the peptide sequence at SEQ ID NO. 42999
tggagctccccgcggtggcggccgctctagaactagtggatcccccgggctgcaggaattcgcacgagaccattacctagaacatcctaatcgaaaaaaattagacggataatatcgtcctccgcgggacaaggcacctcacgagcccttctcgtcctcagatctagcgcctccttcaccctgctgctggccggcgagctcctcagcgtgcaagatcaggaagaagacaaaaaaacgttatagtgaagaggaggggttgattgctgcattcaaaagtgtcggggataccttatccaatgctactgagaaggttgccacaggggacaccagatgatcttttttgatagtttgataaacctttcaggttttgagcagacccacatatctctgtatttcaattatctggtggcgcaccctcacattgctagagccttcaacaagttgccattcgaccacaagttaatctgggctcgcaatttcgtcagtgaaaagtttctaggagtgtgagggcagttggtaggtaggcttggagggttcttttgcttgaaccacattgaacaatgaactgtgatctatgtgtaaccaggagtgtgagggcagttagtaga

SEQ ID NO: 42999 - protein, 58 aa, Zea mays
  misc_feature: Ceres CLONE 1442472-F
MIFFDSLINLSGFEQTHISLYFNYLVAHPHIARAFNKLPFDHKLIWARNFVSEKFLGV

SEQ ID NO: 43000 - DNA, 861 bp, Zea mays
  misc_feature: Ceres CLONE 1442481-F
  misc_feature: Encodes the peptide sequence at SEQ ID NO. 43001
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
gccccttgttccccgcctctttttccgtgtgcgcgcgctccgcgcctcggcggggtgttgggtgtnnnanccctgggccccccccgaaaactggaactcaccgcggaggcgggcgctcatccccaagtggatcccccggggtgtaggttctcccacgagaccattacctagaacatcctaatcgaaaactcacccatctatcgagttaggactgccagatcctgacctgcccgactctcgctcgtcggttggatctttcccataggaacgcacggtgctagttcccagtgcagcgcgactatatggaggcaaagagggcggccgcggaggggctcaggaagaccgacgctggcggagacaacgacacgcatacggaagggggagatgggggcccgaaggcccgctgaaggaaggaggagggtgaaaaccgccgaagggcgggcgggaagcgccctctcgcccggccggggacaacaaagagggaagcggcggcggccgcaaccccgcgagggacgcacggggcgcgccgtgaggcgccaaaccggggcctccggggcccacccacaagggggccgcccccggcccgatccccgccgtttgccgcagcgcgaaaaccccgccgggggttgtaacgccggcgggtgctgttgcccgcgcgagacgcggccccgccgggggcgggcggcgccgcgaggctccgtgggcggtcggggaggctcgccccccccccccgcgacaccgaggagagtagcgcgcgccccggcgccaccgtgtccgggggtgtgcgccctccgcgggacgaaagcggcgggcgcggacgacccggccgcggtggccggccgggccgcgcacaagtccgcg

SEQ ID NO: 43001 - protein, 34 aa, Zea mays
  misc_feature: Ceres CLONE 1442481-F
MEAKRAAAEGLRKTDAGGDNDTHTEGGDGGPKAR

SEQ ID NO: 43002 - DNA, 632 bp, Zea mays
  misc_feature: Ceres CLONE 1442483-F
  misc_feature: Encodes the peptide sequence at SEQ ID NO. 43003
  misc_feature (418)..(418): n is a, c, t, g, unknown, or other
aagctggagctccccgcggtggcggccgctctataactagtggatcccccgggctgcaggaattcgcacgagaccattacctagaacattctaatcgaaaaactgcggcttcaggactcgacctcttgcgccgccgccatgaccttcaagcgccgcaacggcggccgcaacaagcatggccgcggtcacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcaggnaccgcaagccgccggagcgcttcaggcgcagggaggataggcctgctggtggacaaggaggcccccgccctgggtctggtgctgctgctacaggtccagctccagcaccggttgctgctcggccataggctttagcttttcgacccggttagtcttccgcccactcaagttcggagttgtcccccgtgcgtgtggtgagctgctatattagagt

SEQ ID NO: 43003 - protein, 135 aa, Zea mays
  misc_feature: Ceres CLONE 1442483-F
  misc_feature (1)..(117): Pfam Name: Ribosomal_S26e Pfam Description: Ribosomal protein S26e
  misc_feature (94)..(94): Xaa is any aa, unknown, or other
MTFKRRNGGRNKHGRGHVKYIRCSNCAKCCPKDKAIKRFQVRNIVEQAAIRDVQEACVYDGYVLPKLYAKVHHCVSCAIHAHIVRVRSREKRRXRKPPERFRRREDRPAGGQGGPRPGSGAAATGPAPAPVAARP

SEQ ID NO: 43004 - DNA, 725 bp, Zea mays
  misc_feature: Ceres CLONE 1442484-F
  misc_feature: Encodes the peptide sequence at SEQ ID NO. 43005
ggggtggggcgttccggtgtagggcccccgccgctcgtgcgcgggggggggggggcggggaaccccgattaaccctgcctccccttactgggactccccgcggtggcggccgctctttaactagtggatcccccgggctgcaggagttcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacgggtatcggcgtcatcggcaatggaaccgcccttgtgctcttcctctccccggtgcccaccttcctgggcatctggaaaaagcttgcggtggatgagtattcgccggatcccgtacgtggtgacgctgctgaactgcatgatgtgggtgcctggaggggccgccccggggttaacccgcccacctttgcggggggtggaccatgaacggcgccgggcttggtcatcctcgtgacccaagaaggcgctccttcgtgcccctcatctctctccggggcgaggaggcgcccggccgggccgcggggatacgtgggtgtgcgcggcgcggggcggcccgttactctcttcccaccttgtggccgcgagccaggtgtgcttgagccgctgc

SEQ ID NO: 43005 - protein, 76 aa, Zea mays
  misc_feature: Ceres CLONE 1442484-F
MVSADTIRTGIGVIGNGTALVLFLSPVPTFLGIWKKLAVDEYSPDPVRGDAAELHDVGAWRGRPGVNPPTFAGGGP

SEQ ID NO: 43006 - DNA, 739 bp, Zea mays
  misc_feature: Ceres CLONE 1442492-F
  misc_feature: Encodes the peptide sequence at SEQ ID NO. 43007
  misc_feature (69)..(69): n is a, c, t, g, unknown, or other
  misc_feature (81)..(81): n is a, c, t, g, unknown, or other
  misc_feature (83)..(83): n is a, c, t, g, unknown, or other
  misc_feature (85)..(85): n is a, c, t, g, unknown, or other
  misc_feature (739)..(739): n is a, c, t, g, unknown, or other
gggtgtggtcttttttttttatcctcgtgtgccccctactccctgtttatcgttgtagcgtccccccgnagaaagaggtgntncnttatagctggaactccccgcggtggcggccgctcttcactagtggatcccccgggctgcaggtatttcgcacgagaccattacctagaacatcctaatcgaaaacacacgtgtgcagcacgctgtcgctggcctagcggccctagcaagagtcaaagacgggcatcggcagcaacagcaccacactctcaagtcccaactcccaacattacgagacgcctcgccggccgcgccgcgcccaactcctctgatcctcttccttgtccccaccctcttctccgatggcgacgctgcagctcaaccacatcgcgcgggagacctccgacgtggcccgactcgccgccttctacgaggccgtgctggggttcgagcgcatcccttcgcccacctactcgggcttccaggtcgcatggctccgcctcccgagctcccccgacgtcgcgctccacctcatcgagcgggagcccgcccgcgggcacccgtcgcggtttgcgcccaaggcccgcccgccgacgccgctgtccccggtgaccacctccttccccttcctccgtccgctgaaccagaacggggttccgtgaacccaggcttgaagggcaccgcgggccaccccaattttgtttcgaagaaagtccgtaaggccggaatggggggn

SEQ ID NO: 43007 - protein, 99 aa, Zea mays
  misc_feature: Ceres CLONE 1442492-F
  misc_feature: SWISSPROT Homolog: EC 5.1.99.1 Methylmalonyl-CoA epimerase
MATLQLNHIARETSDVARLAAFYEAVLGFERIPSPTYSGFQVAWLRLPSSPDVALHLIEREPARGHPSRFAPKARPPTPLSPVTTSFPFLRPLNQNGVP

SEQ ID NO: 43008 - DNA, 627 bp, Zea mays
  misc_feature: Ceres CLONE 1442505-F
  misc_feature: Translation starting site: 145
ctggagctccccgcggtggcggccgctctagaactagtggatcccccgggctgcaggaattcgcacgagaccattacctagaacatcctaatcgaaaaagattcggagcttcgggggaaaaaggcaggcacagtatcgtcgaacatgctgccaggtcgccacccggcgcgccgggccgacaccaccgggacggggccgctcctgccggacgccactcgcgcggtggtgtcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtggggcacgtcaaccctgcggtcacgttcggcctgctcgtgggccgtcgcatctctttcggccgtgcggcggtatactggctcccgcagatgctcggcgccctggtcgcgtcgttgctgctaacgctcgtctccggcggcacgcgtcccgtggggcttcgggctcgtccgcgcgtccacgagcggcaccccttctgctagaagccgtcatgacgttcgggctcatgtacccc

SEQ ID NO: 43009 - DNA, 626 bp, Zea mays
  misc_feature: Ceres CLONE 1442506-F
  misc_feature: Encodes the peptide sequence at SEQ ID NO. 43010
ggagctccccgcggtggcggccgctctttaatagtggatcccccgggctgcaggatttcgcacgagaccattacctagaacatcctaatcgaaaaaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccgcagattgcattcatccgaggggcggataaaatcaaggggagcatcagtgcggcgcagaaatttacccctgacatctttcccaaaccctgccaaagctgaagaagtttagattgtaatacttgggccgaggggaattataatggtttgaag

SEQ ID NO: 43010 - protein, 122 aa, Zea mays
  misc_feature: Ceres CLONE 1442506-F
  misc_feature (12)..(117): Pfam Name: SCP2 Pfam Description: SCP-2 sterol transfer family
  misc_feature: SWISSPROT Homolog: EC 2.3.1.176 Propanoyl-CoA C-acyltransferase
MDSSSLKSAQLLELMRQHLATDAGKEVTKKVGLVYQLNIAPKKIGVDEEIFVVDLKKGEVTKGPYQGKPDATFSFTDNDFLGIATGKTNPQIAFIRGADKIKGSISAAQKFTPDIFPKPCQS

SEQ ID NO: 43011 - DNA, 847 bp, Zea mays
  misc_feature: Ceres CLONE 1442507-F
  misc_feature: Encodes the peptide sequence at SEQ ID NO. 43012
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (78)..(78): n is a, c, t, g, unknown, or other
  misc_feature (386)..(386): n is a, c, t, g, unknown, or other
  misc_feature (425)..(425): n is a, c, t, g, unknown, or other
  misc_feature (467)..(467): n is a, c, t, g, unknown, or other
  misc_feature (575)..(575): n is a, c, t, g, unknown, or other
  misc_feature (634)..(634): n is a, c, t, g, unknown, or other
tgttcgatttctatccggtgtgtgtgcgtgccacgtgacgcgccgtgtcctgtaggtggggttgggggggnnnnttcnggggggtaaactggcactccccgcggtggcggccgctctatactagtggatcccccgggctgcaggaattcgcacgagaccattacctagaacatcctaatcgaaaaatgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggaggagaggcgttccggctctcggccgcgccgggggccggcttactgaagctgcacaagggngacatcacccttctggtctcgtgactggcgcaacgaacnccaatcgttaatgcctgctaatgaacgaaatgttaaggtggngggaaggggttggatgggagcttatacattcaagcttgcctggacccgcagcctagcggcaatcctctgcccgggaaaagtttccaagaaggttcaaaaacctgggangttccgttttgttctcacctaagaacgaaagcctaagaaatattactccccgggccttnttcaaaccttcccccggccggcgctgggggttgaaatcgcccctctgggtgggccgccctcatatcttgcaatattgggaaaaaagccaataccctggaggggcggccaatttgaaaagacaaggcgcctttttaaaacaattcgcccaggaaaaaccttctcctcttaccggattaaagtggccttttcactacaacccagccgagcgtgtc

SEQ ID NO: 43012 - protein, 74 aa, Zea mays
  misc_feature: Ceres CLONE 1442507-F
MSRAATRFFLTRCLLPLPLLSPRWRQRRRGSICATRAFAMAASGFGGGEAFRLSAAPGAGLLKLHKGDITLLVS

SEQ ID NO: 43013 - DNA, 833 bp, Zea mays
  misc_feature: Ceres CLONE 1442513-F
  misc_feature (13)..(13): n is a, c, t, g, unknown, or other
  misc_feature (14)..(14): n is a, c, t, g, unknown, or other
  misc_feature (74)..(74): n is a, c, t, g, unknown, or other
  misc_feature (76)..(76): n is a, c, t, g, unknown, or other
tttttttttcttnngcttttctccgctcatttttaatccaatctttaattctttgatggcgttttctttttttnanttgttgccttcttaaaactggagctccccgcggcggcggccgctctagaatagtggatcccccgggctgcaggaattcgcacgagaccattacctagaacatcctaatcgaaaacttattcaggagtgtatctagctgaaaagatgaacagatacctgggagagaactggaagagctttaccagtaggaattattttgaccgttctggagtttttatctcctgtcgtctggtctggggccctaattgtcacatcgattgtcagtgtgattagccggcctcgttgcattaatgacgatcgctggcgtaatgtaaaatagcttatcttacgcccctgggttccaccctgcttacgactagatatcggttcgcataagagaaacaccacgctctgtatgtggcgaattcctaagtatgtagtggatttgtagacatttccctaagtctcgccctcgtctaatttctacacccccgccgcccttcaccccatttctttttcctgagaatcccctccaatccaccccccacggacgccgctcaaataccccgtattccgtccctcggttgtcttacctgctcccctccttctcctttctccgtttcgcttattccccgtatcccgaccacatacccgacttgtcggttaccacatcgttctgcgcccttctttacgctaatcataattctagtagcgcccaccacatcctatgatattgtgcgatcctctcctcttcctccctcttctcccccacacaccac

SEQ ID NO: 43014 - DNA, 733 bp, Zea mays
  misc_feature: Ceres CLONE 1442515-F
  misc_feature: Encodes the peptide sequence at SEQ ID NO. 43015
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (79)..(79): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (700)..(700): n is a, c, t, g, unknown, or other
  misc_feature (701)..(701): n is a, c, t, g, unknown, or other
  misc_feature (706)..(706): n is a, c, t, g, unknown, or other
ggctgttttgttttctctcccccgccccgcctttaatccgccctgttgttgttggggtgtggacccccnnnnncaatgncgtggtaagctggagctccccgcggtggcggccgctctagactagtggatcccccgggctgcaggaattcgcacgagaccattacctagaacatcctaatcgaaaaacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaactcccccaagaaccagcgccccaagtgcccctaggccctaccgctctaagggagggaggatgacccaggatttcgctcgcgatcctgcacagctttccagtccttgtacctgctaagtttaagcgcgcccgagcgcccgggaatggtccacgtccgaccnnnnnnnnnnnnntnnttctnccccccaacccccctccccccttctcc

SEQ ID NO: 43015 - protein, 96 aa, Zea mays
  misc_feature: Ceres CLONE 1442515-F
  misc_feature (1)..(96): Pfam Name: GASA Pfam Description: Gibberellin regulated protein
MKAIPVALLLLVLVAAASSFKHLAEAADGGAVPDGVCDGKCRSRCSLKKAGRCMGLCMMCCGKCQGCVPSGPYASKDECPCYRDMNSPKNQRPKCP

SEQ ID NO: 43016 - DNA, 630 bp, Zea mays
  misc_feature: Ceres CLONE 1442521-F
  misc_feature: Encodes the peptide sequence at SEQ ID NO. 43017
  misc_feature (630)..(630): n is a, c, t, g, unknown, or other
ggagctccccgcggtggcggccgctctagaactagtggatcccccgggctgcaggaattcgcacgagaccattacctagaacatcctaatcgaaaaacgacacacacaaaccagtagccactactccatccaccacaccacgagcgcgcgataaccctagctagcttcaggtagtagcgagagccaatggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccan

SEQ ID NO: 43017 - protein, 147 aa, Zea mays
  misc_feature: Ceres CLONE 1442521-F
  misc_feature (40)..(105): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 795 in the 10/374,780 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
MDSSSFLPAAGAENGSAAGGANNGGAAQQHAAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGD

SEQ ID NO: 43018 - DNA, 642 bp, Zea mays
  misc_feature: Ceres CLONE 1442525-F
  misc_feature: Encodes the peptide sequence at SEQ ID NO. 43019
  misc_feature (587)..(587): n is a, c, t, g, unknown, or other
ggagctccccgcggtggcggccgctctatactagtggatcccccgggctgcaggaattcgcacgagaccattacctagaacatcctaatcgaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgcctcaacttcgacctcttncaggctgctgcggccgactggcgcgacacgctcttctgcgaggtggctccgaccc

SEQ ID NO: 43019 - protein, 168 aa, Zea mays
  misc_feature: Ceres CLONE 1442525-F
  misc_feature: SWISSPROT Homolog: EC 1.14.11.20 Desacetoxyvindoline 4-hydroxylase
  misc_feature (150)..(150): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASTSTSXRLLRPTGATRSSARWLRP

SEQ ID NO: 43020 - DNA, 640 bp, Zea mays
  misc_feature: Ceres CLONE 1442528-F
  misc_feature: Encodes the peptide sequence at SEQ ID NO. 43021
aagctggagctccccgcggtggcggccgctctataactagtggatcccccgggctgcaggaattcgcacgagaccattacctagaacatcctaatcgaaaaactgcgggcacgtccgcttcttccccatcccgtttctatggccgcgcgcggtgggttgacactgcaattattgatttccgcttaatctattgccgtgccgtagaagcggaagctactggacgaggggctggagcggaagcgggaggcggaactcaatgagctttacgatgccatgaaagattgggtcagcgaactcaggaaagacaatgcggaactcaacgagaagctggtggagaagcaggatgagctcgagaaggcccgtcaggaattccttgaagatattcgtacaagggacgctgaaattctgaagctgaagcagctcttagatgagaaggctgaaaaaaacaattctgcagctactgggtttccttgcctagcgcctgaagctgtcctagaaaattcaactccattgtcacctaaaagaaagacaccattttcccacggcaagcagctagaatgctccagaagacatacacgcatctcagggaataggacaacagagattcggagtgctcatatgctttctttgctgcttcatc

SEQ ID NO: 43021 - protein, 122 aa, Zea mays
  misc_feature: Ceres CLONE 1442528-F
MKDWVSELRKDNAELNEKLVEKQDELEKARQEFLEDIRTRDAEILKLKQLLDEKAEKNNSAATGFPCLAPEAVLENSTPLSPKRKTPFSHGKQLECSRRHTRISGNRTTEIRSAHMLSLLLH

SEQ ID NO: 43022 - DNA, 614 bp, Zea mays
  misc_feature: Ceres CLONE 1442529-F
  misc_feature (614)..(614): n is a, c, t, g, unknown, or other
ccccgcggtggcggccgctctataactagtggatcccccgggctgcaggatttcgcacgagaccattacctagaacatcctaatcgaaaactgtgtctcgtaggtggacatattctccgcgtgacttcaggtgtcgtcgccgagttgtctccggccgagggcggcggcgcgaccggtaaccagcgtcagcgtgagtgtgacaggcgacatgactcatatccttcccaaaccctgtttagatctgcgcgttgggggctcttcctctaatccatcctttgcttgtatacgatctcgatctgtttcgttgtttcgattctgttattgccctgttcctctttccttaactcgcgcgcacgcggcaaccagcgtgaccgcgatcgtgagcgcgcggcggcgcggaagcccaacggcaaggggccccaggacgggctcaccccggagcagcgccgtgagagggacaagaaagcgctggaggagaaagcggcgaagaaggcgcagcaggcagcgcccggcggcaccgggacctccacggacaacaagaataaggcaggtggcaagaagtaggccgcagcggcgagcggcgccacctctgtacgattatcgatccatgcctn

SEQ ID NO: 43023 - DNA, 800 bp, Zea mays
  misc_feature: Ceres CLONE 1442530-F
  misc_feature: Encodes the peptide sequence at SEQ ID NO. 43024
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
tggctgggtccgtcctcctcgtcccctggattgtgttttggttgcggttggcgtgcgggggggtgtgtgtnnnnnnntnnnnnnnnaaactggagctccccgcggtggcggccgctctatactagtggatcccccgggctgcaggaattcccacgagaccattacctagaacatcctaatcgaaaaatcacatatccgttgtggcagcagccttcgtgcaggcatggcgagctcatcttgtgcactgctgggtctggcctgcttcgtgctcctggcggcggcagccggcgccacgcagtacaaggtcggcggcgacaatggctgggccgtgccggacgccaccgccgagtcgttcaacacctgggcggagaagaccagcttccagatcggcgacagcctcttgttcgtgtaccccaaggacaaggactcggggctgccgggtggattcggtcgactacaacggcgtggggcacctcccccctacgaacaagcagtttcgaccaacgggcgccacgtcccgtgggtgtttggaccgcggccgggcgccccttcttccttccataagggggctgttctagggccaaattgcccctcgcccaaaccaagaaagcttccatccgtcccggggtcctccccggaccttgggagcgcacaccgcggcgccccggccccccgagaacccggggcgagagggttccgcgggttcctatcctctcctctcccgctgttgcgaaccgtcccggacgcccacggataacccctcccacaaaagggggcgggcccggccgaccctccccgcg

SEQ ID NO: 43024 - protein, 177 aa, Zea mays
  misc_feature: Ceres CLONE 1442530-F
MASSSCALLGLACFVLLAAAAGATQYKVGGDNGWAVPDATAESFNTWAEKTSFQIGDSLLFVYPKDKDSGLPGGFGRLQRRGAPPPYEQAVSTNGRHVPWVFGPRPGAPSSFHKGAVLGPNCPSPKPRKLPSVPGSSPDLGSAHRGAPAPREPGARGFRGFLSSPLPLLRTVPDAHG

SEQ ID NO: 43025 - DNA, 671 bp, Zea mays
  misc_feature: Ceres CLONE 1442538-F
  misc_feature: Encodes the peptide sequence at SEQ ID NO. 43026
aaagctggagctccccgcggtggcggccgctctagaactagtggatcccccgggctgcaggaattcgcacgagaccattacctagaacatcctaatccaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcaggctaaagggctccacgctccttaccgaaggagtggtgacggatggatccgatgaatgggcaatttacggcgggaccggagagtttgctatggcgagaggtgtcgtcaaaagaaggtaccttgccgatagggacggcgccgggaacactgacgagctcagcatgcaggttttctgcccggtgtttggctcatcacagcaaccaaacaagcaggcacgtgcc

SEQ ID NO: 43026 - protein, 174 aa, Zea mays
  misc_feature: Ceres CLONE 1442538-F
  misc_feature (7)..(161): Pfam Name: Dirigent Pfam Description: Dirigent-like protein
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWAIYGGTGEFAMARGVVKRRYLADRDGAGNTDELSMQVFCPVFGSSQQPNKQARA

SEQ ID NO: 43027 - DNA, 669 bp, Zea mays
  misc_feature: Ceres CLONE 1442543-F
  misc_feature: Encodes the peptide sequence at SEQ ID NO. 43028
aagctggagctccccgcggtggcggccgctctagaactagtggatcccccgggctgcaggaattcgcacgagaccattacctagaacatcctaatcgaaaagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgccccggacggtcgatggcgcgggtggcgctccggttgggcgcccgcgcgctcgcggttctcgtcctcgtgtcagtggctctgcttccacttgtcagttccgacgatggacacaaacactgcgagggtgttgtcaggggctgggcggattcctccacggggcgcgtgaaggacggggacaaactgagcctcaaggatttgctcttcttcctccacattcctaggactggaggccgcacctactttcactgcttcc

SEQ ID NO: 43028 - protein, 80 aa, Zea mays
  misc_feature: Ceres CLONE 1442543-F
MARVALRLGARALAVLVLVSVALLPLVSSDDGHKHCEGVVRGWADSSTGRVKDGDKLSLKDLLFFLHIPRTGGRTYFHCF

SEQ ID NO: 43029 - DNA, 670 bp, Zea mays
  misc_feature: Ceres CLONE 1442562-F
  misc_feature: Encodes the peptide sequence at SEQ ID NO. 43030
  misc_feature (622)..(622): n is a, c, t, g, unknown, or other
aagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacgggcggcgtgcacgacggcaccgccgtcgtngctctgggagtggtgcaagggcgagaaccagagctggaagatcctgcc

SEQ ID NO: 43030 - protein, 170 aa, Zea mays
  misc_feature: Ceres CLONE 1442562-F
  misc_feature (155)..(155): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGRRARRHRRRXSGSGARARTRAGRSC

SEQ ID NO: 43031 - DNA, 652 bp, Zea mays
  misc_feature: Ceres CLONE 1442570-F
  misc_feature: Encodes the peptide sequence at SEQ ID NO. 43032
aagctggagctccccgcggtggcggccgctctagaactagtggatcccccgggctgcaggaattcgcacgagaccattacctagaacatcctaatcgaaaaaccgccggtcaagtccctgatggacacgccgccgccctctctcccgccgtccaccctcctctggccggacctcctcgcgggcgcggcgtcctccacctgccgcctcgtcgccgcgcattcccgtcacttcctggccctatcctctctcctccttctcccgctcgccctcctcctactcgccctcccctgcccgttcttctctgcctccgcctcctccgccgcctcccctcccgtacatctccgggtcccgcaggatccgtcaaggtacccactacccatcccgctgccgctgctcgcccttgccgccgcgctcctctacctcgccgccttcgccgccgccgcggccagcgcgcacgcagggttcttcggtcgccccgtccggctcctcgcctcgctccgctccgtgccagcctcactcctccgcctcatcctgaccgccatcccggcctccccgctggcactccttccgctcctcccgctccccgcggcgctcggcgccgcactgcccgtcctcggcttcatccttttgtccccgttctggtccctcgctg

SEQ ID NO: 43032 - protein, 177 aa, Zea mays
  misc_feature: Ceres CLONE 1442570-F
MDTPPPSLPPSTLLWPDLLAGAASSTCRLVAAHSRHFLALSSLLLLPLALLLLALPCPFFSASASSAASPPVHLRVPQDPSRYPLPIPLPLLALAAALLYLAAFAAAAASAHAGFFGRPVRLLASLRSVPASLLRLILTAIPASPLALLPLLPLPAALGAALPVLGFILLSPFWSLA

SEQ ID NO: 43033 - DNA, 672 bp, Zea mays; identical to SEQ ID NO: 42296
  misc_feature: Ceres CLONE 1442574-F
  misc_feature: Encodes the peptide sequence at SEQ ID NO. 43034

SEQ ID NO: 43034 - protein, 104 aa, Zea mays; identical to SEQ ID NO: 42297
  misc_feature: Ceres CLONE 1442574-F

SEQ ID NO: 43035 - DNA, 663 bp, Zea mays
  misc_feature: Ceres CLONE 1442577-F
  misc_feature: Translation starting site: 201
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggtcttcagcaagctgaccggcggcggcccgacgaccccggagggcctgatcgcggcggcggcggcgcacgcgttcgcgctgccaccggcggtgtctgtgggcgcgaacatctccggcgggcacgtgaaccctgccgtgaccttcagcaccttcatgggcggcaacatcaccctgttccgggggctcctgtactgaggtggcgcaactgctggggtccaccatggcgtgcttcctgctccgcttctcgacgggcgggaaggccaccggcaccttcgggctgaccggcgtgtcggtgtgggaggcgctggtgctagagatcgtgatgaccttcgggctg

SEQ ID NO: 43036 - DNA, 640 bp, Zea mays
  misc_feature: Ceres CLONE 1442582-F
  misc_feature: Encodes the peptide sequence at SEQ ID NO. 43037
aagctggagctccccgcggtggcggccgctctagaactagtggatcccccgggctgcaggaattcgcacgagaccattacctagaacatcctaatcgaaaaaccaacatgaaaaaaggcccagaggcggtgccgtgaccgattcgagacgcaagagaaggatcgagacgaggcgggggttttccgggggcaccatcggctcggccacgaaagatgtcttactcaagaggctcaaggtatggatctcgctcgccttactcgagagagcacaagggacccaattcgctctaggagtgtcgactctagtgatgctgaaaaccctgggaacaacctgtatgtgactggtttgtcagctcgtgtaacggatcgagatctggagaagcacttctccactgagggtgaggtgattgatgcaagcgttgtatatgatccttggacaagggaatcacggggtgttggttttgataccatggctgctgttaaagatgcagatcgctgcatcaaatatctggaccgttctgtgttgcaaggtcgggtcataactgttgagaagattttgttgacagacacatggtacatgttggtagctgctctgcaacagactgatacaacctaacaccagaccatgccgacctcagcca

SEQ ID NO: 43037 - protein, 125 aa, Zea mays
  misc_feature: Ceres CLONE 1442582-F
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MDLARLTRESTRDPIRSRSVDSSDAENPGNNLYVTGLSARVTDRDLEKHFSTEGEVIDASVVYDPWTRESRGVGFDTMAAVKDADRCIKYLDRSVLQGRVITVEKILLTDTWYMLVAALQQTDTT

SEQ ID NO: 43038 - DNA, 562 bp, Zea mays
  misc_feature: Ceres CLONE 1442585-F
  misc_feature: Encodes the peptide sequence at SEQ ID NO. 43039
  misc_feature (72)..(72): n is a, c, t, g, unknown, or other
  misc_feature (310)..(310): n is a, c, t, g, unknown, or other
  misc_feature (317)..(317): n is a, c, t, g, unknown, or other
ggagtccccgcggtggcggccgctctagaactagtggatcccccgggctgcaggaattcgcacgaagaccanttacctagaacatcctaatcgaaaagcacatattatgtgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcnttcaccntacaggatccaacaggcaatcacagctggcatcttacctttatcaccctttgttcctcaaacaatcatcagccctattacatcagttaccctttgggtgccatttattgggcacaaaaacattcaggggcacaaacaaactacaaacaaacttgggggctaaccaaaacctttggttggccaaaatccttaaagaaaaaaaggaagttttttctttccctttccaacccaaacttaactttgcat

SEQ ID NO: 43039 - protein, 108 aa, Zea mays
  misc_feature: Ceres CLONE 1442585-F
  misc_feature (53)..(53): Xaa is any aa, unknown, or other
MAAKIFCLLMLLGLSASAATATIFPQCSQAPIASLLPPYLSPAVSSVCENPIXSPYRIQQAITAGILPLSPFVPQTIISPITSVTLWVPFIGHKNIQGHKQTTNKLGG

SEQ ID NO: 43040 - DNA, 684 bp, Zea mays
  misc_feature: Ceres CLONE 1442592-F
  misc_feature: Translation starting site: 225
  misc_feature (367)..(367): n is a, c, t, g, unknown, or other
  misc_feature (404)..(404): n is a, c, t, g, unknown, or other
  misc_feature (424)..(424): n is a, c, t, g, unknown, or other
  misc_feature (431)..(431): n is a, c, t, g, unknown, or other
  misc_feature (432)..(432): n is a, c, t, g, unknown, or other
  misc_feature (440)..(440): n is a, c, t, g, unknown, or other
  misc_feature (454)..(454): n is a, c, t, g, unknown, or other
  misc_feature (458)..(458): n is a, c, t, g, unknown, or other
  misc_feature (465)..(465): n is a, c, t, g, unknown, or other
  misc_feature (473)..(473): n is a, c, t, g, unknown, or other
  misc_feature (491)..(491): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (556)..(556): n is a, c, t, g, unknown, or other
  misc_feature (564)..(564): n is a, c, t, g, unknown, or other
  misc_feature (567)..(567): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
  misc_feature (582)..(582): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (600)..(600): n is a, c, t, g, unknown, or other
  misc_feature (601)..(601): n is a, c, t, g, unknown, or other
  misc_feature (620)..(620): n is a, c, t, g, unknown, or other
  misc_feature (652)..(652): n is a, c, t, g, unknown, or other
caagctggagctccccgcggtggcggccgctctagaactagtggatcccccgggctgcaggaattcgcacgagaccattacctagaacatcctaatcgaaaatttgaacttctcgtcttctctaatctctttgcctctttggctccctccaccacaagaccacgacctctgctacccaaccattgcttcgccaaaccctagccaagggacacggtggccagacgatggacggcgacggaggaggcgctggtgcgctgcaccaccacacgcgctcacccgaggacgtcttccgcgatttccgcgcgcgccgagccggcatcgtcaaggcgctcaccacggatgtggagaaagtctatcagcagtgcgntcccaagaagaaaacttggcgccttaagggtttgccnattgacacttggaaaggcantcctccnnttgggggnggacctcctggggnttcnaaaaccncccggggnataaattttgccccgggnggggggggcccnnnnnggaggggggggcnnnnnnncgnnnncnnnnngnnnaaggggcccgaggngggggganttntgtgtggnnnnnanntttaaatagnnnagaagnncaagaagaaaaagctcccncgcgaaaaaaaagggcccaaaaaaaaaaaagngaagaaaaggagaaaaaaacaaaaaaaaaaaa

SEQ ID NO: 43041 - DNA, 629 bp, Zea mays
  misc_feature: Ceres CLONE 1442596-F
  misc_feature: Encodes the peptide sequence at SEQ ID NO. 43042
  misc_feature (85)..(85): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctanaacatcctaatcgaaaactattcctcggagagggagaagccgccgccgcagcaatcacagcaacccggagaaagcccaggtccgacaagatgcagatcttcttgaagacgctgacagggaaaaccatcaccctcgaggtcgagagcagcgacaccatcgaggatgtgaaggccaacatccaggacaaggaagggatcccgccggaccaccaggggatgatctttgccgggaagcagctggaggatggccgcacccttgcggactataacatccaaaaggagtctacgcttcacctcgtgcttaggctccgcggtggcatcattgaaccctcgctgcaggcgctcgctcgcaagtacaaccaggacaagatgatctgccgcatatgctatgcacgactgcaccctacggctgtcaactgccgcaagaacaagtgtggtcacagcaaccagctgacgtccaagaagacatgacgaactgaggtgctgctcctagtcagtttcatggacaatgttgcgctgtattgctgtgtggttgctgaaccggn

SEQ ID NO: 43042 - protein, 126 aa, Zea mays
  misc_feature: Ceres CLONE 1442596-F
  misc_feature (6)..(74): Pfam Name: ubiquitin Pfam Description: Ubiquitin family
  misc_feature (77)..(127): Pfam Name: Ribosomal_L40e Pfam Description: Ribosomal L40e family
MQIFLKTLTGKTITLEVESSDTIEDVKANIQDKEGIPPDHQGMIFAGKQLEDGRTLADYNIQKESTLHLVLRLRGGIIEPSLQALARKYNQDKMICRICYARLHPTAVNCRKNKCGHSNQLTSKKT

SEQ ID NO: 43043 - DNA, 659 bp, Zea mays
  misc_feature: Ceres CLONE 1442597-F
  misc_feature: Encodes the peptide sequence at SEQ ID NO. 43044
  misc_feature (406)..(406): n is a, c, t, g, unknown, or other
aagctggagctccccgcggtggcggccgctctagaactagtggatcccccgggctgcaggaattcgcacgagaccattacctagaacatcctaatcgaaaatgacatatgagggtgccgttgatttggagaacatggatgatatgttacaaaagtccgctattgaggaccaaattgcaaattttggacaaacaccaattcaaatttttcggaagaaacacccaaggagaggtcctcctataccaattgtgcatccactatattttgcgccacaatcgataacagtgacttctgttgtcccgaccatagtcacccctttatctgtattattcattggtttgttggactcaaacgttgtcatgatgaatgaggggctcatactctctgtaaagctttggctaacaaancagtatgcagtctggtggaaacttcacattttctggatcactggaacctttcttcggaattggttctgatgttatttctccgaggaaaattggcacttctttggctgaaaatgttgagtttggaagacaatgcttagcaactgttcaaattcgtggtgacaattacttaattttgtgtggtaattgggagaatagtttccagatcatatctctaagtgatggaaaaattgtgcagagcatccggcagcataaa

SEQ ID NO: 43044 - protein, 124 aa, Zea mays
  misc_feature: Ceres CLONE 1442597-F
  misc_feature (102)..(102): Xaa is any aa, unknown, or other
MTYEGAVDLENMDDMLQKSAIEDQIANFGQTPIQIFRKKHPRRGPPIPIVHPLYFAPQSITVTSVVPTIVTPLSVLFIGLLDSNVVMMNEGLILSVKLWLTXQYAVWWKLHIFWITGTFLRNWF

SEQ ID NO: 43045 - DNA, 664 bp, Zea mays
  misc_feature: Ceres CLONE 1442601-F
  misc_feature: Encodes the peptide sequence at SEQ ID NO. 43046
ggggctccccgcggtggcggccgctctagaactagtggatcccccgggctgcaggattcgcacgagaccattacctagaacatcctaatcgaaaaaagatcctccgccccgccaaccaactactctcacagtctcacctcccgctcctgccccctccctctcgttctcttccgaaatggcggccgagtccgccaggccgccctcggcgcctcgctactccagctgccccgcgggccctgggaaactccaccttactcccacctgaccgcgaactacctcggtgtttacttcgcgctcttcctcgccatccttcccgtcgaggcaccgcagatgcgccacgtggcctcaatcaagtcgcggggtcgcctactctcctcgcgcctgcgggcaacataggactaactgtatcatctgcccccgcgccgtcacaaggatacccgaacacacgcccgaacagcatagatcttcgcgtgccaccgcgccaactgaatggaggacgagcgccaacatgagagcctcgccgcagcagctatagaatatgtcgcctcccaccacgcacacctcgccgacgtttaggtccatgccgctatgctacgcgcccatacccatggactcgagcgcgaagcaacgtattcttattacctgatcacagacgtactcgatc

SEQ ID NO: 43046 - protein, 35 aa, Zea mays
  misc_feature: Ceres CLONE 1442601-F
MSPPTTHTSPTFRSMPLCYAPIPMDSSAKQRILIT

SEQ ID NO: 43047 - DNA, 668 bp, Zea mays
  misc_feature: Ceres CLONE 1442602-F
  misc_feature: Translation starting site: 138
  misc_feature: SWISSPROT Homolog: EC 5.3.3.2 Isopentenyl-diphosphate Delta-isomerase
aagctggagctccccgcggtggcggccgctctagaactagtggatcccccgggctgcaggaattcgcacgagaccattacctagaacatcctaatcgaaaaaaatccaggcgtggccgtgcgaccatccctcccctcatggcgtcatcggcggcgcgatccctcgcgctcgtcgcgtctgcctcggcatcgctcggcgtcgggcagcggtcgtgggctcgcttggctgtctcttcctcttcggctgggtcggccctccccaagctccgcgggctccgctcgttcgccgcctccgcagggggcgccgtgatggggaagccaggccccggggtcgttgacgccgacgccgggatggacgccgtccagcggcggctcatgtttgaggacgagtgcattttagtggatgaacaagacaatgtcatcggccacgagtccaagtataactgccatctcatggagaagatagaagctggaaatgccctgcacagagctttcagtgttttcccttttcaactccaaatatgagttgctactgcagcaaaggtctgcaacaaaggtgacattttccacttgtctggacaaacacctgctggagccctcctctctaccgcgagtcaaagttgattgaggaaaatggggcaggggtgaaaaatgcacccccacgcaaat

SEQ ID NO: 43048 - DNA, 652 bp, Zea mays
  misc_feature: Ceres CLONE 1442612-F
  misc_feature: Encodes the peptide sequence at SEQ ID NO. 43049
ctccccgcggtggcggccgctctagaactagtggatcccccgggctgcaggaattcgcacgagaccattacctagaacatcctaatctaaaagcaattgtttccaggtaatctcgcatcagcaaacagcaccgggctccgttcaccgccttgccttctcttctccggttcctcccccgcgcgttcgctcgctctcgtggcgcaactcgtagaccgccgccgcctccgctctacgccaggtgcctaggtctagcttcgtcggtcccttcgccaacgacgagcacccacccgatctgacgccagaagttcagctaggagtgcatcttgtttacctgttgcttaatcatggacaactctcataatcaaccaccaccacctggtgttggaacatggccgcaggcacctcctagtcacccgccacaatgccatgctgatccacagtcttatcatccacaatttgctgctagacctgacaatgctagtgccaataatagtggtagttcagcaaacattgagtcagctgtccaggaggctgttcttcacgcgcaggacattgagactcagcaagtcatacataatcaaagacatgcaaacacaacaagtgaacctacaaaatatggggaagacttactttcgaaccgccgtgaccctaa

SEQ ID NO: 43049 - protein, 102 aa, Zea mays
  misc_feature: Ceres CLONE 1442612-F
MDNSHNQPPPPGVGTWPQAPPSHPPQCHADPQSYHPQFAARPDNASANNSGSSANIESAVQEAVLHAQDIETQQVIHNQRHANTTSEPTKYGEDLLSNRRDP

SEQ ID NO: 43050 - DNA, 654 bp, Zea mays
  misc_feature: Ceres CLONE 1442621-F
  misc_feature: Encodes the peptide sequence at SEQ ID NO. 43051
aaagctggagctccccgcggtggcggccgctctagaactagtggatcccccgggctgcaggaattcgcacgagaccattacctagaacatcctaatcaaaaaacggatgcgtcacttccaggctgactttttgctccctctacaagagcagaagacggcgcacaacatcggtctcttgatgtcaaccctggcctatgtggaccagcaacaggacacgccgaacctcttcgaccggtggacctaccatgatgtccaggtgaacgacgtctcgctgaacgactacctcgctgtgaacgcgacgaagcacgcgatgtacctgccgcagaccgcgtggcgctactccaagaagcagttccgcagggcgcagtgcacgatcgttgagcgccttacaaactccctcaagatgcacgggcgcaacaacgataagaaggacatggctgaccgcatcatcaagcataccctgtagatcattcacctgatcaccgatgcctaccccatccaggtcgacgtcgacgcgatcatcaacagtggcccccgtgaggatgccacccgtattgctaccgctggtgttgtgagaatgcatgccatggatatctcacccctgatgagggtgaaccaggccatctacctcttgcacactggtgccagagagag

SEQ ID NO: 43051 - protein, 119 aa, Zea mays
  misc_feature: Ceres CLONE 1442621-F
MRHFQADFLLPLQEQKTAHNIGLLMSTLAYVDQQQDTPNLFDRWTYHDVQVNDVSLNDYLAVNATKHAMYLPQTAWRYSKKQFRRAQCTIVERLTNSLKMHGRNNDKKDMADRIIKHTL

SEQ ID NO: 43052 - DNA, 608 bp, Zea mays
  misc_feature: Ceres CLONE 1442626-F
  misc_feature: Encodes the peptide sequence at SEQ ID NO. 43053
  misc_feature (336)..(336): n is a, c, t, g, unknown, or other
  misc_feature (342)..(342): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcngctgcnctgggcgggaccgactatgggaacgacgacagcaagatctcccccgacgagatcctcttcgagggctgcgactacaaccactggctcatcancatggacttccccgaccccaagccgtcccgcgaagagatgatccagacataccttcagactctcggcaaggtcgtccggaagtatgaagaaggcaagaagaagaatgatgcttttagtacgaccacttatgttggttttcaagctggaatgaccgaagaaatgtcagaaaaatt

SEQ ID NO: 43053 - protein, 154 aa, Zea mays
  misc_feature: Ceres CLONE 1442626-F
  misc_feature (97)..(97): Xaa is any aa, unknown, or other
MALALRLRRVLAAASTAAPLLRPSTSVARPCPLVPLASPVAPLPLPPWRFLPGGGAGFRSTAAAAALGGTDYGNDDSKISPDEILFEGCDYNHWLIXMDFPDPKPSREEMIQTYLQTLGKVVRKYEEGKKKNDAFSTTTYVGFQAGMTEEMSEK

SEQ ID NO: 43054 - DNA, 653 bp, Zea mays
  misc_feature: Ceres CLONE 1442627-F
  misc_feature: Encodes the peptide sequence at SEQ ID NO. 43055
tggagctccccgcggtggcggccgctctagaactagtggatcccccgggctgcaggaattcgcacgagaccattacctagaacatcctaatcgaaaaaacattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaagggggaggacagcggcgaccgctgcccttgcgagaagcagtgcgagggccaccacgaccgggaaagcaggcagcagtgcgtccaggcttgcgagcgccggcgacagcagcgcggcggcagccgtgactccaacgtcgacgaggacgacagcgaccggcggtgccagatgaaatgccggcgccacagcgatcggcaggcgaggcagtggtgcgtgcagcgctgcgagcgtaagcaacaggaggaggacgccgccgccgacgacgacaacagcggccggtgccagaagagatgccagcaccacagcgatcggcaggcgaggcagtggtgcgtgcagcgctgcgagcgtaagcaacagga

SEQ ID NO: 43055 - protein, 126 aa, Zea mays
  misc_feature: Ceres CLONE 1442627-F
MRCSMRKKGEDSGDRCPCEKQCEGHHDRESRQQCVQACERRRQQRGGSRDSNVDEDDSDRRCQMKCRRHSDRQARQWCVQRCERKQQEEDAAADDDNSGRCQKRCQHHSDRQARQWCVQRCERKQQ

SEQ ID NO: 43056 - DNA, 647 bp, Zea mays
  misc_feature: Ceres CLONE 1442630-F
  misc_feature: Encodes the peptide sequence at SEQ ID NO. 43057
aagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgcc

SEQ ID NO: 43057 - protein, 108 aa, Zea mays; identical to SEQ ID NO: 16131
  misc_feature: Ceres CLONE 1442630-F

SEQ ID NO: 43058 - DNA, 632 bp, Zea mays
  misc_feature: Ceres CLONE 1442640-F
  misc_feature: Encodes the peptide sequence at SEQ ID NO. 43059
aaagctggagctccccgcggtggcggccgctctagaactagtggatcccccgggctgcaggaattcgcacgagaccattacctagaacatcctaatcgaaaaatttttcctcttctccaaaccccactcaccgcaacgagccgccggatccatggccggcaaagacggctccgtcccttccccgcctcctccccggctcccatcctaccctgagatgatcgtggaggcaatccgggcgctgggactcgagaacggctgcaacaagactgcgatctcggactacatcaagggcagctacggctccaacctccctgcccagcacaacgccgtcctcacgggccacctcgcccgcatgaaggctaccggtgagctcgccttcctcaggaacaactatctcctccccaacgaggacgaagcctccccgctgagcaccggtgggcacaagggccccgccgccgccaaggagtctactggcgtgttggacgttggtgacgatgtgttgcttgcttcccctctcgtcatcaacgctgacgccgtctacattgacgtgcctgctccagctcccgttgtcaccgctgatgtcgacgacattgacgtgcttgctccagctcccgttgtcagcgctgatgtca

SEQ ID NO: 43059 - protein, 160 aa, Zea mays
  misc_feature: Ceres CLONE 1442640-F
  misc_feature (15)..(85): Pfam Name: Linker_histone Pfam Description: linker histone H1 and H5 family
MAGKDGSVPSPPPPRLPSYPEMIVEAIRALGLENGCNKTAISDYIKGSYGSNLPAQHNAVLTGHLARMKATGELAFLRNNYLLPNEDEASPLSTGGHKGPAAAKESTGVLDVGDDVLLASPLVINADAVYIDVPAPAPVVTADVDDIDVLAPAPVVSADV

SEQ ID NO: 43060 - DNA, 866 bp, Zea mays
  misc_feature: Ceres CLONE 1442649-R
  misc_feature: Encodes the peptide sequence at SEQ ID NO. 43061
  misc_feature (676)..(676): n is a, c, t, g, unknown, or other
cgaattgggtaccgggccccccctcgaggtcgacggtatcgataagcttttttttttttttttttgtgggaaaaggccccctttccttatttattattaaagcacatttcctttacacagtctctcaactagtacaagcgtacttgggcaaaacgtatacttgtcatgctgggaaaaacttcccaaacacccgtacacggttagttttttcatcgaaaagccatggcccccgaacgcgcatgcacctcccactctttattcccacgtccccctacaaaggagcaaaaccacttggggaatgggcccctggaaactggaaagtcccccccccggaaacccgtacttacccggaaagcgaacactaccctttaattataacctctgccccaccccatgcacgtcttcaatcgtcaccccccctcaaggagggccccggccaccgtttcccacccacggccgcgggggaagtcccgcacccactgctgctgtttgtcaaagccccgggggggctgctggcacttcttctcgcaccggtccccggggttggagtcatcgtcagcgtcgtcgcgggcgccgccctcctcctgtcgcccgcaccgttgcatgcaccgcaaccttttcatccagtcgctgtgctgctggcatcttttcgtgcaccggttcgctgttctcgtcntcgtcggggggcggcgtcctcctgttgcataccctcgcagcgttgcacgcaccattgcctcaccgtgccaatggatggggggcttgaaatctctttctgcaccggcgcgctgttgtcttcctcgggggggggggtcctccctctggttggtttaccctcgaaggggttgcaagcacaactgcctttcgcc

SEQ ID NO: 43061 - protein, 209 aa, Zea mays
  misc_feature: Ceres CLONE 1442649-R
  misc_feature (146)..(146): Xaa is any aa, unknown, or other
MHLPLFIPTSPYKGAKPLGEWAPGNWKVPPPETRTYPESEHYPLIITSAPPHARLQSSPPLKEGPGHRFPPTAAGEVPHPLLLFVKAPGGLLALLLAPVPGVGVIVSVVAGAALLLSPAPLHAPQPFHPVAVLLASFRAPVRCSRXRRGAASSCCIPSQRCTHHCLTVPMDGGLEISFCTGALLSSSGGGVLPLVGLPSKGLQAQLPFA

SEQ ID NO: 43062 - DNA, 632 bp, Zea mays
  misc_feature: Ceres CLONE 1442657-F
  misc_feature: Encodes the peptide sequence at SEQ ID NO. 43063
aagctggagctccccgcggtggcggccgctctagaactagtggatcccccgggctgcaggaattcgcacgagaccattacctagaacatcctaatcgaaaaatacggcataccacactagagccgccgccgccgccgccgctgccgtttcgcgcaccgtaccctagccctcgtcagcggcggcttcgagctcctccagccatgacgttcaagcggaggaatggcggacgcaacaagcacgggcgcggtcacgtcaagtacatccgctgctccaactgtgccaagtgctgccccaaggataaagctatcaagcggttcttggtgaggaacattgttgagcaggctgccgtgagagatgtgcaggaggcctgtgtacatgatggatatgttctacccaaattgtatgcaaaggttcatcactgtgtctcatgcgcaatccatgcgcacattgtccgtgtccgctctcgtgagaacaggaggaaccgtgagcccccgcagcgcttcagacgccgggatgatggcccaaggcctggtcagggcccgccgcgcccaggcggtgcagctcctgcagctgcacctgctgctgctcctcgtacttaagttctggaattagtttcggggcttagttttggg

SEQ ID NO: 43063 - protein, 132 aa, Zea mays
  misc_feature: Ceres CLONE 1442657-F
  misc_feature (1)..(114): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGPPRPGGAAPAAAPAAAPRT

SEQ ID NO: 43064 - DNA, 648 bp, Zea mays
  misc_feature: Ceres CLONE 1442665-F
  misc_feature: Encodes the peptide sequence at SEQ ID NO. 43065
aaagctggagctccccgcggtggcggccgctctagaactagtggatcccccgggctgcaggaattcgcacgagaccattacctagaacatcctagtcgaaaactccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccacgccctccacaacgccttcagcacctacggcgaggtcctcgagtccaagatcatcctcgatcgggagacgcataggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccatgatggcggtggcggctacagcggtggcggcggctacggtggcggcggcggctacagtggtggtggcggcggctactgcggtggcaaccgtggcggctgctactgcaa

SEQ ID NO: 43065 - protein, 147 aa, Zea mays
  misc_feature: Ceres CLONE 1442665-F
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHALHNAFSTYGEVLESKIILDRETHRSRGFGFVTFSTEEAMRNAIEGMNGKELDGRNITVNEAQSRGGRGGGGGGYGGGRGGGGYGGGGRHDGGGGYSGGGGYGGGGGYSGGGGGYCGGNRGGCYC

SEQ ID NO: 43066 - DNA, 644 bp, Zea mays
  misc_feature: Ceres CLONE 1442668-F
  misc_feature: Encodes the peptide sequence at SEQ ID NO. 43067
aagctggagctccccgcggtggcggccgctctagaactagtggatcccccgggctgcaggaattcgcacgagaccattacctagaacatcctaatcgaaaacatccgctccccgccttccgcttccctaccccccgcatcacctaccaacgccgacaccatgggggccttcgcgaaggaggagcaccagttcctagccgagctcgggctcgagcagcgcaacccaggcgcgttcgcatgcggtgcgtggggcggctcacgtcccaccgtcacctccacaagcccgaccaacaatcaggtcatcgcagaggtcgtggaggcgtccgtgcaccactacgaggagggcatgctcacctgcttcaatgcctccaagacatggatggcgattcctgctccaaagcgaggagagatcgataggcaaatcggtgatgcactgagagcaaagctccatcaccttgacaggcttgtgtcacttgagatggggaaaattcttcctgaagggatcggtgaggttcatgaaatcatcgacatgtgtgattatgctgtgggggtaattcgccaactaaatggatccattataccatctgaacgaccaaaccatatgatgatggaggtgtggaatccccttggagttgtgggaggtat

SEQ ID NO: 43067 - protein, 161 aa, Zea mays
  misc_feature: Ceres CLONE 1442668-F
  misc_feature: SWISSPROT Homolog: EC 1.2.1.3 Aldehyde dehydrogenase (NAD(+))
MGAFAKEEHQFLAELGLEQRNPGAFACGAWGGSRPTVTSTSPTNNQVIAEVVEASVHHYEEGMLTCFNASKTWMAIPAPKRGEIDRQIGDALRAKLHHLDRLVSLEMGKILPEGIGEVHEIIDMCDYAVGVIRQLNGSIIPSERPNHMMMEVWNPLGVVGG

SEQ ID NO: 43068 - DNA, 610 bp, Zea mays
  misc_feature: Ceres CLONE 1442675-F
  misc_feature: Encodes the peptide sequence at SEQ ID NO. 43069
agctccccgcggtggcggccgctctagaactagtggatcccccgggctgcaggaattcgcacgagaccattacctagaacatcctaatcgaaaactccgaatccgagggttcaagcgaccgacggcgaacatggcggcggacggcggcccagcgacgtcggcgctggaagaggccctcaagcccttccaggaaagagcctccgaggctgagatacgcatagcgaagctggaagccttgctgtacaacaaagatggtccgagcggtggatccgaggcaacttactctgccgtgaaggatctccagtcgaagctagatgttgttactgcagaatgcttgactgaaaaggataagaacaagaagctgaccatggagaacgagaagctccagtaccgcatgacccatctgatccgtgcgataaaagaggcggaatcgagataggagcagcccggcgaggcccattcaaagcctgatgtcgaagtgttacccacccgccttgttgatcgttcacgttgttcctgcatctacctcaagctatccttgtgatcttgagatagagattggtcacaagtcaagactggtattattcaaactggtgggatccaaaagggg

SEQ ID NO: 43069 - protein, 102 aa, Zea mays
  misc_feature: Ceres CLONE 1442675-F
MAADGGPATSALEEALKPFQERASEAEIRIAKLEALLYNKDGPSGGSEATYSAVKDLQSKLDVVTAECLTEKDKNKKLTMENEKLQYRMTHLIRAIKEAESR

SEQ ID NO: 43070 - DNA, 597 bp, Zea mays
  misc_feature: Ceres CLONE 1442681-F
  misc_feature: Encodes the peptide sequence at SEQ ID NO. 43071
  misc_feature (507)..(507): n is a, c, t, g, unknown, or other
  misc_feature (508)..(508): n is a, c, t, g, unknown, or other
  misc_feature (511)..(511): n is a, c, t, g, unknown, or other
  misc_feature (518)..(518): n is a, c, t, g, unknown, or other
ggagctccccgcggtggcggccgctctagaactagtggatcccccgggctgcaggaattcgcacgagaccattacctagaacatcctaatcgaaaaaccgcgacgctctatctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccgtccgccattgccggcaagctcggatctctccctttccaggcctgcgagcatcagatcgtcaccgtcgactgccagccatcgggtccccagggaggcatgctcgtcttcgtctccggttccatacgcaccggccccgaggagcaccccatcaagttctcccaggcattccatttgctgccgggccgctggtcctttcnntcntgcaaantgacattgttcccgcttaaacttttggttaaaaaaacgccaaaaacctttgtggttaaaaaagatttttttaagggttt

SEQ ID NO: 43071 - protein, 142 aa, Zea mays
  misc_feature: Ceres CLONE 1442681-F
  misc_feature (8)..(118): Pfam Name: NTF2 Pfam Description: Nuclear transport factor 2 (NTF2) domain
  misc_feature (113)..(113): Xaa is any aa, unknown, or other
  misc_feature (117)..(117): Xaa is any aa, unknown, or other
MAMDPDAVAKAFVEHYYRTFDTNRAALVGLYQETSMLTFEGQKFQGPSAIAGKLGSLPFQACEHQIVTVDCQPSGPQGGMLVFVSGSIRTGPEEHPIKFSQAFHLLPGRWSFXSCKXTLFPLKLLVKKTPKTFVVKKDFFKG

SEQ ID NO: 43072 - DNA, 726 bp, Zea mays
  misc_feature: Ceres CLONE 1442686-F
  misc_feature: Encodes the peptide sequence at SEQ ID NO. 43073
  misc_feature (72)..(72): n is a, c, t, g, unknown, or other
  misc_feature (78)..(78): n is a, c, t, g, unknown, or other
  misc_feature (80)..(80): n is a, c, t, g, unknown, or other
aaaaagtattaacgtgtatttggaattccgccactgccagcgcgctgtggcaggagatggcacccccctttngaattnancctaagctgggactcaccgcggtggcggccgctctttactagtggatcccccgggctgcaggatttcgcacgagaccattacctagaacatcctaatcgaaaagattcaccacattcagctcgccgtgttgcgctcactcaaccaaatccaatcccggcggagggaagcgtcgtctaaattccaaccctaggccatggcgaatgcggcttcatccgcatcgtcgccgggggcaggtccctcctcctcgccgcaggccggtggagacgggggaggggacgcgcacacgccgcggcagcggcagggccggcccccgcgcgccggttccgacccgctcctcatcgtctgcggctgcttcagcgtcgtcacggtcgccaccgcgcttctctgcgtcgccgtcaacgtcgtctccgccgtccagtccttccgcgccggctccgatatattcgggggcatattccggtgctacgcggtcgtcttctccctattcgtcgccgtcctcgagaccgagtgggggttcatcatccgtttctggaagatatttgaatactgggcctgcaccggggaatgctcccggatctttggttgcctgtcatgaacgaaaggcattcccccaactattggaaagggaatgatccctcaaattgg

SEQ ID NO: 43073 - protein, 133 aa, Zea mays
  misc_feature: Ceres CLONE 1442686-F
MANAASSASSPGAGPSSSPQAGGDGGGDAHTPRQRQGRPPRAGSDPLLIVCGCFSVVTVATALLCVAVNVVSAVQSFRAGSDIFGGIFRCYAVVFSLFVAVLETEWGFIIRFWKIFEYWACTGECSRIFGCLS

SEQ ID NO: 43074 - DNA, 625 bp, Zea mays
  misc_feature: Ceres CLONE 1442691-F
  misc_feature: Encodes the peptide sequence at SEQ ID NO. 43075
  misc_feature (625)..(625): n is a, c, t, g, unknown, or other
ggagctccccgcggtggcggccgctctagaactagtggatcccccgggctgcaggaattcgcacgagaccattacctagaacatcctaatcgaaaagaagcatccaggcatccagcaaatccagcgggtccgtactcatctgcttcacctccgggctccggctacggcggcactcttctctggcaaccggaccacagaaacctctaggcgacgaatcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccttccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaacacatgatcgggaacgtgtacgtgtagttccgcgagaagtagcaggcggcccgcgccctgcn

SEQ ID NO: 43075 - protein, 114 aa, Zea mays
  misc_feature: Ceres CLONE 1442691-F
  misc_feature (13)..(39): Pfam Name: zf-CCCH Pfam Description: Zinc finger C-x8-C-x5-C-x3-H type (and similar)
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLAEHMIGNVYV

SEQ ID NO: 43076 - DNA, 610 bp, Zea mays
  misc_feature: Ceres CLONE 1442693-F
  misc_feature: Encodes the peptide sequence at SEQ ID NO. 43077
tggcggccgctcttgcatacgtggatcccccgggctgcaggaattcgcacgagaccattacctagaacatcctaatcgaaaaattgcaagattttgtctttgagtcagttgatggccggcgctacatcaaccttacttttggttgccctctattggatactgtggttgacgatcttacagttaaagttgtgcttcctgaaggatcaaaaaatccagagcatgtagttccttttgtgacagagaaacatcttgagactagttattcataccttgacgttgttggaaggacgacggttgtactgaagaagaaaaatgttgtaggggagcacaacgttcctttccaggtgtactatgaattcaatccgatcttcatgctggcggaaccattgatgctgatatctgcagtgttgctgtttttcgttgccttcattgcgtatcttcacatggatctttccatcagaaaatcatcatagggctgttggcaattctgtccaccacagtattttttgaagcacatgttctgctaactggggattgaagaataccaatccttgtcctaccgcctaatttaacctgtttaccaggccccatctctcatgggaaaaggaaa

SEQ ID NO: 43077 - protein, 33 aa, Zea mays
  misc_feature: Ceres CLONE 1442693-F
MLAEPLMLISAVLLFFVAFIAYLHMDLSIRKSS

SEQ ID NO: 43078 - DNA, 631 bp, Zea mays
  misc_feature: Ceres CLONE 1442713-F
  misc_feature: Encodes the peptide sequence at SEQ ID NO. 43079
ggagctcaccgcggtggcggccgctctagaactagtggatcccccgggctgcaggaattcgcacgagaccattacctagaacatcctaatcgaaaaagcgaaatccaaaagcccgttcgaccccaaacaccgactgaccgacacgactccccccttcgtcttccaatccgccgctgttcgagtagtcggcggcgcggcgccggcggccggggcggcggcgatgaatcccctcacgcaggtgaagcggacgcagattatcaaccagaaggaggcgctcctgggcatcggcgaggacgcgtcgtggcacgccaagtttaaggactcggcctacgtctacgtcggcggcgtccccttcgacctcaccgagggcgacctcctcgccatctttgcgcagtatggtgaggttgtcgacgtgaacctcgtgcgcgacaagggcaccggaaaatccaaggggttcgcgttcctcgcgtacgaggaccagagaagcacgattcttgctgttgacaatttgaatggagctaaagttcttgggaggatcataaaggttgaccatgtgagcaagtacaagaagaaggaagaggaagatgaggaggagctgcagaagaagagggaggcccgtggagtctgctat

SEQ ID NO: 43079 - protein, 137 aa, Zea mays
  misc_feature: Ceres CLONE 1442713-F
  misc_feature (38)..(109): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MNPLTQVKRTQIINQKEALLGIGEDASWHAKFKDSAYVYVGGVPFDLTEGDLLAIFAQYGEVVDVNLVRDKGTGKSKGFAFLAYEDQRSTILAVDNLNGAKVLGRIIKVDHVSKYKKKEEEDEEELQKKREARGVCY

SEQ ID NO: 43080 - DNA, 615 bp, Zea mays
  misc_feature: Ceres CLONE 1442714-F
  misc_feature: Encodes the peptide sequence at SEQ ID NO. 43081
ggagctccccgcggtggcggccgctctagaactagtggatcccccgggctgcaggaattcgcacgagaccattacctagaacatcctaatagaaaaatagatgaagactaggtcgcagacgtcgccgaagcctctcaagacggtggcgatggctcccaggccgagcagcaccaagcggaagccgaggcccaagccggcggggaagggcgacccccgcgcacccaagaagccacccaccgccttcttctacttcatggaggattttcgcaagatctataagcaagaaaaaccaagtgtaaaatccatgcaggaaatagggaaggcatgtggcgaaaaatggaataccatgacatttgaggaaaaggtccagtattatgatatagctactgagaaacgtgcagaatttgagaaggcgatgattggatattacaagaaaaagggaagctgaacatttgtctgtgtccaattccccgaggttcactgtgactggatgaatccatccgctgtgtattacacaaatgtgatttttagtggaaattttaaataccactagttggaaccgtccgctcacgccaaatgtatctctttggaatccacctggcccttttgatgacc

SEQ ID NO: 43081 - protein, 115 aa, Zea mays
  misc_feature: Ceres CLONE 1442714-F
  misc_feature (41)..(110): Pfam Name: HMG_box Pfam Description: HMG (high mobility group) box
MKTRSQTSPKPLKTVAMAPRPSSTKRKPRPKPAGKGDPRAPKKPPTAFFYFMEDFRKIYKQEKPSVKSMQEIGKACGEKWNTMTFEEKVQYYDIATEKRAEFEKAMIGYYKKKGS

SEQ ID NO: 43082 - DNA, 617 bp, Zea mays
  misc_feature: Ceres CLONE 1442723-F
  misc_feature: Encodes the peptide sequence at SEQ ID NO. 43083
ggagctccccgcggtggcggccgctctagaactagtggatcccccgggctgcaggaattcgcacgagaccattacctagaacatcctaatcgaaaaattcattaccggaagagaaaaaaataactcggaaaagaaggagacgccgaaaattcgaaaggggagggggaaagcaaagctgatggcggaggcccaggggaaagcaaagcaaatggcggaggccccgagcaagatcgaatccatgaggaagtgggtcgtcgagcacaagctccgagccgtaggttgcatgcgcaagctctaaccctcgctgcattagttggttctgcatgcgtggagtactatgaccagaagtatggttcttctgggccaaaggtggacaaatacacaagccaatacctggcccattcgcataaagattaaaggtcgccatgttggttcctgcatgccggattaattttgggctcatctcgggttgctcatgacccgcccatggatgctggatgtttattcttttttttttgtcttcataattacaaaatggtggtgtacttgccaggcaaatgttaatgagggtataatgcagatattgtcgtcataatttggcctcatgttgcattatc

SEQ ID NO: 43083 - protein, 39 aa, Zea mays
  misc_feature: Ceres CLONE 1442723-F
MAEAQGKAKQMAEAPSKIESMRKWVVEHKLRAVGCMRKL

SEQ ID NO: 43084 - DNA, 751 bp, Zea mays
  misc_feature: Ceres CLONE 1442730-F
  misc_feature: Encodes the peptide sequence at SEQ ID NO. 43085
  misc_feature (68)..(68): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (88)..(88): n is a, c, t, g, unknown, or other
  misc_feature (110)..(110): n is a, c, t, g, unknown, or other
  misc_feature (112)..(112): n is a, c, t, g, unknown, or other
  misc_feature (139)..(139): n is a, c, t, g, unknown, or other
aacccaaataccgtccccggtgctccgacagaaaggtcggtgggtttattaatggggtttttggaatnggggggnnnttcaaactggnactccacgcgggggcggccgcncngtaactaaacagcccccgggctgcagngaatcccacgagaggggtacctagaacatcctaatcgaaaagtgagcttcgttcgttctgttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattattatagctaaataaagtatagcggcgtcgctgtgtgtgtttcgagtcagtcagtccgttaagttgcgtgccatgggctggcatgcctctgagttctgagatgaatgatgatgccctggatggcgggggccgtggtcctgtaggtccctcccctggcccccctcgggggcgcttccgggcgggccaagcaagtggtgggtcgcgggtagcgggtcgga

SEQ ID NO: 43085 - protein, 82 aa, Zea mays
  misc_feature: Ceres CLONE 1442730-F
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAAAGAENGGCKCGGNCQCDPCNCGK

SEQ ID NO: 43086 - DNA, 720 bp, Zea mays
  misc_feature: Ceres CLONE 1442731-R
tgtgtaccgggccccccctcgaggtcgacggtatcgataagcttttttttttttttttttaatcagccaaaaaaaacaaatgtttttccttaaaaatattcattgatttctcgaccatttgccaaaaaaaaacaagatcgtgcttgggaaatcaaaggtaaggagcagggtaaacaaaatcaggagaccgaattatatgcatttggcaccacgcacggcaccacaaattagctcactcgctggattggacagtgcctcccgctcctgctgctggctcgtcgaaatcatcgaagctcaagcttagagtttgcagcttgaacccagctccctggatagcttccaccaggttcgaggctactccagtagcttgcacagttgtctcctttgttaacacaacgctccctatgccttcttcaatgagcacctccaggtccttgactccctccataccctcaagagattctgtgatcttgggaatggccctctcctccatggtgccctccgccctgaagtaaagatgaagggatccgaagtggaggcgggcccgccacatccacggtggccccgcgcaccttggccatccggcgcattcttcccctcctcccagggaacactcccccccttggcccaaaaaaacttccgggaaaaccccccgtgggacgggggaataccccaccggcgaatgggaaaagttggctaaacccccccaacaaactctct

SEQ ID NO: 43087 - DNA, 741 bp, Zea mays
  misc_feature: Ceres CLONE 1442735-F
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
ttttttttttctttccctccgcccgcccttaggatatatcaaaatactcgtgtcgtcttttaaattttttttnnnnnnttgtttttttaaaactggagctccaccgcggtggcggccgttcttcactagtggatcccccgggctgcaggttttcgcacgagaccattacctagaacatcctaatcgaaaaagtagaaaagagatgtatgcatcgaaacaattggtttggtttctcaaattttccagctcgagataggtcgggaggaccagaaattcaggggtaaaactgtcatactacccgccagattccaaactccagttccttgtcatcatctcttgctttgttttgttcttccgaccttgcctcgccgcatctgctcctccagacacagcgcacccgccttcctcatcctgattccgtggccggcggccgcctaacctcagccccctcacccccaccgacgccgccggagcccttgaagtagcggacccgggttctcgcgcccatccgcgtcaggagttcgatgtccgttttgcgcctgatggatccccaccgggctgaccgggccccgccggcgtcccgacccctaacgaatgccccactgacccggggataaacggatggaactttcggtggatcccccaacgcctttatagggggttgaaaaaaaactctcccaaacaatccgtgttgtaactcgcggcgaaacaagcttcttcccaggcgggcctcataccccg

SEQ ID NO: 43088 - DNA, 746 bp, Zea mays
  misc_feature: Ceres CLONE 1442739-F
  misc_feature: Encodes the peptide sequence at SEQ ID NO. 43089
  misc_feature (10)..(10): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
cccccgccgnccctcccccggcgcggcccaccctcacgtggaacgggcaggacggacccccgggnnnagaggccggggatagcggggctccccgcggtggcggccgctctttccctagaggatcccccgggctgcaggatttcccacgagaccattacctagaacatcctaatcgaaaaaacgcaagcgcagacactagcgatccgatccgatccggaactgtgccggccagccatggcgactagggttttgctcaccgccctcctcctcgccttcctcctcgtcgccacccctttcaccgcccgagttgctagagctgattcggaggaagatgctgctgcagctgaggttgttgaaggggctgatctaggtattgtgggtgatgatacacaggtttccagtgatggacctttaagccctgctcctggtgtagagacagtagttgtattccccaaaaatgctggcaaaattgtactaccgggtgaagaaactgaattacaagttggtctgcaaaaggagggggaaccgactttgaatgggggtgctggccatccaactctccatcctccctttggcccataatatggatggcccaaaaccttaccgggtcgaaaattttcttcaaacccatccagtcccccggtttctggtgacaaacgaaccctcccccctaaaaaaaatccggctgggcgacgcaaggctcctagggagggcccgggggcacctcacaggaaaacatggggccg

SEQ ID NO: 43089 - protein, 115 aa, Zea mays
  misc_feature: Ceres CLONE 1442739-F
MATRVLLTALLLAFLLVATPFTARVARADSEEDAAAAEVVEGADLGIVGDDTQVSSDGPLSPAPGVETVVVFPKNAGKIVLPGEETELQVGLQKEGEPTLNGGAGHPTLHPPFGP

SEQ ID NO: 43090 - DNA, 630 bp, Zea mays
  misc_feature: Ceres CLONE 1442740-F
  misc_feature: Encodes the peptide sequence at SEQ ID NO. 43091
tttactggtggatcccccgggctgcaggaattcgcacgagaccattacctagaacatcctaatcgaaaagaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggtggtatggcggcgccgccggcgagggccagggccgactacgactaccttatcaagctgctcctcattggagacagcggtgttggcaagagttgcctcctgttgcggttctctgatggttccttcactacaagctttattaccacaattggtattgacttttagatacgaacgatagaattggatggcaagcgtataaagctacagatttggggatacggggggccaagaacccttcccgggactattacacccgcgtactacccgaggagctatgggccatcttgcttggtttatgatgtcacccgatgaaatcttctttttaccaacttcccgaaacttggattccggaaactttgaaccaccccgccttcttaataatgccaacaaaaatttttgggttgggaaacaggggccca

SEQ ID NO: 43091 - protein, 52 aa, Zea mays
  misc_feature: Ceres CLONE 1442740-F
MAAPPARARADYDYLIKLLLIGDSGVGKSCLLLRFSDGSFTTSFITTIGIDF

SEQ ID NO: 43092 - DNA, 851 bp, Zea mays
  misc_feature: Ceres CLONE 1442748-F
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (80)..(80): n is a, c, t, g, unknown, or other
  misc_feature (851)..(851): n is a, c, t, g, unknown, or other
gcctgtggttcggtctccttggacgtgggcggggggggggtgggggggggcggggggggggcccaannntnattcccccnccctaaaactggggctccccgcggtgggggccgctctatcctagtggatcccccgggctgcaggattcccacgagaccttacctagaaatcctaatcgaaaaatcttcctcggtctctccgccgcccaccacctccctccccctcctctgtttatacgccaccgcgggagggggatccccccatcccttgcccgtcgctgcattgctcccctaaccggtggccagagacagcgcagagggcagagaagggcggccggttatttaaccgccgccaaagtctgggcgcccgggggccccaaaatcccgcccggaaaaggaggggacgcccccggctgcccggcggggggtcagcgggcccccccccccttcggccagggaccccccggcgcccccgccgggccgcgggggggggccgtaacccggccgcgcccgaggggggggtgggggcgggcagcaggaggccggctttccccccccgcgcgaacgcccccaggttttgccccgcgcggcccgccaacgacgtaggcgcggtgggttaatggaggggagaaacgcgcaaacgaccaaacgacagacgcaagtgatacacgcctcggccggcggagacaggggacgcctcacctccccgccgccgtcacgcaggagcaacacctgtttcgccgcgcccagcggcccggcgcgtggtccacataaagagagaggggggtgagcgacacacacgccacaacggcaccccacggcccgccaggcgacacgcccccaccgtcatcn

SEQ ID NO: 43093 - DNA, 808 bp, Zea mays
  misc_feature: Ceres CLONE 1442750-F
  misc_feature: Translation starting site: 720
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
naattttttcgtttnnactcgtgccggcccgccccccccccctagtatgatgcggggtgggggccnnnnggggtcacattataaagctggagctcaccgcggtggcggccgctctttaatagtggatcccccgggctgcaggatttcgcacgagaccattacctagaacatcctaatcgaaaagtttcctggcggcgacggctggtcaagcggcgccgcccttggctaggtcttcgctgggtccttccccggcgacgagcgtccatctggggtcgactgaactgagcaggcagtaggaagagacactatgttgttcttctcctacttcaaggagctggtggggaaggaggtgacagtggagctcaacaacgacttggcgattccgcgggacgccccactcggttgaccagtacctcgaacatcaaccctcgagaacaacccgccgtactcgaccacggaaaaagtgatcccccacatgccttttcaccgcccccaactcgccccccctccaggcggctccgggggggcgcccgcttacggtgccctgtcttccccccagggacccgggccgggggcacattccaacaatcactccccaccgaacctcccccccttccaggggcgggtcctcccccgcaagccctgtattccttgaaacgccccaaccccgctcccccttcacccttggcccgggccggcttgcctctagccccgccggaatgtgcaccgcaagccatgccactgtccgccggtggcggcctcatatccacacaaacggccccccgcattcagagatccacttcgacgg

SEQ ID NO: 43094 - DNA, 645 bp, Zea mays
  misc_feature: Ceres CLONE 1442756-F
  misc_feature: Encodes the peptide sequence at SEQ ID NO. 43095
ggagctccccgcggtggcggccgctctagaactagtggatcccccgggctgcaggaattcgcacgagaccattacctagaacatcctgatcgaaaaagatcagaccacactcgtagagagaaggaaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcgggaacggcaccggcggcgagtccatctacggcgagaagttccccgacgagaagttcgtgcgcaagcacaccgccccccggtgtgctctccatggccaacgccggggcccaacacccaacggctccccagttcttcattctgcaccgtcgcgacccccttgggctcgacgggcaaagcacggtcgtcttccggccagggtccgtccgaggggcatgggaacgtccttcaaagggcccatcgaggaaggggggggccacc

SEQ ID NO: 43095 - protein, 162 aa, Zea mays
  misc_feature: Ceres CLONE 1442756-F
  misc_feature (5)..(162): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKHTAPRCALHGQRRGPTPNGSPVLHSAPSRPPWARRAKHGRLPARVRPRGMGTSFKGPIEEGGGH

SEQ ID NO: 43096 - DNA, 722 bp, Zea mays
  misc_feature: Ceres CLONE 1442760-F
  misc_feature: Encodes the peptide sequence at SEQ ID NO. 43097
  misc_feature (1)..(1): n is a, c, t, g, unknown, or other
  misc_feature (34)..(34): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
ngtattttgcctgtccgccaggcccccccccaancccccccatatcctagtgccgccgcctaggcttttataannnnnnnnnnntttatactggagctccccgcggtggcggccgctctataatagtggatcccccgggctgcaggaattcgcacgagaccattacctagaacatcctaatcgaaaaagctgctcttctccatggccgcccccattatcctttccctgcgtcgaaggcgcatcttttcctagctctccccgacaaccctacccgtttcctggcctccgcctccgtccgggtcgcctatcctccccggtggcctctccgcgccgccgacggggagcgggacaaccgcgtgcaggagctgagggtgcccgattcttggctgacgcctgcaggagcaacgcaggaatctgaatggctgagggagacactgcgcaagtggctcgacgacgagtactgcccggagccggccaacgtggacatcagcagcaccgccgcgcggtcgtatcgcgaatccttgatagcgcggcagtctgatctgggagagatcttgctgaggatggtgggcgacctggaacaagctgtcgtacaggggagagcttccacgggcccctttcttcggccgccaacgcctgcatgcctgtttgatcgcctccagaggaatgggagggagccccctggcctggatgaaatggacgggggggtggccccgaaccct

SEQ ID NO: 43097 - protein, 53 aa, Zea mays
  misc_feature: Ceres CLONE 1442760-F
MVGDLEQAVVQGRASTGPFLRPPTPACLFDRLQRNGREPPGLDEMDGGVAPNP

SEQ ID NO: 43098 - DNA, 739 bp, Zea mays
  misc_feature: Ceres CLONE 1442764-F
  misc_feature: Encodes the peptide sequence at SEQ ID NO. 43099
  misc_feature (12)..(12): n is a, c, t, g, unknown, or other
  misc_feature (59)..(59): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
gctgggtgcgtngtcttgctttggggggcccaggcgcgcccctggggggggagtagggnccccgtnnnttgtcccctcaaaactggagctccaccgcggtggcggccgctctatactagtggatcccccgggctgcaggatttcgcacgagaccattacctagaacatcctaatcgaaaactctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccaacgaccccgaggttgcgcgctacaggcacaagcttcattgagggatccagctccattcccgtctcctctttttcgcaaccgttttccccggttccttttcctggattccgggttaaacttacggaacctttattccggggcccttctatgggcctttgggctaaaataaaaaagtgggttattgttgctttgcccccgc

SEQ ID NO: 43099 - protein, 103 aa, Zea mays
  misc_feature: Ceres CLONE 1442764-F
MNTDITASTKPEYPVVDRNPAFTKVVGNFSALDYMRLSTISAVSVTVGYLSGIKPGIRGPSMVTGGLIGVMGGFMYAYQNSAGRLMGFFPNDPEVARYRHKLH

SEQ ID NO: 43100 - DNA, 637 bp, Zea mays
  misc_feature: Ceres CLONE 1442769-F
  misc_feature: Encodes the peptide sequence at SEQ ID NO. 43101
  misc_feature (461)..(461): n is a, c, t, g, unknown, or other
tcagaactagtggatcccccgggctgcaggaattcgcacgagaccattacctagaacatcctaatcgaaaacaaactgttaaatatctggatacgctgcatgaacatttaagcataatgttgtctgtccgcactgcattttctgatcgggcaagtgcattattgactgtgcaaacacttatgtcggatttggcatcattagagtccaggatcgagaaactcgaggctgcatccttgaagatatttggtggtgataaagctaggactcgcaaagttgaagagctaagggaaacaattagggctactgaagatgctaagttctgtgctttaagagagtacgagagaattaaggaaaataacaggagcgaactccagcgactagaccgcgaacggaaagaagaattcatgaggatgcttaaaaggatttgttgcaaagtcaggcggcctacgcggaccaaatcntaaatggatgggagaccggaccgaaggagacgagccggtaatgttggctgtgcgtggatctgaatagcatgacttcgtaaccttcctttgggtagaaaatcaaagtggttggtcaattgcaaccctagggttaaggattttgggaaatagcaaaaaagggggcgcccaggtttcaa

SEQ ID NO: 43101 - protein, 153 aa, Zea mays
  misc_feature: Ceres CLONE 1442769-F
RTSGSPGLQEFARDHYLEHPNRKQTVKYLDTLHEHLSIMLSVRTAFSDRASALLTVQTLMSDLASLESRIEKLEAASLKIFGGDKARTRKVEELRETIRATEDAKFCALREYERIKENNRSELQRLDRERKEEFMRMLKRICCKVRRPTRTKS

SEQ ID NO: 43102 - DNA, 660 bp, Zea mays
  misc_feature: Ceres CLONE 1442776-F
  misc_feature: Encodes the peptide sequence at SEQ ID NO. 43103
  misc_feature (445)..(445): n is a, c, t, g, unknown, or other
  misc_feature (447)..(447): n is a, c, t, g, unknown, or other
  misc_feature (480)..(480): n is a, c, t, g, unknown, or other
  misc_feature (531)..(531): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccctttttgntngatgtcctcaaggagggaggcgtcctccctggncatcaaggtgacagggcaccattggaggttgtttgccctgaataaggaaanacccacccaggnccatgacaacctttgccaagcgttgccgccaagtactaccaaggcaggtgccccgcctttgccaagtgggcccgctggttctcaagattggcccttatggagcccttcccaccttgt

SEQ ID NO: 43103 - protein, 116 aa, Zea mays
  misc_feature: Ceres CLONE 1442776-F
  misc_feature (11)..(117): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (91)..(91): Xaa is any aa, unknown, or other
MSAYCGKYKDELIKNAAYIGTPGKGILAADESTGTIGKRLSSINVENVEENRRALRELLFCCPGALQYISGVILFEETLYQKTKDGKPFLXDVLKEGGVLPGHQGDRAPLEVVCPE

SEQ ID NO: 43104 - DNA, 611 bp, Zea mays
  misc_feature: Ceres CLONE 1442795-F
  misc_feature: Encodes the peptide sequence at SEQ ID NO. 43105
  misc_feature (435)..(435): n is a, c, t, g, unknown, or other
  misc_feature (445)..(445): n is a, c, t, g, unknown, or other
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgaggggggaatcggggaaggaggaggtgagggagtatgaaagcgacatgaggaaagctggagagctgctttctaagctgaacccctncgcggaggangtcgtgccgcagtcccgccgccgcgtggacggcggcgctccccgccttttcgccgacgcgcccgtgttcgtgttcgcggcgatcgactactaggggcgccaccaccagntcccggcgccgaactttctggagaagcacaacccaatccctggctgcattttggtgg

SEQ ID NO: 43105 - protein, 48 aa, Zea mays
  misc_feature: Ceres CLONE 1442795-F
MVAVAVDGLIRGADAVPAAEREAVRAAAAEAAAKGGEGGIGEGGGEGV

SEQ ID NO: 43106 - DNA, 657 bp, Zea mays
  misc_feature: Ceres CLONE 1442799-F
  misc_feature: Encodes the peptide sequence at SEQ ID NO. 43107
aaactggagctccccgcggtggcggccgctctagaactagtggatcccccgggctgcaggaattcgcacgagaccattacctagaacatcctaatcgaaaaagcaggcgttcggcccggcagcccccaagtcccatcgccgagcagaaagtcaggaacagaactcaggcgttggcgattggcatctccctcccctaagccatggctaccgggcggcccgtacgactcgtgctggatgcctccctcctcctcgacccctcctccaccagggaggcggcggcggtggcgctgcggcccggggtagaggagttgctgcggcggttgcgctactccaacctgagcgtggcaatctgctatgcagagggcatgccaactaatgagtcagactttcttgaaaaggtcgcaagctcacacttgtttggatctatagtacttcttgcaaaaagtgggaatctttctccaattgaattaatgatagaatggagccgaacaagtttttgtttttatgcgacttcaagagttgacaaaggtttaatttctgagctccagaatcagaactggagagttctttctgtagctaatgaatgtagcatagaggttcctggtgttttaaatgttcaaaggcttcaggagttgcttctcaccttggctactctaa

SEQ ID NO: 43107 - protein, 152 aa, Zea mays
  misc_feature: Ceres CLONE 1442799-F
MATGRPVRLVLDASLLLDPSSTREAAAVALRPGVEELLRRLRYSNLSVAICYAEGMPTNESDFLEKVASSHLFGSIVLLAKSGNLSPIELMIEWSRTSFCFYATSRVDKGLISELQNQNWRVLSVANECSIEVPGVLNVQRLQELLLTLATL

SEQ ID NO: 43108 - DNA, 611 bp, Zea mays
  misc_feature: Ceres CLONE 1442802-F
  misc_feature (214)..(214): n is a, c, t, g, unknown, or other
  misc_feature (221)..(221): n is a, c, t, g, unknown, or other
  misc_feature (222)..(222): n is a, c, t, g, unknown, or other
  misc_feature (226)..(226): n is a, c, t, g, unknown, or other
  misc_feature (227)..(227): n is a, c, t, g, unknown, or other
  misc_feature (233)..(233): n is a, c, t, g, unknown, or other
  misc_feature (240)..(240): n is a, c, t, g, unknown, or other
  misc_feature (241)..(241): n is a, c, t, g, unknown, or other
  misc_feature (256)..(256): n is a, c, t, g, unknown, or other
  misc_feature (257)..(257): n is a, c, t, g, unknown, or other
  misc_feature (295)..(295): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (583)..(583): n is a, c, t, g, unknown, or other
  misc_feature (586)..(586): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaagagagagagagtgtgtgtgatcggtacaaggatcaccgctgtgcctgcgcgtgctgcttcaccgaatcgagtcagatcctgtccgaatccgagctaagggatggcaaccgtngtagtgnnaagnncctcgnaagggcnnagctgaaggctgtgnngttgactggcataaacacgacagcaagaggatgctccnatgcgggttttacgcggttggggaatcttgaccccccaattcaagttcccccccggaaggcttttggggaaaaaaccccccgagaaaaaagggggtccccccccnnnnngaaagaagaaagannnnnaaaannnnnnnnnnaannnnnnnacacaccccacccccccccnnnnnnnnnnnnnnnnnnnnnnnnnnnnagnnngngnnncgggccgtccgccccccgnnnnnnnnnnnnnnntccctccgnnnncnnnnnnnccccccgcggggggggtgggggggagnagnagaannnaacaaaaaaaanaaaaaa

SEQ ID NO: 43109 - DNA, 665 bp, Zea mays
  misc_feature: Ceres CLONE 1442821-F
  misc_feature: Encodes the peptide sequence at SEQ ID NO. 43110
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaatcactaccaccgctctctcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgctccgagggccgtcttccccagcatcgttgggcgcccgcgccacaccggtgtgatggtggggatggggcagattgatgcctacgtcggcgacgaagcgcagtccaagaggggtatcctgaccctcaagtaccccatcgagcacggaatcgtcagcaactgggacgacntgaagaaaatctggcatcacacttttcaaaacgagctccgggtgggtccccaagaaaaccccgtcctccctccctgaggggccccggaccccaagggtaaccgggagagaaaggaccccaaattttggtcaaaactttaaaacccccggtttggagttgcccccccagcccctctggtttttttttgcgccggggcctacaccacgggttca

SEQ ID NO: 43110 - protein, 108 aa, Zea mays
  misc_feature: Ceres CLONE 1442821-F
  misc_feature: SWISSPROT Homolog: EC 2.7.10.2 Non-specific protein-tyrosine kinase
  misc_feature (84)..(84): Xaa is any aa, unknown, or other
MADAEDIQPLVCDNGTGMVKAGFAGDDAPRAVFPSIVGRPRHTGVMVGMGQIDAYVGDEAQSKRGILTLKYPIEHGIVSNWDDXKKIWHHTFQNELRVGPQENPVLPP

SEQ ID NO: 43111 - DNA, 621 bp, Zea mays
  misc_feature: Ceres CLONE 1442834-F
  misc_feature: Encodes the peptide sequence at SEQ ID NO. 43112
  misc_feature (433)..(433): n is a, c, t, g, unknown, or other
  misc_feature (574)..(574): n is a, c, t, g, unknown, or other
  misc_feature (576)..(576): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
tggagctccccgcggtggcggccgctctagaactagtggatcccccgggctgcaggaattcgcacgagaccattacctagaacatcctaatcgaaaaaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccngtcgctcacctttccgcccgcagctgccggggaagggcaatcgtgcggggaaccccgcccccttggaaaatttgaaagggaaaaaaaggggttctccctggggtttaaccaaaaaaaaattggggggggccccccctctcngngnnngggnnnnnnnnnnnaannnnnnnnnntgggacgggtttttt

SEQ ID NO: 43112 - protein, 116 aa, Zea mays
  misc_feature: Ceres CLONE 1442834-F
  misc_feature: SWISSPROT Homolog: EC 1.3.5.1 Succinate dehydrogenase (ubiquinone)
MAAALLRRSPAARALLSPALSSRLVASKPHSSSPAPPPPAKADSSTKTFSIYRWDPDSPSTKPHLKDYQVDLSDCGPMVLDALLKIKNEQDPVAHLSARSCRGRAIVRGTPPPWKI

SEQ ID NO: 43113 - DNA, 618 bp, Zea mays
  misc_feature: Ceres CLONE 1442840-F
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagccagtacaagagagtttggtggtgcactactcacaacctagtaggccccggggtcctccttgctgcttcaggaaatgtagcccgctataaaaatttgagagccttttgccttancttcctctgaagggggccgaaatcccccaaaacttggccccccccccccccccctttggcctttttgaa

SEQ ID NO: 43114 - DNA, 635 bp, Zea mays
  misc_feature: Ceres CLONE 1442841-F
  misc_feature: Translation starting site: 188
  misc_feature (404)..(404): n is a, c, t, g, unknown, or other
  misc_feature (484)..(484): n is a, c, t, g, unknown, or other
  misc_feature (537)..(537): n is a, c, t, g, unknown, or other
aagctggagctccccgcggtggcggccgctctagaactagtggatcccccgggctgcaggaattcgcacgagaccattacctaaaacatcctaatcgaaaaaaagtttcgtccaccatttcgctctcgcaagtcgccaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacnacgacgtcatcgagatcaagcccttcgccgcccagagtactttctccagagatggctttagcaccatgactactgctggntatgatgcccctgcagcaaggttggccaaaaaggagaggaagaaatcataccnggggtatcccgcagcgccctttggggtaagtgggctgctgaaatcaaagatccccagaagggcggtcgggttggggctggtactttcaataatcccga

SEQ ID NO: 43115 - DNA, 693 bp, Zea mays
  misc_feature: Ceres CLONE 1442842-F
  misc_feature: SWISSPROT Homolog: EC 2.4.1.207 Xyloglucan:xyloglucosyl transferase
  misc_feature (352)..(352): n is a, c, t, g, unknown, or other
  misc_feature (358)..(358): n is a, c, t, g, unknown, or other
  misc_feature (359)..(359): n is a, c, t, g, unknown, or other
  misc_feature (411)..(411): n is a, c, t, g, unknown, or other
  misc_feature (449)..(449): n is a, c, t, g, unknown, or other
aaagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctgactggagctggcgggcaccgcgcagggctgcaacttctacaggacacaaagatgacctggggcgatggccgcggcaaggtantgaacnngcggcgcgggctggacctgaacgctgaacgcacatcccggctcggggttcantccaagagcgagtacctgttccgcaaaatcgaaatgcnaattcaagtgggggccggaaacttcgtgggcgggtccccccctttctacctgggtccccaggggaacccgcaaaaaaaaattcatttcaatttctgggggaccgggggggggagaccctaccccgcacccccctttgtgtcccccggggaaggggccggggaaaaaaaatttccccccttgtgggaaaacaaaaagggggtttcccaattttttttgtgggggggaccccccatcttttttttt

SEQ ID NO: 43116 - DNA, 665 bp, Zea mays
  misc_feature: Ceres CLONE 1442843-F
  misc_feature: Encodes the peptide sequence at SEQ ID NO. 43117
caaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcaacaatggcggaccgtgaccgcaccggcatctacggcggcgcccacgccacctacgggcagcatcagcagcaaggaggaggcgggcgcccgatgggtgaacaagtgaagggcatgctccacgacaaggggccgacggcgtctcaggcgctgacggtggcgacgctgttcccgctgggcgggctgctgctggtgctgtcggggctggcactgacggcctccgtggtggggctggccgtggccacaccggtgttcctgatcttcaaccccgtgctggtccccaccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaggcgcaccgcatgatggcggaggccgcggcgcacgcgggccacaaa

SEQ ID NO: 43117 - protein, 153 aa, Zea mays
  misc_feature: Ceres CLONE 1442843-F
  misc_feature (44)..(153): Pfam Name: Oleosin Pfam Description: Oleosin
MADRDRTGIYGGAHATYGQHQQQGGGGRPMGEQVKGMLHDKGPTASQALTVATLFPLGGLLLVLSGLALTASVVGLAVATPVFLIFNPVLVPTALLIGTAVMGFLTSGALGLGGLSSLTCLANTARQAFQRTPDYVEEAHRMMAEAAAHAGHK

SEQ ID NO: 43118 - DNA, 665 bp, Zea mays
  misc_feature: Ceres CLONE 1442850-F
  misc_feature: Encodes the peptide sequence at SEQ ID NO. 43119
  misc_feature (315)..(315): n is a, c, t, g, unknown, or other
  misc_feature (338)..(338): n is a, c, t, g, unknown, or other
  misc_feature (339)..(339): n is a, c, t, g, unknown, or other
aaagctggagctccccgcggtggcggccgctctagaactagtggatcccccgggctgcaggaattcgcacgagaccattacctagaacatcctaatcgaaaaacacctcgaagccttcgaggcccgaaaccctagctcctcggcctccccgccgcttccacccatggctccaggactgcagcgcttcactgacattgccgacgacggcacgccccagctcgacgccgcgtccggcgaggagctggtccgtgtggaccgcaccgtggctgtcgcccttggcccccgctcgccggagtccccggggactctgttccnccccccccgggggagggcttctnngaaaagttcaagcgcatgtgtgacaagtcgatgataaggaaacgacacatgcacctaaccgaggagttcttgaaggagaatccgaacatgtgcgcctacatggctccttctctcgacgtcagacaagacatcgtggtggttgaagtccctaagctaggtaaagaagctgcagtgaaggccatcaaggagtggggccagcccaagtccaagatcacacacgttgtcttctgtacaacctcaggagtcgacatgcctggtgctgactaccagctcaccaagctccttggtcttcgtccctcccgtaagcgtctcatgatgtaccagca

SEQ ID NO: 43119 - protein, 103 aa, Zea mays
  misc_feature: Ceres CLONE 1442850-F
  misc_feature (1)..(103): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MCDKSMIRKRHMHLTEEFLKENPNMCAYMAPSLDVRQDIVVVEVPKLGKEAAVKAIKEWGQPKSKITHVVFCTTSGVDMPGADYQLTKLLGLRPSRKRLMMYQ

SEQ ID NO: 43120 - DNA, 655 bp, Zea mays
  misc_feature: Ceres CLONE 1442852-F
  misc_feature: Encodes the peptide sequence at SEQ ID NO. 43121
  misc_feature (468)..(468): n is a, c, t, g, unknown, or other
  misc_feature (490)..(490): n is a, c, t, g, unknown, or other
  misc_feature (505)..(505): n is a, c, t, g, unknown, or other
  misc_feature (511)..(511): n is a, c, t, g, unknown, or other
aaagctggagctccccgcggtggcggccgctctagaactagtggatcccccgggctgcaggaattcgcacgagaccattacctagaacatcctaatcgaaaagtttccccttcttccccatcgcgtgccctcgccgcagccatcttccatggcggaccagctcacggacgagcagatcgcggagttcaaggaggccttcatcctcttcgataaggatggcgacggctgcatcactaccaaggagcttggaactgtgatgcgctcccttggccagaaccccactgaagcagagctgcaggacatgatcaacgaggttgatgctgatggcaatgataccattgacttcccagagttcctgaacctgatggcaaggaagatgaaggacaccgactccgaggaggagcttgaggatgtctttcgcgtcttcgacgaggaccagatggtttcatctcggctgctgagctccgncatgtcatgaccatccctcgcnagaagctgactgacnaggagntcgaccagatgatccctgaggcccatgttgaacggtaccgccaaatcaactaccaggatttcctccaggccaggaggcccaagggggaaccttcccccgtttctttgaaagaatttgaatggaaatttcgggcaccaacccttg

SEQ ID NO: 43121 - protein, 109 aa, Zea mays
  misc_feature: Ceres CLONE 1442852-F
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (107)..(107): Xaa is any aa, unknown, or other
MADQLTDEQIAEFKEAFILFDKDGDGCITTKELGTVMRSLGQNPTEAELQDMINEVDADGNDTIDFPEFLNLMARKMKDTDSEEELEDVFRVFDEDQMVSSRLLSSXMS

SEQ ID NO: 43122 - DNA, 657 bp, Zea mays
  misc_feature: Ceres CLONE 1442856-F
  misc_feature: Encodes the peptide sequence at SEQ ID NO. 43123
aaagctggagctccccgcggtggcggccgctctagaactagtggatcccccgggctgcaggaattcgcacgagaccattacctagaacatcctaatcgaaaaacggctcctacgcttgcaagctgtggcacggatacctcattcctcacgcctgctggcgtcgatctcctccggaggctgcttctcaccgattcctgttccaaagcgaggagagatcattaggcacatcgctcgatgcactgacagcagatctccatcaccttgacaggcttgtgacacttgacatgggtaaaattcttcctgaagggatcggtgagcttcaggaaatcatcgacatgtgtgattatgctgaggggctaagtcgccaactaactggatccatatatccatctgacccaccaaactatatcatgatcgacgtctgtaatccccttggagttgtcggtgttatcacggcatttaattacacctgtgctgtgcttagctaggatgctctcattgcttaggactgtggaaattgtgtctcctggaacgcgatacaacaactcgcctgatcactattgcaatgacaaagatactggctagtgtattgaacaagaaccacttgccaggcacaatttttacatctttctgtcacggcactgaaaatgatcaagc

SEQ ID NO: 43123 - protein, 67 aa, Zea mays
  misc_feature: Ceres CLONE 1442856-F
  misc_feature: SWISSPROT Homolog: EC 1.2.1.3 Aldehyde dehydrogenase (NAD(+))
MGKILPEGIGELQEIIDMCDYAEGLSRQLTGSIYPSDPPNYIMIDVCNPLGVVGVITAFNYTCAVLS

SEQ ID NO: 43124 - DNA, 637 bp, Zea mays
  misc_feature: Ceres CLONE 1442857-F
  misc_feature: Encodes the peptide sequence at SEQ ID NO. 43125
  misc_feature (362)..(362): n is a, c, t, g, unknown, or other
  misc_feature (365)..(365): n is a, c, t, g, unknown, or other
  misc_feature (637)..(637): n is a, c, t, g, unknown, or other
tccccgcggtggcggccgctctagaactagtggatcccccgggctgcaggaattcgcacgagaccattacctagaacatcctaatcgaaaaaaattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaagggggaggacagcggcgaccgctgcccttgcgagaagcagtgcgagggccaccacgaccgggaaagcaggcancantgcgtccaggcttgcgagcgccggcgacagcagcgcggcggcagccgtgactccaacgtcgacgaggacgacagcgaccggcggtgccagatgaaatgccggcgccacagcgatcggcaggcgaggccagtggtgcgtgcagcgctgcgagcgtaagcaacaggaggaggacgccgccgccgacgacgacaacagcggccggtgccagaagagatgccagcaccacagcgatcggcaggcgaggccagtggtgcgtgcagcgctgcgagcgn

SEQ ID NO: 43125 - protein, 84 aa, Zea mays
  misc_feature: Ceres CLONE 1442857-F
  misc_feature (32)..(32): Xaa is any aa, unknown, or other
  misc_feature (33)..(33): Xaa is any aa, unknown, or other
MRCSMRKKGEDSGDRCPCEKQCEGHHDRESRXXCVQACERRRQQRGGSRDSNVDEDDSDRRCQMKCRRHSDRQARPVVRAALRA

SEQ ID NO: 43126 - DNA, 617 bp, Zea mays
  misc_feature: Ceres CLONE 1442861-F
  misc_feature: Encodes the peptide sequence at SEQ ID NO. 43127
aagctggagctccccgcggtggcggccgctctagaactagtggatcccccgggctgcaggaattcgcacgagaccattacctagagcatcctaatcgaaaaaaaaacctatcagttattcggtaccattgccatcactctctagtacgccgcaaaagacatcagccagacttcccaatttccggccacaaccatacctgctacgcttgcgccgccgcctccccccttgtcttcgcttcccgtgcaagcttcaccgccgccgtctccgactcccttcgcgatgcgaccgctttcgcgccacgattcctctatccccgccttccccgcccgcgccggttcttgcacttgaccgacccaatccgcctatctgttcccctcttccgtgcgagaggtactatcgccggccgtttcgtttcgaggctgatcggatcggcggcagatgggccgcgacgctgaggatacttcgtctccggtgtcctcgtcggaattggagcaggaagacgacgacgattgctacctgagcgatcagggggacgatgccctagaagagtctgttctccatgttctcgaggacgagcacctcgaggactgccattggtctgcctcatctgtgatcac

SEQ ID NO: 43127 - protein, 59 aa, Zea mays
  misc_feature: Ceres CLONE 1442861-F
  misc_feature: The sequence is a functional homolog of SEQ ID NO 1727 in the 10/374,780 US patent application
MGRDAEDTSSPVSSSELEQEDDDDCYLSDQGDDALEESVLHVLEDEHLEDCHWSASSVI

SEQ ID NO: 43128 - DNA, 635 bp, Zea mays
  misc_feature: Ceres CLONE 1442869-F
  misc_feature: Encodes the peptide sequence at SEQ ID NO. 43129
aagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtg

SEQ ID NO: 43129 - protein, 158 aa, Zea mays; identical to SEQ ID NO: 36864
  misc_feature: Ceres CLONE 1442869-F

SEQ ID NO: 43130 - DNA, 644 bp, Zea mays
  misc_feature: Ceres CLONE 1442872-F
  misc_feature: Encodes the peptide sequence at SEQ ID NO. 43131
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (435)..(435): n is a, c, t, g, unknown, or other
  misc_feature (436)..(436): n is a, c, t, g, unknown, or other
  misc_feature (457)..(457): n is a, c, t, g, unknown, or other
ggagctccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgtccgcggcggctgtttattgacgccggccccggggcggancnnncnnnccnncaccttgataccccccgccgntgggctgaagcgcaagctgggctgcatcgactccgccacgcggatggggcggaagaagccgctcgagagcgagtacgagctccgcgccgagatcggccagggcaagttcggctccgtccggatctgccgcgccaaggtccggccgcaacaagtttccccggaaggagctgccccaagacggcgaggg

SEQ ID NO: 43131 - protein, 140 aa, Zea mays
  misc_feature: Ceres CLONE 1442872-F
  misc_feature (67)..(67): Xaa is any aa, unknown, or other
  misc_feature (68)..(68): Xaa is any aa, unknown, or other
  misc_feature (69)..(69): Xaa is any aa, unknown, or other
  misc_feature (70)..(70): Xaa is any aa, unknown, or other
  misc_feature (71)..(71): Xaa is any aa, unknown, or other
  misc_feature (78)..(78): Xaa is any aa, unknown, or other
MDSLPRKRKGARAACSLAGSRHDAPAARKRTCREPKPRPEKKKPSSADEGSASVRGGCLLTPAPGRXXXXXTLIPPAXGLKRKLGCIDSATRMGRKKPLESEYELRAEIGQGKFGSVRICRAKVRPQQVSPEGAAPRRRG

SEQ ID NO: 43132 - DNA, 589 bp, Zea mays
  misc_feature: Ceres CLONE 1442876-F
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (422)..(422): n is a, c, t, g, unknown, or other
  misc_feature (423)..(423): n is a, c, t, g, unknown, or other
  misc_feature (433)..(433): n is a, c, t, g, unknown, or other
  misc_feature (439)..(439): n is a, c, t, g, unknown, or other
  misc_feature (465)..(465): n is a, c, t, g, unknown, or other
  misc_feature (498)..(498): n is a, c, t, g, unknown, or other
  misc_feature (499)..(499): n is a, c, t, g, unknown, or other
  misc_feature (509)..(509): n is a, c, t, g, unknown, or other
  misc_feature (510)..(510): n is a, c, t, g, unknown, or other
  misc_feature (523)..(523): n is a, c, t, g, unknown, or other
  misc_feature (543)..(543): n is a, c, t, g, unknown, or other
  misc_feature (556)..(556): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
aagctggagctccccgcggtggcggccgctctagaactagtggatcccccgggctgcaggaattcgcacgagaccattacctagaacatcctaatcgaaaaattttttcgcccgccgcccccagtcccgatccgaagctgtgcctcgtaccatttcgatcgcaatggcgccgacgtctaagctgtcgacgggggtcaatctaatggcgcgcttcgcggtcgcacgcgtaccatcgccgtgggctgtgggccatcaaggccaagaacggcggcgccttccccaaggccgaacaggccgacagccgacctgtggcaaacccaatgtttcctaccccctgggccgaacaaagannnnnncccccgcgnnnnnnnnnnnnnnnnnnnnnnnnnnncnncnncnncncnnnnnnnnnnnnnnnncgnngggggggggngggggnggggggggggggggggccgccccgcngggcccgggcggccccccccccccccggcccgnnccgccggcgnnggcgcggcggggngcgcgcgcggccgggcgggngcggggggccccncccccccgccggccgccgcnnnncncccgcccc

SEQ ID NO: 43133 - DNA, 626 bp, Zea mays
  misc_feature: Ceres CLONE 1442877-F
  misc_feature: Encodes the peptide sequence at SEQ ID NO. 43134
aagctggagctccccgcggtggcggccgctctagaactagtggatcccccgggctgcaggaattcgcacgagaccattacctagaacatcctaatcgaaaaatcccacccattcactcgcctgcactccctcgccgccccagttccccaccccctgctacacccacccgtcccctcctgctcgcccatgggtcccatcgctgtcggcgacgccctccccgacggccagctcgggtggttcgaccagaacgaccaactgcagcaggtctccgtccacgcgctcgacgccggcaagaaaggcatcctcttcggcgtccccggcgccatcaccccgacctgcagcaaccagcatgtgccaggcttcatcacacaggctgagcagttcaaagccaacggtgtagacgatatcctgcttatcagcgttaaccaccccttcgacatgaaggcgtgggcgaagacctaccccgagaacaagcacgtgaagttcctcaccgacggatctggagcgtacaccaaggcgctcgacctcgagctcgatctcacggacaaagggctgggcatacgctcaaagaggttcgctctcctggccgacgacctcacggtcaccgtcgcaaacatccaggaagg

SEQ ID NO: 43134 - protein, 146 aa, Zea mays
  misc_feature: Ceres CLONE 1442877-F
  misc_feature (5)..(144): Pfam Name: Redoxin Pfam Description: Redoxin
  misc_feature: SWISSPROT Homolog: EC 1.11.1.15 Peroxiredoxin
MGPIAVGDALPDGQLGWFDQNDQLQQVSVHALDAGKKGILFGVPGAITPTCSNQHVPGFITQAEQFKANGVDDILLISVNHPFDMKAWAKTYPENKHVKFLTDGSGAYTKALDLELDLTDKGLGIRSKRFALLADDLTVTVANIQE

SEQ ID NO: 43135 - DNA, 649 bp, Zea mays
  misc_feature: Ceres CLONE 1442878-F
  misc_feature: Encodes the peptide sequence at SEQ ID NO. 43136
  misc_feature (480)..(480): n is a, c, t, g, unknown, or other
aagctggagctccccgcggtggcggccgctctagaactagtggatcccccgggctgcaggaattcgcacgagaccattacctagaacatcctaatcgaaaagtcatctagtattatatacagtacattcattcgcttcgccacgtacgttcagcatcgtcgtctttcgaaaaatgtggttcggtggcggacccatcgacgcggcgggcgcgctgcgcggcttcttgcgggaagcaggcgggtgcgcggtggtggacgggggtctcggcacggagctggaggcgcacggcgcggacctgcacgacgcgctctggagcgccaagtgcctcgcctccgccccgcatctcatccgcaaggtccatctggactacctcgaagcaggcgcggacgtcataatctctgcgtcctaccaggccacgatcgaggggttccagtcgaggggcttctcgcgggacgagagcgaggagctgctgcggcgtancgtgcacgtcgcgcaggaggcgcgcagggtcttcgcggcggagggcgacaggtcatcgcgccgcggacgcccgccggcgctggtggcggcctcggtcgggagctacggggcgtaccgggcagacggctccgagtacagcggggattatggaaaatcgatgacgaaagaa

SEQ ID NO: 43136 - protein, 159 aa, Zea mays
  misc_feature: Ceres CLONE 1442878-F
  misc_feature: SWISSPROT Homolog: EC 2.1.1.10 Homocysteine S-methyltransferase
  misc_feature (103)..(103): Xaa is any aa, unknown, or other
MWFGGGPIDAAGALRGFLREAGGCAVVDGGLGTELEAHGADLHDALWSAKCLASAPHLIRKVHLDYLEAGADVIISASYQATIEGFQSRGFSRDESEELLRRXVHVAQEARRVFAAEGDRSSRRGRPPALVAASVGSYGAYRADGSEYSGDYGKSMTKE

SEQ ID NO: 43137 - DNA, 641 bp, Zea mays
  misc_feature: Ceres CLONE 1442881-F
  misc_feature: Encodes the peptide sequence at SEQ ID NO. 43138
aagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtctt

SEQ ID NO: 43138 - protein, 137 aa, Zea mays
  misc_feature: Ceres CLONE 1442881-F
  misc_feature (49)..(137): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLV

SEQ ID NO: 43139 - DNA, 620 bp, Zea mays
  misc_feature: Ceres CLONE 1442882-F
  misc_feature: Encodes the peptide sequence at SEQ ID NO. 43140
aagctggagctccccgcggtggcggccgctctagaactagtggatcccccgggctgcaggaattcgcacgagaccattacctagaacatcctaatcgaaaaaccacgcttgcgtgaatgccctcgccgcctctccccgtgctcgcccaaatcgccgcctctccctccctgtcgcccctgcgccatggtgcttcacgccgttgaagtcacctcactcatcctgccgatgcagtcacccacaccgcctcctcccctccgctcaagccgcaccgcgacgtcagctgccagcaacgccctccccctcttaacaacgtcgcggcgtcctcgtgggctaacccccctccatcacttcttctcgccgagatgcacaacaccaggagctccatccaccttctccagcacccccacccccgctcaaatggtgtcgcgatgtccgccaccaacagcgccccttcccccctctcaaacaacgtcgcggcgtctgcgaattctagtaccggctgacagcggctgcggcgaagctatatgagaggtagcggagtactaaggggtggagagagggagcactgtctcaaacatgaaagaaagtctccaaaacaaaaaattggtccaaaagggcgc

SEQ ID NO: 43140 - protein, 32 aa, Zea mays
  misc_feature: Ceres CLONE 1442882-F
MRGSGVLRGGEREHCLKHERKSPKQKIGPKGR

SEQ ID NO: 43141 - DNA, 644 bp, Zea mays
  misc_feature: Ceres CLONE 1442883-F
  misc_feature: Encodes the peptide sequence at SEQ ID NO. 43142
aagctggagctccccgcggtggcggccgctctagaactagtggatcccccgggctgcaggaattcgcacgagaccattacctagaacatcctaatcgaaaaatcccaattggaagggcagctaataaggtaaggggcgacgaaaatggctccaacgaccgccaccaaggacgacagtggctacggcgacgagcgccggcgcgagctgcaggcgttcgacgacactaagctgggggtgaaaggtctggtggactccggcgtcaagtccatcccgtccatcttccaccacccgccggaagccctgagcgacataatttctccggcgcctctgccgccgtcgccgccctccggagccgccatcccggtggtggacctctcggtgacacggcgcgaggacctagtcgagcaggtgaggcacgcggccgggacggtgggcttcttctggctggtgaaccacggagtgcccgaggagctgatgggcggcatgctccgcggggtgcgccagttcaacgagggcccccgtggaggcgaagcaggcgctctactcgagggacctcgctcgcaacctgcgcttcgcctccaacttcgacctcttcaaggctgctgcggccgactggcgcgacacgctgcttctgcgaggtggct

SEQ ID NO: 43142 - protein, 166 aa, Zea mays
  misc_feature: Ceres CLONE 1442883-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPRGGEAGALLEGPRSQPALRLQLRPLQGCCGRLARHAASARW

SEQ ID NO: 43143 - DNA, 691 bp, Zea mays
  misc_feature: Ceres CLONE 1442886-F
aaactggagctccccgcggtggcggccgctctataactagtggatcccccgggctgcaggaattcgcacgagaccattacctagaacatcctaatcgaaaacccttgcgtttcgtgtcatcgatatgtctggctttaccctccccacacggttgtttctcgcgtgtccctcacgcgctctccatcgtcttcaccactcaaagcttatgctatactgcaaaatgtcatcatcatcgtcttcctcctctctcacacactccatcacgcttccgagccaacccacggagcctgtcaatgtcgccgcagccgcgggagtctcttcctctgatttcaggaacgcggtagattcgtccttgttcaagaattggctaagaaacttagagtcagagactggaattttagctgatgggacaatgactttgaacccagttacccttcagggttgtgatatggtttggagaaagaattggcttttctcaaattcaaaagagaatattttcgaccagtgggtcttggtccaaaaggctccccggtattggcgtttgcaaagaagaaccaccgccgtagctggttctcctttccccttggacacccgaattatgggcggagactttacgcgggttttctcaatgaaaccaggttaatggtttccctaccttggcgaaaaaattgtaccttgggaatttcccccg

SEQ ID NO: 43144 - DNA, 649 bp, Zea mays
  misc_feature: Ceres CLONE 1442895-F
  misc_feature: Encodes the peptide sequence at SEQ ID NO. 43145
aaagctggagctccccgcggtggcggccgctctagaactagtggatcccccgggctgcaggaattcgcacgagaccattacctaggacatcctaatcgaaaaaggagcccagtcaatgagcttagcacttctcgagggctactcctccgccgaggaggaggacggccccgccgccggcgccggcgccgagctaagcgagtccgctgattcgtcagccgaggaagccggatcggacggcgacgaggggtccgctcctccgaagtcggccttcaagccccgccgccgaccaaaccgtaagaagggagatgccggcggcggcgacggggactcctgtctgccctccgctctggaggccttctccgatatctcgggaccaccggagttcttgaggcacagggttgcggagcctgaggaagggacggaggccctcggtgtactcgatcgccgtgggaaagaggggagcaagctgccgcctccaggagctgttgtggtggcaaaaccgcagttggttaccacaattggagccaaccctccaggttcagtgacatctggttctgttgatggaaaaagaataataggtgccgcaaatcctggtccagaagatgcagctgatcttctgaggatgtgtctccaatgtggtgtaccaaaa

SEQ ID NO: 43145 - protein, 178 aa, Zea mays
  misc_feature: Ceres CLONE 1442895-F
MSLALLEGYSSAEEEDGPAAGAGAELSESADSSAEEAGSDGDEGSAPPKSAFKPRRRPNRKKGDAGGGDGDSCLPSALEAFSDISGPPEFLRHRVAEPEEGTEALGVLDRRGKEGSKLPPPGAVVVAKPQLVTTIGANPPGSVTSGSVDGKRIIGAANPGPEDAADLLRMCLQCGVPK

SEQ ID NO: 43146 - DNA, 639 bp, Zea mays
  misc_feature: Ceres CLONE 1442897-F
  misc_feature: Translation starting site: 164
aagctggagctccccgcggtggcggccgctctagaactagtggatcccccgggctgcaggaattcgcacgagaccattacctagaacatcctaatcgaaccaccaccactggacgacagcctagcaattatgtcatcgactccagattggagaactccacaccatgaaggtgctgatcgttgcccttgctctcctggagctcactgcgagcgcctcctccagtacaagcggctgctgtggatgccagacaccaccggttcatctaccacctccgttctatatgccgcctccgttctatctaccgccgcaccagcatccgcaaccatggcaataccccactcaagcaccgcagctaaccccgtgccaccattctctgatcctgcggcgtccgcagcgtcagcaacccgttcctgggccagtgcgtctagtaccagaggaaccattgcagcccggaggaaacaccctacatttcgccacaaagccaggagctgcagcaacagggctgccaccttatcaggcaggtggagccactgcaccgggaccaggcaacataccgtgtggtcctgcagtccttcctgcacatcagccaaatggcgagctcacggcgctgatggccgcccaagtagcacatcatctgaa

SEQ ID NO: 43147 - DNA, 617 bp, Zea mays
  misc_feature: Ceres CLONE 1442900-F
  misc_feature: Encodes the peptide sequence at SEQ ID NO. 43148
aaagctggagctccccgcggtggcggccgctctagaactagtggatcccccgggctgcaggaattcgcacgagaccattacctagaacatcctaatcgaaaaatgtagctctttctggtcccaggagaacgagccgctcgctgatgtgggagcttgtcagcaccgtggatcgcccaaacggccagacgtgatgtctcgcccacgtgtcccttgcccctgtccacctgtcccctccggagcctgcaaagaactcccctccccgctatcatttccggcgcagaaaaggagagtaacactcaacactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcac

SEQ ID NO: 43148 - protein, 86 aa, Zea mays
  misc_feature: Ceres CLONE 1442900-F
MLPGRHPARRADATGTGPLLPDATRAVVAEFVATAMFVFAAEGSVYGLWKLYKDTATPGGLLAVAIAHTLALVAAVAVASNASGGH

SEQ ID NO: 43149 - DNA, 621 bp, Zea mays
  misc_feature: Ceres CLONE 1442909-F
  misc_feature: Encodes the peptide sequence at SEQ ID NO. 43150
  misc_feature (621)..(621): n is a, c, t, g, unknown, or other
tggagctccccgcggtggcggccgctcttcaactagtggatcccccgggctgcaggtttccgcacgagaccattacctagaacatcctaatcgaaaacatctgctcgataagagaaatgggatgtgggtaaagttcttcaatttcacccttctgaagagcatggatgaggatctggcagaagaagctgatgatggcatgcatcctggaaacgagcagtggctgtggccattgactggtcaggtgttctggcctggtattgctgatcgggaaagggaggagaaatacattaaaaagctagataaaaagctcaagaacaaggtgaagttacttgaaaggcagaagtctggttacaagcagaagcccctgggacaatgaccatgactgaagagctaacaattcaagatttttttccttgccacgtccggtgcatgcacgtggaagagttggagcacaaaaggcaccgctgttgtgaatacgcattctttctacgcctcattgatcctccctctccaaagaagtttgggtgagtcctgaagaatttggccaggatggaaaagcccatttttttttcccgttcgtataaaccgattagaagggaattccgttttggctcccctgcn

SEQ ID NO: 43150 - protein, 124 aa, Zea mays
  misc_feature: Ceres CLONE 1442909-F
GAPRGGGRSSTSGSPGLQVSARDHYLEHPNRKHLLDKRNGMWVKFFNFTLLKSMDEDLAEEADDGMHPGNEQWLWPLTGQVFWPGIADREREEKYIKKLDKKLKNKVKLLERQKSGYKQKPLGQ

SEQ ID NO: 43151 - DNA, 835 bp, Zea mays
  misc_feature: Ceres CLONE 1442910-F
tggctgctgctccccccctaagtgttgcccggcgcgaccctcggtgcccagcagcgggaggaggtatcccccctcccgcccaggatacttccctttgtggtgggcggtctgtcttaaacaatggatcccccgggttgcatgtattcgcacgataccattacctagaacatcctaatcgaaaaaggcctaggcttttttgaggagcgcggactagggagtagggaggacgggacgggacacagagagagaggcgcgtgcgttcgtggtcggtgccggtgcgtgcgtggcgtggtggccgtttgcctgtacgtgatccgcgcaccccctcatgctcactcgaccccggccaacgctaggaggcaccccccgggctaagaatgggaagagccaagccccttctctctcgtgcccgccctgtccgcaaatggccgggtagcaccttttcttcgcccttcccaccctttactctccagaacccggcgacgtcatctccgcggaagtatgcgtacccttggtacataccgccttcctccttcactaagtggtccggggtccccccattacatacatgattagaggccctatataccctggtgaacaaatctctcccccctgtacccttgggggcgccatcaggtagatgagcacccatcacccgagctaccacgaccccgcgttcgcactcccatgttcctttttctccctaacaatatcaaggggggaagaacaccccccaacacctcttatactcgcccccgcttacactcgccgcctacaccgccgtgctgttgaggtgggatatagtcatataaccccccctcgttggtgttgtgcg

SEQ ID NO: 43152 - DNA, 601 bp, Zea mays
  misc_feature: Ceres CLONE 1442920-F
  misc_feature: Encodes the peptide sequence at SEQ ID NO. 43153
  misc_feature (601)..(601): n is a, c, t, g, unknown, or other
tctgtactagtggatcccccgggctgcaggaattcgcacgagaccattacctagaacatcctaatcgaaaaagggagaagctcacaaacgcaggggagagctagcacagcaacaaacaatggccaagagcggcacggaggagtggcgccgcaacgccgacacgcacaaaatgagcgcggaggaggtgcgcgcggcaggggtggaggcgtcgatgcgcccgccgggccggggccccggagaggtgctgcaccagcgcggccgccgcccgctgccgtacggttccgggcaccatggcgctggtggggttcggtatcgtcggcgtcgtcagctaccttgacttgtaccagaaggacaggtccggcacgctggccactgatgtggccaaggtccccgtcggccacggcgaccccgtccccggccgggaaccggagaagcgccgcgaaggctcgcgtgaatccaagtagctccggtccattgtcaccttcataaccggatgtaacgtgcctgttgtgttcggtagggaattcacctccgttttttctgctttgcgaaacactgaatagtttcttccatcggcccggaatgtagaatccccgctccn

SEQ ID NO: 43153 - protein, 72 aa, Zea mays
  misc_feature: Ceres CLONE 1442920-F
MAKSGTEEWRRNADTHKMSAEEVRAAGVEASMRPPGRGPGEVLHQRGRRPLPYGSGHHGAGGVRYRRRRQLP

SEQ ID NO: 43154 - DNA, 621 bp, Zea mays
  misc_feature: Ceres CLONE 1442923-F
  misc_feature: Encodes the peptide sequence at SEQ ID NO. 43155
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaactctccctccctcactcactaagccaaagctgacagcagcatacaagcaccagcagagctcttgccgatggcggtggccaagcccccgcttcagacggccgcggtcctcctcctcctcctcctggtcgtcgcggccgcgtcgtggctccagaccgtcgacgccgcttcaggtacgtactactacctagtagtacctagctaggcggtcgccggccgtgtctgacgccggcgcatatatgctgcagggttctgctcgagcaagtgcagcgtccggtgcgggcgggcggcgagcgcgcgggcgcggggcgcgtgcatgaggtcctgcggcctctgctgcgaggagtgcaactgcgtgcccacgcggccgccgcgcgacgtcaacgagtgcccctgctaccgcgacatgctcaccgccggccccaggaagaggcccaagtgcccctgaggccggctcacacacggcgcaacccaagacacgtgctccatgggactgccactgctttgcctgcaactgcgatccgatn

SEQ ID NO: 43155 - protein, 43 aa, Zea mays
  misc_feature: Ceres CLONE 1442923-F
MRSCGLCCEECNCVPTRPPRDVNECPCYRDMLTAGPRKRPKCP

SEQ ID NO: 43156 - DNA, 764 bp, Zea mays
  misc_feature: Ceres CLONE 1442925-F
  misc_feature: Encodes the peptide sequence at SEQ ID NO. 43157
  misc_feature (1)..(1): n is a, c, t, g, unknown, or other
  misc_feature (13)..(13): n is a, c, t, g, unknown, or other
ntttcccattgcntctacttggagcgagggcggggggggggcgctccgctcgttgggggggggggggggggaaaactttttttaaaatgggactcaccgcggtggcggccgctctattactagaggatcccccgggctgcaggaattcccacgagaccattacctagaacatcctaatcgaaaagaacgaaacgggagacgataacgagacagcaagagccaagaggtggtgagagagaggaccgaggagggaaacagagaagatgacgacgaagcgcgacaccgagtcggacggcgaaggctccaaccccgtcggtggtggcgcgactccgccgcccctagccgccgcccctgtcgtatgcctcctccgctccgccggggacttcggaggcggcgccttcgttggatccatctccggatatggacaaggcttgatccccaagaagggttttaagggctcatgcaggagagcaggggcctctgccaagacttttgcatttctctctggcgacccgaggtgggggtcgagcttgttgccaagggccacgtggcacggaagacttcgtcaatgcgggtaaaagatggttgggtgtaccgggcctgcgttctggggcgttccaagggcctccccaggggacattgccttctagagggggtggttacccttccgcggggccaccctccaccggacttcatgggaagggggcctcccaccaacccaggcaacgccagggaatacgggcatcccgacacccccctgggga

SEQ ID NO: 43157 - protein, 104 aa, Zea mays
  misc_feature: Ceres CLONE 1442925-F
MTTKRDTESDGEGSNPVGGGATPPPLAAAPVVCLLRSAGDFGGGAFVGSISGYGQGLIPKKGFKGSCRRAGASAKTFAFLSGDPRWGSSLLPRATWHGRLRQCG

SEQ ID NO: 43158 - DNA, 628 bp, Zea mays
  misc_feature: Ceres CLONE 1442931-F
tggagctccccgcggtggcggccgctctatactagtggatcccccgggctgcaggaattcgcacgagaccattacctagaacatcctaatcgaaaaccatcagaccagtatgcactggaatttggagcttggaaggtgaaagaggaatcaaaaataggacagtgcaaacgaccagaaaagcctatcgagatatatgaatttgaagggtcagagagatggtaacagtcttggacctagatgtattattttacccctgtcctcaaaaaggcccaacattccgacctaaagtcctcgaaatgggtggaaagaaacaattcccttacatggtagatccaaacacaggggtcgccatgtatgaatccgatgacatcataaaatatctagctgatacatatggcgatggaactgttccaattatgctatcacttggtctgttgacagcaattacagcagggcttgctactcttggtcgtattggaaagggaaattcctacattgcttcaaaagtcccaccgcagcccatagagatatgggcatgtgagggatctcccttctgtaaattagtacgagagacacttgtcgagttggaattgccacatctgctacacagctgcgcacgaggcagccc

SEQ ID NO: 43159 - DNA, 602 bp, Zea mays
  misc_feature: Ceres CLONE 1442944-F
  misc_feature: Encodes the peptide sequence at SEQ ID NO. 43160
  misc_feature (391)..(391): n is a, c, t, g, unknown, or other
tggagctccccgcggtggcggccgctctagaactagtggatcccccgggctgcaggaattcgcacgagaccattacctagaacatcctaatcgaaaaaaaactcggaggaaagcagaaggggaagagtcagcaatggaggcgagggttgcaggagtgcccgaagacgaagagtctggcctcctcccccgcccgtccgcagccggccgacggccgtcctcccgcggcccccgcttcccgcctccaccggcagcctgggcgacggtggacggtcccctcgggcttccgctggaggacgcggagggccacgcccgccgcttcgtcatgtggggtttcgcgtgcctccccttcctctgggccatcaactgctgctacttctggcccgtccctcgntcgtaggtcgcctactcgaccagcgccttcgcccccattcggccatatggtgtgcggtcggcaatgggttccacatcttctccgttgttctggccacctgggccacaaccttcttcgggggaggcaccggtttattggggccatgggggaagattttggaaggacaaaggggcccaaaagcttgggtttctggaattcggggataaccccg

SEQ ID NO: 43160 - protein, 87 aa, Zea mays
  misc_feature: Ceres CLONE 1442944-F
MEARVAGVPEDEESGLLPRPSAAGRRPSSRGPRFPPPPAAWATVDGPLGLPLEDAEGHARRFVMWGFACLPFLWAINCCYFWPVPRS

SEQ ID NO: 43161 - DNA, 626 bp, Zea mays
  misc_feature: Ceres CLONE 1442945-F
  misc_feature: Encodes the peptide sequence at SEQ ID NO. 43162
tccccgcggtggcggccgctctagaactagtggatcccccgggctgcaggaattcgcacgagaccattacctagaacatcctaatcgaaaatcctagcaatcctctgccggagtccaagctccaatcagatccggacccacccctccccctccgaagaagccctaggcatgccccgcagccgatgaggtcgctccgccgggtcctcatcccgctcgtcctcctcgcaggactcgtcttccgcgtggacgacggcggcggcgcgttcctcccgcccccgccccccgcgctccccgctcccccgccccgcctcgcacttaacggagaagcggctccggaggatgatggggcggcggtttcccgctccacggagatcgtcgcggcggaggcgcgctccaccgagttcgtcgccccagcgaggcccaagaagcagagcttccgggagctccttgtccggccgcagcctgcgcgccacgagccggctagtttggttaccgacgaggcgaaagccgaatccagctctgtgcttcagttttgggataatggcacaattcagcttgtggacaaactgtcgcaatctcctctgtgggagatcaccacagggcctccactatcagaccagattaat

SEQ ID NO: 43162 - protein, 148 aa, Zea mays
  misc_feature: Ceres CLONE 1442945-F
MRSLRRVLIPLVLLAGLVFRVDDGGGAFLPPPPPALPAPPPRLALNGEAAPEDDGAAVSRSTEIVAAEARSTEFVAPARPKKQSFRELLVRPQPARHEPASLVTDEAKAESSSVLQFWDNGTIQLVDKLSQSPLWEITTGPPLSDQIN

SEQ ID NO: 43163 - DNA, 620 bp, Zea mays
  misc_feature: Ceres CLONE 1442946-F
  misc_feature: Encodes the peptide sequence at SEQ ID NO. 43164
  misc_feature (604)..(604): n is a, c, t, g, unknown, or other
acccgcggtggcggccgctctacaactagtggatcccccgggctgcaggaattcgcacgagaccattacctagaacatcctaatcgaaaagacgcgtctcttccacagccgcaacctctatccctcgtctggtatcgtctcccacacccctctgccccaactcagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcacaagctgcaccgccagtggaccttctgcttgtatgatcatgttttccgtccaagcaagttgcctgggactgctgattttcacctattcaaggctggagtagagccaaaatgggaagacccagagtgtgcaaatggtggcaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattgtggactaggactgccagncatgaagctgtccagg

SEQ ID NO: 43164 - protein, 141 aa, Zea mays
  misc_feature: Ceres CLONE 1442946-F
  misc_feature (6)..(141): Pfam Name: IF4E Pfam Description: Eukaryotic initiation factor 4E
  misc_feature (136)..(136): Xaa is any aa, unknown, or other
MAEVEAPAAAVAAATPEVATVTEGGAATEAKGPHKLHRQWTFCLYDHVFRPSKLPGTADFHLFKAGVEPKWEDPECANGGKWTVPCNRKPTFETMWLETLMALVGEQFDETDDICGIVASVRPRGDKLALWTRTAXHEAVQ

SEQ ID NO: 43165 - DNA, 636 bp, Zea mays
  misc_feature: Ceres CLONE 1442955-F
  misc_feature: Encodes the peptide sequence at SEQ ID NO. 43166
  misc_feature (600)..(600): n is a, c, t, g, unknown, or other
tccccgcggtggcggccgctcttgtactagtggatcccccgggctgcaggatttcgcacgagaccattacctagaacatcctaatcgaaaaatccccgcgcccccgcgtctgaatccggcgccccccgccccgatccgtccgatccgcgccgaatcgccgttgctcggggcggaaccctagcccgatctccacctgtttcctcgcgatgggcgccggtcgtgtctgccgcggcggccctttctccgcctcccccgccgctggcgccgccgcggggcggccgttcccgccgctcaccgcgtcctcctcctcatctccttcatcggccccttccgagacagcgtccacgtcggtcaccaagacggtgaacggctcccaccacttcaagatcgcgggctactccctctccaaggggatcggcgtggggaagttcatcgcctccgagtccttccacgtggggggattcgactgggcgatctacttctaccccgacgggaaaagcggcgaggatgggccctgcctaacgtctggttcttcatatgccctgggccagcgaaggcaccctattgtgcgccgcgctggttccaggttcaccctcgtcnaaccagagccggcaagggggcaagaacagggggcat

SEQ ID NO: 43166 - protein, 143 aa, Zea mays
  misc_feature: Ceres CLONE 1442955-F
  misc_feature (132)..(132): Xaa is any aa, unknown, or other
MGAGRVCRGGPFSASPAAGAAAGRPFPPLTASSSSSPSSAPSETASTSVTKTVNGSHHFKIAGYSLSKGIGVGKFIASESFHVGGFDWAIYFYPDGKSGEDGPCLTSGSSYALGQRRHPIVRRAGSRFTLVXPEPARGQEQGA

SEQ ID NO: 43167 - DNA, 652 bp, Zea mays
  misc_feature: Ceres CLONE 1442956-F
  misc_feature: Encodes the peptide sequence at SEQ ID NO. 43168
agagctggagctccccgcggtggcggccgctctagaactagtggatcccccgggctgcaggaattcgcacgagaccattacctagaacatcctaatcgaaaacttttgctcctaagagatactattctattgatcgtgttttccggaatgaagctgtggaccgaactcatcttgcagaattccaccagatagaaggtcttatttgtgattatggtttgacgcttggtgatctgataggtgtattggaggatttcttctccagactaggcatgtcaaagctgcgtttcaaacctgcctacaacccgtacactgaaccaagcatggaaattttcagctaccacgatggtctgaagaaatgggtggaaataggcaactcaggcatgttcaggccggaaatgttacttcccatgggactgccagagggtgttaatggtatcgcatggggtctttcggcttgaaaggccaacaatgattctgtatggggattgacaacataccgtgatctcttttgggccaaaaggccgacttccatcctgatcaagaacagccccaatttgccgccttggggcttgaagggtggggaagcctggaataaacttttatcctgaatgcctgggatggcaaagggaagtttattttggggggtattccc

SEQ ID NO: 43168 - protein, 62 aa, Zea mays
  misc_feature: Ceres CLONE 1442956-F
  misc_feature: SWISSPROT Homolog: EC 6.1.1.20 Phenylalanine--tRNA ligase
MSKLRFKPAYNPYTEPSMEIFSYHDGLKKWVEIGNSGMFRPEMLLPMGLPEGVNGIAWGLSA

SEQ ID NO: 43169 - DNA, 664 bp, Zea mays
  misc_feature: Ceres CLONE 1442957-F
  misc_feature: Encodes the peptide sequence at SEQ ID NO. 43170
aagctggagctccccgcggtggcggccgctctataactagtggatcccccgggctgcaggaattcgcacgagaccattacctagaacatcctaatcgaaaaaccagacttgcagctccacaccagcaacagcgcgacgatagctagctagtagtagaagcaggcagcggctctagttgtcgagcgttccacaggtatcaagcaccggcgtttaattagccatccgctccgatcgtcccctcccctattcccatggccagtttcgctgctcaggtcatggacatgttcttcgtgctcgtcgagcgcgtcaccggctacggcggccacgctgaggacgaccagaaggacgcttcaggtgcacatgagcccaccaagctgctgacatcgtctggcgtttctgaaaccgaacaagcagaagaagaggtggtcgttgcggtgcagaatgttcagataagagcaagaggggggcggcgaacccctttgtgccagggtggcttcgatgcctcagggttaattaggccctggcatggcatgggggttttggtagaggttaattagttggccgctgccctcaggggaatcgacctttccccaaacaatggatgcggttttaatttgggcagccccggggtttttaaacctttttttcctggcaagggaggggg

SEQ ID NO: 43170 - protein, 101 aa, Zea mays
  misc_feature: Ceres CLONE 1442957-F
MASFAAQVMDMFFVLVERVTGYGGHAEDDQKDASGAHEPTKLLTSSGVSETEQAEEEVVVAVQNVQIRARGGRRTPLCQGGFDASGLIRPWHGMGVLVEVN

SEQ ID NO: 43171 - DNA, 732 bp, Zea mays
  misc_feature: Ceres CLONE 1442964-F
  misc_feature: Encodes the peptide sequence at SEQ ID NO. 43172
  misc_feature (1)..(1): n is a, c, t, g, unknown, or other
  misc_feature (22)..(22): n is a, c, t, g, unknown, or other
  misc_feature (74)..(74): n is a, c, t, g, unknown, or other
  misc_feature (75)..(75): n is a, c, t, g, unknown, or other
ntttattgggttcccacactanaacacaaggatacgcgtcggggggctgccccccgcccgccgtcccctattannaacgttgtgtttttatagctggagctccaccgcggtggcggccgctctataatagtggatcccccgggctgcaggtattcgcacgagaccattacctagaacatcctaatcgaaaagtcttcttcttcttcttattccccttcctccacagcacggcacgcgcacacgctgagtccagagtcatggcggcgggcctcaaggtccccgagatggcgctcaggctctgcgtcgtcccgctctccttggcctccctgtgggagatggccaccaacgcgcaggcagacgacacctacggggaggtcaagttctccgatctctccagattcagctatttggttggcgtcaacgccgtcacagccgcctacgctgtagcctccgtcttggcgtcgtccttcaagcggcccctcgccgcgcgctacgactgggtggttctcgtcatggatcaggcgtcggcatacctgctggggaccccggcctccgccgcggcggagctgctgccactggccccgacaccggctaccggggtcgtgttcttgggggagaggccttgcctcctctcttccgcccgggtccctgccgggaataggcttacgcgttggccccctcgggtgacttgtcacgtccccgccccgccgcttttgggcccccggcccttcc

SEQ ID NO: 43172 - protein, 158 aa, Zea mays
  misc_feature: Ceres CLONE 1442964-F
  misc_feature (2)..(125): Pfam Name: DUF588 Pfam Description: Domain of unknown function (DUF588)
MAAGLKVPEMALRLCVVPLSLASLWEMATNAQADDTYGEVKFSDLSRFSYLVGVNAVTAAYAVASVLASSFKRPLAARYDWVVLVMDQASAYLLGTPASAAAELLPLAPTPATGVVFLGERPCLLSSARVPAGNRLTRWPPRVTCHVPAPPLLGPRPF

SEQ ID NO: 43173 - DNA, 747 bp, Zea mays
  misc_feature: Ceres CLONE 1442970-F
  misc_feature: Encodes the peptide sequence at SEQ ID NO. 43174
  misc_feature (14)..(14): n is a, c, t, g, unknown, or other
  misc_feature (20)..(20): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
tggtggggtgcttntgtctntccccgccccccccgagttcagtactggccagacgcgggtgagcgggggnnnncncccccgcatactggagctccccgcggtggcggccgctctatactagtggatcccccgggctgcaggatttcgcacgagaccattacctagaacatcctaatcgaaaaagagaaattgtacacatattccctgcctctcgctagcgccttccctccgcaaacggaaggctctcgtgaccaccgggatgtccgccatggagaccgacatcaacgcgccgccgccgcccgccccagctggcgagggatcctctgcggccggtccgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgaccagcgaggagtgcactggtgcttggggagtctgtaatcatgcttttcacttccactgcatcagcaggcggcttaagacctcgtaagtgtgccccttcaaataacagggaagtggggagtcccaagacatatggccccctaggtcccggggccccccctcatgtgaaggttggcggcccttaccctcaaaggggacctggccccccccccccgagggggagcttttttgttctggccccaaaacagacctctcctc

SEQ ID NO: 43174 - protein, 105 aa, Zea mays
  misc_feature: Ceres CLONE 1442970-F
MSAMETDINAPPPPAPAGEGSSAAGPSSSRKPNKRFEIKKWNAVALWAWDIVVDNCAICRNHIMDLCIECQANQASATSEECTGAWGVCNHAFHFHCISRRLKTS

SEQ ID NO: 43175 - DNA, 806 bp, Zea mays
  misc_feature: Ceres CLONE 1442971-F
  misc_feature (12)..(12): n is a, c, t, g, unknown, or other
tggggcgtgccnttttccctccgccccgggaagcgggggccaggccggggggggagggggcccccccaataacaatatgtgaaactgagactccccgcggaggcggccgctctatactagagggacccccgggctgcaggaatccccacgagaccattacctagaacatcctaatcgaaaagttccttctcatcatctcttgcttggttatgatcttccgaccttgcctcgccgcatctgctcctccagacacagcgcacccgccttcctcatcctgattccgtggccggcggccgcctaacctcagccgcctcacccccaccgaggccgccggagcccttgaggtaggggacccgggctctcgcgcccatccgcgccaggaggtcgaggggcgggtggcggttgatggaggcggaccggctgagcggcccccgccgcggcctaacgcccacgatgcccaaggaggggggacactgagggacctttgtggatcgccgcgtggggagccgccgaggagggccgggagggcgggggacgggggagagcccgcacggggagcgcgcgcagcccccggcgcccgcgcccggcgggccccccccaaccccacgccgcggccgcccctacagctccccggccccgcaccggggcaggccaccccgccccccttccgcgccccgcccaaccgccgcaccgaaccccccagcggccagcccgccgccggcctagcggcgggcggagcgccaaccacacccgcggcgcacggcgccaccccccgaacccgccaaggcgcccccgcccgccgcacg

SEQ ID NO: 43176 - DNA, 811 bp, Zea mays
  misc_feature: Ceres CLONE 1442972-F
  misc_feature (80)..(80): n is a, c, t, g, unknown, or other
  misc_feature (81)..(81): n is a, c, t, g, unknown, or other
gtgggcctcgttccctccccttcgtctcgccgaataaccccatgcgccccgtgggggggggggggcgggggggacagccnnccaatactggaactcccccgggaggcggccgctcctacacagtggatcccccgggctgcaggatttcccacgagaccattacctagaacatcctaatcgaaaaataggaggtgggattgtagagccacgcgtcagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctgggggcggggctcgcgcggcccatgtcctctcacgacgcgcacctcacccgcgacgaaagcatcgaccggatcctcgacgtccagcagaagccacccccaagatcgaccccctccaagggggacccccggagggcgcactttcgaagaaaggaaccccggggctcgaacagccctggaacacccgtccaaggccgggcccatggcccacttgcatgaaggaagattcaaggcttccaaaaatccccaaaaacaaggccaggcctggaaaaaagacccctgaccccacttctcccccatgcgcccatccgcaggtaccgctcctcaccaaacccaccccccattggcgccgggggctgaaaaacctccccgctttactccccgcaacaaaggaatgactaaacgctcgcacgccccaaacgcctcatccccccc

SEQ ID NO: 43177 - DNA, 803 bp, Zea mays
  misc_feature: Ceres CLONE 1442979-F
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
nnggtatnnggtgggggggcccccacccaccgccccgggggggatgggattattgcccccagggagtataatcctctataaaattggagctccaccgcgtggcggccgctctttaatagtggatcccccgggctgtatgagttcgtacgagaccattacctagaacatcctaatcgaaaaacctcacacaaacacacatacctgaatccagccccgcacccaccgttgtcgcccgccgcccgagtcgccgtggccgcccgcggcagcgccctcccggccgtgagcgcggcctattgcgcgcgccgcggcccccgcggtcctcgaggcggcccaggatatggggcatagggcccccatccctgctatgggccctttccggttgcacgccggtgggggggggttactgctgggcccggaacagctgtagtcaccctccccagcactccatcgggcggcggtgcgggttatcagcgctggcccgatccgcagcagtagcccgggacccacaaacgccgtcgccggggggggcctttacatattcacgccccccccccccccttacgggcactaactcggcacggggggtttcacccgccggcggtcaagcccggcccttgtgcccaccaaggaagcagccgtctttgttgtgggcccggcgggagccggatatgcggcgctcttgtgccaggccggaacagtcggaagcgggcgcgccacggttgcacgcgttgtagggcgctaaccattgcctacccccggcacggtcgccgcgggtcaatgccaacgcaggtggaccgaccccc

SEQ ID NO: 43178 - DNA, 658 bp, Zea mays
  misc_feature: Ceres CLONE 1442983-F
  misc_feature: Encodes the peptide sequence at SEQ ID NO. 43179
tagctggagctccccgcggtggcggccgctcttgaactagtggatcccccgggctgtaggaattcgcacgagaccattacctagaacatcctaatcgaaaaatgaacctccacctctctctctctctctctccttcccagttccctccgtcctctccagttccacagaaggctccgtgcctagatcgtcccgtggagaatgtgttggggatcaaggagtggttgattggatccatcccctcgcgtgcttccctcatcaagtttcaaatccccatctgcgcgaggaactcctctctcaaggggaaatcgctcgtaactgtgcaaacacttgttcctcgatcccccctcaatcaatctattccccgcccccttgtggagggggggggggctttaaaatggttcccccccaagaatccatccatttattggaagaagggtagtaaatcctgaaaaaatccaggggggagtttggaaccgtcctcctccgctcccagaacggttcatgggaagaggccaagctcggggaaaatttttggtgggaattcatttcctccacaccccccaattatttccaagcccgcttgaagaaaaaacttttttccccaacacccccctcttccatcacatcttttttcacctgggcgtcttcgaactccttc

SEQ ID NO: 43179 - protein, 115 aa, Zea mays
  misc_feature: Ceres CLONE 1442983-F
MNLHLSLSLSPSQFPPSSPVPQKAPCLDRPVENVLGIKEWLIGSIPSRASLIKFQIPICARNSSLKGKSLVTVQTLVPRSPLNQSIPRPLVEGGGALKWFPPKNPSIYWKKGSKS

SEQ ID NO: 43180 - DNA, 731 bp, Zea mays
  misc_feature: Ceres CLONE 1442985-F
  misc_feature: Encodes the peptide sequence at SEQ ID NO. 43181
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (224)..(224): n is a, c, t, g, unknown, or other
  misc_feature (225)..(225): n is a, c, t, g, unknown, or other
  misc_feature (241)..(241): n is a, c, t, g, unknown, or other
  misc_feature (243)..(243): n is a, c, t, g, unknown, or other
  misc_feature (249)..(249): n is a, c, t, g, unknown, or other
  misc_feature (250)..(250): n is a, c, t, g, unknown, or other
  misc_feature (258)..(258): n is a, c, t, g, unknown, or other
  misc_feature (418)..(418): n is a, c, t, g, unknown, or other
  misc_feature (731)..(731): n is a, c, t, g, unknown, or other
tttttttttcggtttttgttgggcgggggggcccgcaccttctttttatcgggcggttttaannnnnnggcnnnnnntatactggagctccccgcggtggcggccgctctagtactagtggatcccccgggctgcaggaattcgcacgagaccattacctagaacatcctaatcgaaaagtttagcctccaagcaggggcgccgcgcggggtattctgtccgtnnttgagggtagagagtnanttgganngggggagnggagatgaagccggttgtggggatcgtggcgtcgccccccatgcagaagtcggtggtggttaaaatgaaccgtatcttccacaacaaggtatacaaccgctacgtcaagcgtacctccaagttcatggcacacgacgatgacgactcctgcaacattggngaccgggttaggctggatccttctaggcccttgagcagacacaagcactgggttgttgctgaaattctccgcagagctaaggtgtacgttccaccagctgcaacagcgtccagtgaacgtggtagcaaatctcaacaagctggtggtgctacccaatgatccatctgaagttactcagaaacagatgcagtcacggcttggttttctttccgctggatgtttggtttccctgagggatgggggttgcccaggtttagcaggggaaaaaaaaatggcaagcagccccgcatctttggccttattaaccggtggn

SEQ ID NO: 43181 - protein, 104 aa, Zea mays
  misc_feature: Ceres CLONE 1442985-F
  misc_feature (6)..(74): Pfam Name: Ribosomal_S17 Pfam Description: Ribosomal protein S17
MKPVVGIVASPPMQKSVVVKMNRIFHNKVYNRYVKRTSKFMAHDDDDSCNIGDRVRLDPSRPLSRHKHWVVAEILRRAKVYVPPAATASSERGSKSQQAGGATQ

SEQ ID NO: 43182 - DNA, 632 bp, Zea mays
  misc_feature: Ceres CLONE 1443000-F
  misc_feature (538)..(538): n is a, c, t, g, unknown, or other
  misc_feature (613)..(613): n is a, c, t, g, unknown, or other
ggagctccccgcggtggcggccgctctagaactagtggatcccccgggctgcaggaattcgcacgagaccattacctagaacatcctaatcgaaaaacgggtgaaaatagaaaaatcaggtgccggagactaccgaacgtgtgctcgcttccttcagccgtcgtcgtcctcgtctcctcgatgataagaaggggaggtggatcactcgaacctaataagtgagcttccaggccggggagagggactggccggcggaccgccgatggaaaactttggaggctcctaacttccaagataccaactagctcccagcctcccaccgtcttctttccacccttggctgatgctagggagatgggatttttggagctctaagacaaatagttctgctccttgcgccctgcgtgttcttgatctggcctctaagtttgttggctgttttctcgtgtttgaggtgatatctcgattctaaaaagctaccagatttcttctccctgtttgtatggacaaatttgggaatgaaccctagtctgtgtgncaagcagccaaattggtgttcttgcggatcaaagctaaagctgcagcagttggtgagggatacagagatgcaggnagaacaagagaagggcttg

SEQ ID NO: 43183 - DNA, 640 bp, Zea mays
  misc_feature: Ceres CLONE 1443003-F
  misc_feature: Encodes the peptide sequence at SEQ ID NO. 43184
aaagctggagctccccgcggtggcggccgctctagaactagtggatcccccgggctgcaggaattcgcacgagaccattacctagaacatcctaatcgaaaaactatcatcatttcaacctctctccctcggcctcgccggcggcacagcgcagcgcagcgcttccactgttgggtgtggtggatttcctccgcccccgaacgatcgatcttttgcatggcagcagcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggcggcggcgcggggagccccgacaagtactggagcccccaccccaagaccggcgtgttcggcccggcggcggtggaccccgaccagctgggcgtcgccgtcgccgctgacgctgccgccgcgaatgctgcagcagcaggagccacggtgctggaccagaaggtgtggttccgcccgctcgaggacgtcgagaagccgccccccgtcgcctgaaccgcgccacgcccacgcgacgcgacgctgccagcccacactgctg

SEQ ID NO: 43184 - protein, 125 aa, Zea mays
  misc_feature: Ceres CLONE 1443003-F
MAAAASSKGRAIAGSFVSRVLAGKAASPRRAVHASSYDKNPEEQVRPAFVPDDVIGGGAGSPDKYWSPHPKTGVFGPAAVDPDQLGVAVAADAAAANAAAAGATVLDQKVWFRPLEDVEKPPPVA

SEQ ID NO: 43185 - DNA, 611 bp, Zea mays
  misc_feature: Ceres CLONE 1443004-F
  misc_feature: Encodes the peptide sequence at SEQ ID NO. 43186
ggagctccccgcggtggcggccgctctataactagtggatcccccgggctgcaggaattcgcacgagaccattacctagaacatcctaatcgaaaaattttgcattcggatctggtttagacgggatgagcaacccgggggcaccggacaccgtcactgagtcggcggagctggtcctgccgttgttgccgccgcaggacctcgcggccgcggcatcggcctgccgcgccctccgcgcggctgtgactgctgtcaccgcgcgccgcgccggcgacgccgcacgtggcctagagccgctccccatcccgttccgcaactacgtcgattccaagccctatgcctacttcctgtatacccccttctccctcacccggctggctcccggcgcctccgcccccagcgcccagccgtggggtgccgcctggacccggccgccccgccccacctggccccgccccaacctcgacggcttaccatcagccgtgtacgggtgcgcgtgcgcggcggcggaatgcggtggtacccagtgcgcgtgcgccgatgtggaggccgatgcagcgggctcgggcttggaggccgggatggggagcctcacggagtgcggtgatgtc

SEQ ID NO: 43186 - protein, 162 aa, Zea mays
  misc_feature: Ceres CLONE 1443004-F
  misc_feature: SWISSPROT Homolog: EC 2.1.1.43 Histone-lysine N-methyltransferase
MSNPGAPDTVTESAELVLPLLPPQDLAAAASACRALRAAVTAVTARRAGDAARGLEPLPIPFRNYVDSKPYAYFLYTPFSLTRLAPGASAPSAQPWGAAWTRPPRPTWPRPNLDGLPSAVYGCACAAAECGGTQCACADVEADAAGSGLEAGMGSLTECGDV

SEQ ID NO: 43187 - DNA, 662 bp, Zea mays
  misc_feature: Ceres CLONE 1443010-F
  misc_feature: Encodes the peptide sequence at SEQ ID NO. 43188
  misc_feature (502)..(502): n is a, c, t, g, unknown, or other
caaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaacccactcatcaacgggcagaccactaccccggcgtggccggcaacggcgcgacgttctacttncctggtgtccgccatcctgcccggcttggtggggcgccgcgtccagctgggcggggttcaccaccgtgccgccttgggccacaaaaccgtgcccccaaagcccgggtgttccctatcgccgggggcaaaaagggccccctctttggggtggcccaaaaaa

SEQ ID NO: 43188 - protein, 106 aa, Zea mays
  misc_feature: Ceres CLONE 1443010-F
  misc_feature (53)..(53): Xaa is any aa, unknown, or other
MAGIGRNMVAPLLVLNLIMYIIVIGFASWNLNPLINGQTTTPAWPATARRSTXLVSAILPGLVGRRVQLGGVHHRAALGHKTVPPKPGCSLSPGAKRAPSLGWPKK

SEQ ID NO: 43189 - DNA, 501 bp, Zea mays
  misc_feature: Ceres CLONE 1443011-F
  misc_feature (200)..(200): n is a, c, t, g, unknown, or other
  misc_feature (269)..(269): n is a, c, t, g, unknown, or other
  misc_feature (286)..(286): n is a, c, t, g, unknown, or other
tggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctccntccccgcccccaccccgagccgagcagagcgcagcccctatcccggagctgggatggcggacgccaaancaaccagcaccaagcanccccccaaaagggggggaaacggggaaccccccccggggtggggaaaaaaaggcaaaacccctctcttttaaacggggggggcccctcggggaaagcccccaaacttggggttttcccccctttttaaaatgtggggaaaggggggaagacccatttggggggggggcccccctggtgggggccaaaagaaaaaaattttcacaaaagggggggg

SEQ ID NO: 43190 - DNA, 662 bp, Zea mays
  misc_feature: Ceres CLONE 1443021-F
  misc_feature: Encodes the peptide sequence at SEQ ID NO. 43191
  misc_feature (493)..(493): n is a, c, t, g, unknown, or other
aaagctggagctccccgcggtggcggccgctctagaactagtggatcccccgggctgcaggaattcgcacgagaccattacctagaacatcctaatcgaaaaaccagcgctctccagttccacttcacttcatccctgatcggcgatcacgccgagcgagcagcgctataacgcacaatgaacttggcgtccgtcgttccctgcgggcaggcattcaccgtgttaatgactcccgccgctggctcccaccgtcgggtccacacgcatgcggcggcctccaagagcggattggcctgccgcgtcgcgcgcagcgggggcgcccggtggctgccggtctcctgtgcagccgggggcggtgcagttggtgacgcttttgttactgaggacactacaaatgtgaagtttcctcgggaagtaacagttccaggctatacacacccattggttgcagttggcacaggttacagaagaaaagttttttgtcaaagatatngctgccggcgtctatgtagaatactcacctccgcctggatactgagcaatggaaagcaaagactgggattgaaagctttgaaaggtccccctgttttcaactccatttttaaggggccccgggtggaaaacccttgaagaaaaatctttgttaaaaccctttaagggca

SEQ ID NO: 43191 - protein, 150 aa, Zea mays
  misc_feature: Ceres CLONE 1443021-F
  misc_feature (106)..(106): Xaa is any aa, unknown, or other
MNLASVVPCGQAFTVLMTPAAGSHRRVHTHAAASKSGLACRVARSGGARWLPVSCAAGGGAVGDAFVTEDTTNVKFPREVTVPGYTHPLVAVGTGYRRKVFCQRYXCRRLCRILTSAWILSNGKQRLGLKALKGPPVFNSIFKGPRVENP

SEQ ID NO: 43192 - DNA, 678 bp, Zea mays
  misc_feature: Ceres CLONE 1443029-F
  misc_feature: Encodes the peptide sequence at SEQ ID NO. 43193
  misc_feature (411)..(411): n is a, c, t, g, unknown, or other
  misc_feature (422)..(422): n is a, c, t, g, unknown, or other
  misc_feature (483)..(483): n is a, c, t, g, unknown, or other
  misc_feature (513)..(513): n is a, c, t, g, unknown, or other
  misc_feature (537)..(537): n is a, c, t, g, unknown, or other
aaagctggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcangtgaagcacgncgccgggacggtgggcttcttttctgctgtgaaccacgctttggcgaagaactgatgggcngcatgctccgcgggggtgcgcagttcaacnagggcccccctgaaggcaaagcangccctctactccaggggacctggttcggaacctgcgctttcccttcaaatttgaacctctttaaagcccctttggggccaaattgggccaaacacctttttttggcaagggggtctcaaaccccccccccccgggaaggag

SEQ ID NO: 43193 - protein, 109 aa, Zea mays
  misc_feature: Ceres CLONE 1443029-F
  misc_feature: SWISSPROT Homolog: EC 1.14.11.20 Desacetoxyvindoline 4-hydroxylase
  misc_feature (88)..(88): Xaa is any aa, unknown, or other
  misc_feature (92)..(92): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEXVKHXAGTVGFFSAVNHALAKN

SEQ ID NO: 43194 - DNA, 662 bp, Zea mays
  misc_feature: Ceres CLONE 1443033-F
  misc_feature: Encodes the peptide sequence at SEQ ID NO. 43195
aaagctggagctccccgcggtggcggccgctctagaactagtggatcccccgggctgcaggaattcgcacgagaccattacctagaacatcctaatcgaaaatgacatatgagggtgccgttgatttggagaacatggatgatatgttacaaaagtccgctattgaggaccaaattgcaaattttggacaaacaccaattcaaatttttcggaagaaacacccaaggagaggtcctcctataccaattgtgcatccactatattttgcgccacaatcgataacagtgacttctgttgtcccgaccatagtcacccctttatctgtattattcattggtttgttggactcaaacgttgtcatgatgaatgaggggctcatactctctgtaaagctttggctaacaacacagttgcagtctggtggaaacttcacattttctggatcactggaacctttcttcggaattggttctgatgttatttctccgaggaaaattggcacttctttggctgaaaatgttgagtttggaagacaatgcttagcaactgttcaaattcgtggtgacaattacttaattttgtgtggtaattgggagaatagtttccagatcatatctctaagtgatggaaaaattgtgcagagcatccggcagcataaagat

SEQ ID NO: 43195 - protein, 187 aa, Zea mays
  misc_feature: Ceres CLONE 1443033-F
MTYEGAVDLENMDDMLQKSAIEDQIANFGQTPIQIFRKKHPRRGPPIPIVHPLYFAPQSITVTSVVPTIVTPLSVLFIGLLDSNVVMMNEGLILSVKLWLTTQLQSGGNFTFSGSLEPFFGIGSDVISPRKIGTSLAENVEFGRQCLATVQIRGDNYLILCGNWENSFQIISLSDGKIVQSIRQHKD

SEQ ID NO: 43196 - DNA, 674 bp, Zea mays
  misc_feature: Ceres CLONE 1443040-F
  misc_feature: Encodes the peptide sequence at SEQ ID NO. 43197
  misc_feature (421)..(421): n is a, c, t, g, unknown, or other
caaagctggagctccccgcggtggcggccgctctagaactagtggatcccccgggctgcaggaattcgcacgagaccattacctagaacatcctaatcgaaaagtgttcgagtccatcttcttgtgccatccaacccctcgtccgtagatcgatcgctgctacgcgcctgcatgctgacggttcggcgccgctgatgcgatgaagctctcgtagcccgacgttagcgagaagacgggatcgcacaagtactgaggtctcggccaggtgtcgatttggttcaaccgagggagcacctgtgcattgctataacaacaatgctggatcgggttgccatgtcagctgaggattctgccctggctgaagatttgcaggttgaagaggttctccccggtctcattcagtcggggaaggcctgtgcangttgcaaagaagcatccgatcattggatgcctcgtggaaacctgaaaattgtgacatgtcatctgcattgcctgcttctgccagtatgcactgaaaactgagccactggactggccagtgggccccggggcatcttgggatccttgggcaatcaaaaaaccctaggggaccaaagggccccggggcctttccattcccattgaaaaacgggcccgaaaggaaaaaaccccccgggggtggacaattccaaaag

SEQ ID NO: 43197 - protein, 68 aa, Zea mays
  misc_feature: Ceres CLONE 1443040-F
  misc_feature (36)..(36): Xaa is any aa, unknown, or other
MLDRVAMSAEDSALAEDLQVEEVLPGLIQSGKACAXCKEASDHWMPRGNLKIVTCHLHCLLLPVCTEN

SEQ ID NO: 43198 - DNA, 670 bp, Zea mays
  misc_feature: Ceres CLONE 1443041-F
  misc_feature: Encodes the peptide sequence at SEQ ID NO. 43199
  misc_feature (529)..(529): n is a, c, t, g, unknown, or other
caaagctggagctccccgcggtggcggccgctctagaactagtggatcccccgggctgcaggaattcgcacgagaccattacctagaacatcctaatcgaaaaccgaatctcacacccaaaagtttcccactgccctcgtcccccattcaattcttccaactccgccgcttcgcctcgttccgtccgccgccctcatggcgtccgccgccgccacgaccacctccgcccccgcccagaacatcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttccagagcgacccgcagggcaggnaaaaagggggccgggggaagaaaggggacccgctacagcagctcttcgccgcgccgttggtggggctcatcaccaagcgtttctccgtgctctacgacgtcgaggcacgcaacgcgctgctccgcggagactgctcgcttc

SEQ ID NO: 43199 - protein, 158 aa, Zea mays
  misc_feature: Ceres CLONE 1443041-F
  misc_feature (112)..(112): Xaa is any aa, unknown, or other
MASAAATTTSAPAQNINPLSINIKLPPWLSGLRCPFTFVCPPPPPPPPPPPPPPPLPPTEPVVPRSRRLPSLRVTTEYDSEEGVFVNKVSCKLAGDLAKLRLSFQSDPQGRXKGGRGKKGDPLQQLFAAPLVGLITKRFSVLYDVEARNALLRGDCSL

SEQ ID NO: 43200 - DNA, 658 bp, Zea mays
  misc_feature: Ceres CLONE 1443042-F
  misc_feature: Translation starting site: 199
  misc_feature: Pfam Name: Annexin Pfam Description: Annexin
  misc_feature (395)..(395): n is a, c, t, g, unknown, or other
  misc_feature (424)..(424): n is a, c, t, g, unknown, or other
caaagctggagctccccgcggtggcggccgctctagaactagtggatcccccgggctgcaggaattcgcacgagaccattacctagaacatcctaatcgaaaaatctccgcgcattttatatgcaggcttgcgcctgtcacttctcccctgtccttgctccccctcgatcccgcatcagtgcgtcacattcaccgggaatggcaacgctcaaggtcccagccactgttcctcccgtcgccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgaggagctcctccgctccatcancgacgagatctccggcgacttcgagaggnccgtgatcctgtggacgctggaccccagcgagcgcgacgcggtgctggcaaacgagcggccccgaagtggaagcccgggaaccttgtgctcttcgaaatcccctgcacgccaacctccgcgaaaattttcgcaaccaggcaggctttatccgaacgggtcaaccctcccctgaagaaaaactccctgcccatcccctggggacctcccaaaacaatggggcgccattgaaaaac

SEQ ID NO: 43201 - DNA, 659 bp, Zea mays
  misc_feature: Ceres CLONE 1443043-F
  misc_feature: Encodes the peptide sequence at SEQ ID NO. 43202
  misc_feature (560)..(560): n is a, c, t, g, unknown, or other
aagctggagctcaccgcggtggcggccgctctagaactagtggatcccccgggctgcaggaattcgcacgagaccattacctagaacatcctaatcgaaaaatcacacatattattgaaatcaaataccttcatacaaagcatatgggtgtaccaatgatggtacgtaagatattttgcgtcttatgctcgttggacttttggtacgtgctgctaccgcgaccattttgccattgtgctcacaatctcctatactttcccttcttcccccttacgttgcagcagtggtgatttctgtatgggaaaagccaattcttcaagcctataggatccaacaggtaatcgcagctggactattacctttatgacgattgttccacctacaatcatcagatctattacagagagttacgattgctgcatctgttgcatcacatgtactgccacgacaactacaacaccttgtactagatgatttagatgtctactctactcatcaacaggtcgtccgttactacgactagctccattagactactgctgcttattgaaacaaaattnagtaccgttcaccggtttattggctgactacctccagaaattactcccgtgcaggcaatggaaaatttttcaatttgccctgataattaaaaaaaacca

SEQ ID NO: 43202 - protein, 60 aa, Zea mays
  misc_feature: Ceres CLONE 1443043-F
MLVGLLVRAATATILPLCSQSPILSLLPPYVAAVVISVWEKPILQAYRIQQVIAAGLLPL

SEQ ID NO: 43203 - DNA, 471 bp, Zea mays
  misc_feature: Ceres CLONE 1443049-F
  misc_feature (168)..(168): n is a, c, t, g, unknown, or other
aagctggactccccgcggtggcggccgctctagaactagtggatcccccgggctgcaggaattcgcacgagaccattacctagaacatcctaatcgaaaaatatccactattctctaggaagcaagggaatcacatcgccatggcagccaagatgtttgcattgtttngcgctcctagctctttgtgcaaccgccactagtgctacccatatccccaggggcactttggcacccacttcctggattgccattgggcctacccatgaaaacccatgggaatgcccattaactggcaatgaaagccaaaccgggggggttttgccaaattttggttaaggcggggggcccaaaccccctttagttctgcccaacaaaccttgtgggggcccctcccccccccttttttttaaaacccccgggggggcccccaaaaagccccccaaaatatttatttccccccccgtttttata

SEQ ID NO: 43204 - DNA, 726 bp, Zea mays
  misc_feature: Ceres CLONE 1443050-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (27)..(27): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (287)..(287): n is a, c, t, g, unknown, or other
  misc_feature (324)..(324): n is a, c, t, g, unknown, or other
  misc_feature (332)..(332): n is a, c, t, g, unknown, or other
  misc_feature (360)..(360): n is a, c, t, g, unknown, or other
  misc_feature (361)..(361): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (387)..(387): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (446)..(446): n is a, c, t, g, unknown, or other
  misc_feature (447)..(447): n is a, c, t, g, unknown, or other
  misc_feature (449)..(449): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (529)..(529): n is a, c, t, g, unknown, or other
  misc_feature (531)..(531): n is a, c, t, g, unknown, or other
  misc_feature (532)..(532): n is a, c, t, g, unknown, or other
  misc_feature (536)..(536): n is a, c, t, g, unknown, or other
  misc_feature (537)..(537): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (547)..(547): n is a, c, t, g, unknown, or other
  misc_feature (551)..(551): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (574)..(574): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (589)..(589): n is a, c, t, g, unknown, or other
  misc_feature (591)..(591): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (609)..(609): n is a, c, t, g, unknown, or other
  misc_feature (615)..(615): n is a, c, t, g, unknown, or other
  misc_feature (630)..(630): n is a, c, t, g, unknown, or other
  misc_feature (633)..(633): n is a, c, t, g, unknown, or other
  misc_feature (634)..(634): n is a, c, t, g, unknown, or other
  misc_feature (637)..(637): n is a, c, t, g, unknown, or other
  misc_feature (641)..(641): n is a, c, t, g, unknown, or other
  misc_feature (642)..(642): n is a, c, t, g, unknown, or other
  misc_feature (668)..(668): n is a, c, t, g, unknown, or other
ggtggggggggnnnnnnnnnngantanaagggggggcccccccaccnnnccataaaactggagctccccgcggtggcggccgctctagaatagtggatcccccgggctgcaggaagttcgcacgagaccattacctacaacatcctaatcgaaaagatttgtttacccccggaaatttggcgtctcctgctgtcggtcctctccctgggcagcccccagaggggggagtggcgggttcttgatgggagagagttagggagggaggtgggggacggggggggtgggtngtgggtaggaggaggagaagaggaagggtggtatggnggtttttnttgtgaggggtagggtcggatgagggtnntgttnnnntnnntnnnnttttttaanatggnntntgggnnnnttgtttggtgttggggggcggggggggggnnnnnttnnnnnanntnggggtggggggggggggggcccccggtnnnnannnnnnnnnnngaannnnannnnncnnnnnnnnnnnnnngcnnnnagntnnaatnnggggnnntgnaggngattnnngnnnnntnctagggtnannnnnnnaagacantntannnnannnnnnnctgntgtcgnagccggcgccgatanagnnttntttnncgaggttgctccaccccgacggccgntcgccgtcgcccggcggcagcgggcagcccccctcgcgccgcgtgcgttgttcgcggg

SEQ ID NO: 43205 - DNA, 639 bp, Zea mays
  misc_feature: Ceres CLONE 1443063-F
  misc_feature: Encodes the peptide sequence at SEQ ID NO. 43206
  misc_feature (550)..(550): n is a, c, t, g, unknown, or other
aagctggagctccccgcggtggcggccgctctagaactagtggatcccccgggctgcaggaattcgcacgagaccattacctagaacatcctaatcgaaaactcactcgtagctcaagcatcagcggcaggagctctgggcagcgtgcgcacgtggggtacctagctcgctctgctaacctaccatggctgatcaccaccggggcgcgacgggaggtggcgggggctacggggacctccagcgcgggggcggcatgcacggcgaggcgcagcagcaacagaagcagggcgccatgatgacggcactcaaggccgctacggccgcgaccttccgcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctccgcgtcgctgcgctgtccgtgttctcctggatgtacaagtacctgacgggcaagcacccngccgggcgccgaccagctggaccactccaaggcgaagactggggtccaaggccccgccacatcaagggatgccaccacagcacccccat

SEQ ID NO: 43206 - protein, 151 aa, Zea mays
  misc_feature: Ceres CLONE 1443063-F
  misc_feature (36)..(140): Pfam Name: Oleosin Pfam Description: Oleosin
MADHHRGATGGGGGYGDLQRGGGMHGEAQQQQKQGAMMTALKAATAATFRGSMLVLSGLILAGTVIALTVATPVLVIFSPVLVPAAIALALMAAGFVTSGGLRVAALSVFSWMYKYLTGKHPAGRRPAGPLQGEDWGPRPRHIKGCHHSTP

SEQ ID NO: 43207 - DNA, 493 bp, Zea mays
  misc_feature: Ceres CLONE 1443064-F
  misc_feature (252)..(252): n is a, c, t, g, unknown, or other
aagctggagctccccgcggtggcggccgctctagaatagtggatcccccgggctgcaggaattcgcacgagaccattacctagaacatcctaatcgaaaacacaagcagcgaaatccaatctagaagcacccctctccctctctctctcttcgccgtccgaagctccgcaccccaatctaatcgaacaccctcaccgagatgggccgcagtttctcgtcgtggcactggaatgcatggaacacgatcagtcnagagatgtcaaaacctgatgaagaacgttccccctcaatgtgtccaggccttgccacccctcttaagtcttcctcccgggggcaaaacccaattgccccaaaattgcctgttgcttccccaaaatgctggggaaaaaaaaggagggctttctcctgggaaaaacagggtaaaaaccccccaacacctggggggcccccggggggattcttgggaacccaaaaaagaaactttctcgggaaa

SEQ ID NO: 43208 - DNA, 659 bp, Zea mays
  misc_feature: Ceres CLONE 1443072-F
  misc_feature: Encodes the peptide sequence at SEQ ID NO. 43209
aaagctggagctccccgcggtggcggccgctctagaactagtggatcccccgggctgcaggaattcgcacgagaccattacctagaacatcctaatcgaaaagaccctcgcttcacttgtcacggactcgcgtccacgaaccacaaccagctcactcaagaacaaagaacccaacccatggcttctcccaagccgctcctcctgctcgccacctcgttcctgagctgcggcctcctggtggccgccaactacgccccaatgaccctgaccgtggtgaacaactgcccctacccggtgtggccgggcatccaggccaactccgggcacgacgtcctggagggcggcggattcttcctcccgccgctctcccacaagaccttcccggcgccggcccacccctgatccggccgcatctgggcgcgcacgggctgcgcgggcgccggcacgcacctccactgcgccacgggcgactgcggcgggcggctccagtgcggctggctcggcggcgcggcacccgcaacgctagcgcaagtgaacctccaccacggcaacgaccagacctcttacggcgtgagcgtgatggacggcttcaacgtgtgcctgtccctgaccccacacgagggccgcggcaactgccccgtcctcgcctgccgcaagaa

SEQ ID NO: 43209 - protein, 74 aa, Zea mays
  misc_feature: Ceres CLONE 1443072-F
MASPKPLLLLATSFLSCGLLVAANYAPMTLTVVNNCPYPVWPGIQANSGHDVLEGGGFFLPPLSHKTFPAPAHP

SEQ ID NO: 43210 - DNA, 661 bp, Zea mays
  misc_feature: Ceres CLONE 1443089-F
  misc_feature: Encodes the peptide sequence at SEQ ID NO. 43211
aaagctggagctccccgcggtggcggccgctctagaactagtggatcccccgggctgcaggaattcgcacgagaccattacctagaacatcctaatcgaaaatcctttctccgggcacaccatactgttcttgctacttctagatagaggaacaagagagagaaggccaccgacatctcctcttaacccgacaagccccattgcccaggagaaccccgtgccggggagcgagccgcgcgcattccccgtcccgtgccaccggaccaggggaaggaggacacacatgtcgtcgtctctctctccagcggcggcagccgcgcccctggatctggacggcaactccgtcgcgcccctcaccatctgcatgattggtggcggcgggttcatcacctcccacctctgcaagaagctcatggccgagacgcgccatgtcgtcctcgccgtcgacgtatactgcgataagatccgccacctcgtcgaccccgcgccgccgcacctcgcggggggcatctccttcaccgcctcaacatcaagaatgactccagggctcgagggcctcatcaagatggccgatctgaacatcaacctgggcgctatctgcacggccggcggattaaaacaagctgcccctcaacaccatctaaaggacttcatcgatggg

SEQ ID NO: 43211 - protein, 126 aa, Zea mays
  misc_feature: Ceres CLONE 1443089-F
MSSSLSPAAAAAPLDLDGNSVAPLTICMIGGGGFITSHLCKKLMAETRHVVLAVDVYCDKIRHLVDPAPPHLAGGISFTASTSRMTPGLEGLIKMADLNINLGAICTAGGLKQAAPQHHLKDFIDG

SEQ ID NO: 43212 - DNA, 654 bp, Zea mays
  misc_feature: Ceres CLONE 1443090-F
  misc_feature (654)..(654): n is a, c, t, g, unknown, or other
ggagctccccgcggtggcggccgctctagaactagtggatcccccgggctgcaggaattcgcacgagaccattacctagaacatcctaatcgaaaacactcatttcgactccttcctaattccatgttaatcctcgcccttttcctccccaaatcggcccttgggatcgcttcataggaatcctctgcttgttctgcccaacaaaatgaaaaaatgaatgcttcttcatcatgctggatgcaatcgactcttattacccctcctctgaatcaataagtgtcgtttcttcttaaattcgacaaccataaacattcgatcaatgtgctacaagtacatgataaaaaagccggaacttgccaaccttgctgcctcctctatcgatctcgtcgcgaaaaacagctaagcaaacgtaccagtggggtgcacgctgacccccacccgggttaagctgttgcacgactaaagctcttgacaatgcacgtaaatgacacctcatattgtcctggacccacttacgtattgccgacaatctccataagtccgcaagtatgcctgaaacagctacacgccggatggataggacttgacttccttggatcagctgacacagtgggttcattgtttgaggagatcagagatgcttctacatgctcn

SEQ ID NO: 43213 - DNA, 707 bp, Zea mays
  misc_feature: Ceres CLONE 1443091-F
aaagctggagctccccgcggtggcggccgctctagaactagtggatcccccgggctgcaggaattcgcacgagaccattacctagaacatcctaatcgaaaaaaaagaagacggacggacccagtgaggcgagcacgggcgctcaccggcgatggcgacgagggcatgggtggccgccggtggccttgaaccctcaactgctgcctctccgctcctgctcgcccacgaagtcggtctccccagcgcagcgctcggcgtcgatggggctccggctgcgcagcggccggccgtgcctggggaagttcgtgtgccgcccgcgcaagaacgcgggatacgaggactactagtcccgggaccccatcccatactttcgcgaggatggagacgaacaggttccgggaagcacatggcgtggcggcctggaccaaaaaaaagaggactacttcccggggaccctgtcaaggaaatcctttgacctctctgcccgaaaaccttggggaactttcccggaaaaacatttaccgggaaccaagggacccctcctggtttccccctttcctggaaataaaagggggaaattaaggggaaggggggctcccccgcccccacccagagggggacgggggggggattatccgttgccccaaaaaaacggtgaaaaaaaccctgaagggcccttcccggggggaaatactccccctaaaaga

SEQ ID NO: 43214 - DNA, 643 bp, Zea mays
  misc_feature: Ceres CLONE 1443096-F
  misc_feature: Encodes the peptide sequence at SEQ ID NO. 43215
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (146)..(146): n is a, c, t, g, unknown, or other
  misc_feature (150)..(150): n is a, c, t, g, unknown, or other
  misc_feature (168)..(168): n is a, c, t, g, unknown, or other
  misc_feature (184)..(184): n is a, c, t, g, unknown, or other
  misc_feature (533)..(533): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaannnnnnnnncaaaaagctggagactccaccgncggntgggcggccggctctagnaactagtggaatcccnccgggctgcaggaaattcgcacgaaaaccattacctagaacatccttaatcgaaaaaactccgccgttctggccttctgcgcctccatttcggcctctgtcccttgcaagttcaatctcacctccaaccatgggtaaagagaagtcccacatcaacattgtggttattggccatgtcgactctgcaagtcgaccaccacagggacaccttatctacaagctggaaggcatttgacaagcgggtgattcaaaaggttccaaaaaggaggcttgcttaaaaaatggaaaaagcggtcctttcaagtaacccgggggggggccccaaaaaaattttaaagggttaaaaccgnaaaaaaagggggttccccccctttggaatcccccccctggggaaaattttttaaaaccccccccagtttttctttggggccggggtttttttttaccccccccggagaac

SEQ ID NO: 43215 - protein, 34 aa, Zea mays
  misc_feature: Ceres CLONE 1443096-F
MGKEKSHINIVVIGHVDSASRPPQGHLIYKLEGI

SEQ ID NO: 43216 - DNA, 681 bp, Zea mays
  misc_feature: Ceres CLONE 1443099-F
  misc_feature (283)..(283): n is a, c, t, g, unknown, or other
  misc_feature (284)..(284): n is a, c, t, g, unknown, or other
  misc_feature (290)..(290): n is a, c, t, g, unknown, or other
  misc_feature (296)..(296): n is a, c, t, g, unknown, or other
  misc_feature (298)..(298): n is a, c, t, g, unknown, or other
  misc_feature (299)..(299): n is a, c, t, g, unknown, or other
  misc_feature (305)..(305): n is a, c, t, g, unknown, or other
  misc_feature (308)..(308): n is a, c, t, g, unknown, or other
  misc_feature (351)..(351): n is a, c, t, g, unknown, or other
  misc_feature (391)..(391): n is a, c, t, g, unknown, or other
  misc_feature (396)..(396): n is a, c, t, g, unknown, or other
aaagctggagctccccgcggtggcggccgctctagaactagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccatttanntcacgncgccgncnngcgcgnagngtggctctccacggccctgccctcgcccgtctagggtgcgccntctcatcggcggggagttcgtcgagtcgggcgccacaagnaattnaacttccccacccccggacgaggaggggggtcccggatcccgctccccggggcaagaaatcaaagttcggtcaaacccccgggaaggcctccccggggggggaaacaccccctcaaaaacgggggccctttttgtaaatttccgaaacctcgcgggtgaatgggaaccttttgaaaaaaacccccccgggggggagaaaaaaaaaaaaattggggggagcttcccccccccccaagggggggggccctttttttggaacaacccccccgggggaggttttattta

SEQ ID NO: 43217 - DNA, 621 bp, Zea mays
  misc_feature: Ceres CLONE 1443100-F
  misc_feature: Encodes the peptide sequence at SEQ ID NO. 43218
aagctggagctccccgcggtggcggccgctctagaactagtggatcccccgggctgcaggaattcgcacgagaccattacctagaacatcctaatcgaaaacaaagcgagaagacgaagaatggggaaatcgagagatgagctacgggagagtccctccggaggaaccctaccctcctccaggacatcctcgatctcaggcgcacccttacccaccgccacaagatgtgtacccgcctccccctcggggccatggacatccaccaccaccccatggagtgtacccgccgccgccgcggggtccttaccccccaccacagcagcctccaccggggtaccagggctacttcaacgaccagcagcgtccttactacccgccgccgtgtggagagcatcaacgcagccgccaccagggaaaccagggtagctcctctgggttcctcataggatgtttggctgctctctgctgctgctgcttgctgaaggaatgctgcggctgcttctgatacctgagatgtccggcaatccgatcgcaagttgtcgtcgctagcattcggcagcaccccagttattatcatatagtagtaactgtgctggtcaatcatctgggaccatcgatgtc

SEQ ID NO: 43218 - protein, 122 aa, Zea mays
  misc_feature: Ceres CLONE 1443100-F
MSYGRVPPEEPYPPPGHPRSQAHPYPPPQDVYPPPPRGHGHPPPPHGVYPPPPRGPYPPPQQPPPGYQGYFNDQQRPYYPPPCGEHQRSRHQGNQGSSSGFLIGCLAALCCCCLLKECCGCF

SEQ ID NO: 43219 - DNA, 650 bp, Zea mays
  misc_feature: Ceres CLONE 1443102-F
  misc_feature: Encodes the peptide sequence at SEQ ID NO. 43220
tccccgcggtggcggccgctctagaactagtggatcccccgggctgcaggaattcgcacgagaccattacctagaacatcctaatcgaaaagtctccaacccgactctgaaatccacgagctcttccccctcgtccacaccccgcccctccctgctctccgcctccccgtccccgcccccatcgctacccacaagcaccttcggaggctccaggcaacccacctcctgcacccggcgtccctcgcggcggcgacgcgcgaacgtcccgctccccggtgagtaacggagagacggagccatgagcggaggggtggagccggataccccgcccggtagcagcagcagcagcagcaggagcgggggcagcacgcccgtgggcggcaagccgccacgccaccacctcacgtccatccgccactgcgccagcagtgcccgcatcgccgctgcctccgccgaattcgtaagcaagctcgctgccacccaagccatctatccctaacacgaatttgatgtctgcccttctgttctcctgcaggggctggagtcggggacgctcagcttgatttcacctaccgcagacatccgtccgggcttcttgcctgtgttcaggtcggggagtttcgcggatattggacccaaatccttcatgg

SEQ ID NO: 43220 - protein, 66 aa, Zea mays; identical to SEQ ID NO: 17379
  misc_feature: Ceres CLONE 1443102-F

SEQ ID NO: 43221 - DNA, 652 bp, Zea mays
  misc_feature: Ceres CLONE 1443108-F
  misc_feature: Translation starting site: 99
ggagctccccgcggtggcggccgctctagaactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagcttgaagagatgcgtactgctcatgttgtctcaattgactcagaatcattctgtgacttgcatcgtcattgacaagcaggaagaaaaactgagtttacgttggatactcgaaacagtttggcactttttagggtctttcactggcactgattatgtgccttctcaacgtataggggggaggataatgccttatccccatgaaccctttcaaaagggtcaatgtctaaccaactcctacaactgggattactggcccaaaaatccctccaaatggccctaaagtcg

SEQ ID NO: 43222 - DNA, 656 bp, Zea mays
  misc_feature: Ceres CLONE 1443117-F
  misc_feature: SWISSPROT Homolog: EC 2.3.1.74 Naringenin-chalcone synthase
caagctggagctccccgcggtggcggccgctctagaactagtggatcccccgggctgcaggaattcgcacgagaccattacctagaacatcctaatcgaaaaaaagttactcatctcatctaactctagtttaacctaattggattaatatggggatggtgggtgctacttcttcattggtatgaaataccttagggggacagagacgaccgtcctgcaaggatcttgtcgattcgtaccggcaactctgcgaacaatgtggtctcagcggagtatccgaactactacttccccatcactcatcttagaacacatgaccgaccttaatgagaacttctcgctctgtgcgataagtccaccataagatattccaacgtgcacttgtccgaggagttattaacagataaccctttcatgtgtgcctacatgagctccttcgatcaatgctagaccatacctcgtggagacttaattccctaacctattcaaacattctgcttcaaatgccatcatggattgggcgttccattacttccaagatcatcactcggtgtcattcttatccggctctggagatgacttgcctaatgtctgactacttgatggagcagactcgcttgcgcttacgtccttccggactttgcgtctcatgatgc

SEQ ID NO: 43223 - DNA, 635 bp, Zea mays
  misc_feature: Ceres CLONE 1443119-F
  misc_feature: Encodes the peptide sequence at SEQ ID NO. 43224
aagctggagctccccgcggtggcggccgctctagtactagtggatcccccgggctgcaggaattcgcacgagaccattacctagaacatcctaatcgaaaaatcaccaccactgggtcttcagaacattagctttatctactccagaacgcaaaaaaacccgatcgaaaccatgagggtggtggtcgttggcctcgctctcctgggtctcgctgggagcgccacctccacgcatacaagcggggggtgcggctgccaaccaccggcgccggttcatctaccgccgccggtgcatctgccacctccggttcacctgccacctccggtggatctcccaacgccggtccacctggcggcgccgggccaactgccaccgccggtccatgtgccgccgcccgtttatctgccgccgccaccatggcactaccctactcaaccgccccgggctcaggctcatccccagccacacccatggccgtggcaacaaccggatccaagcccgtgccagctgcagggaacctgcggcgttggcagcaacccgaacctgggccagtgcctccagtttctgaagcatcaatggagcccgaaggggaacccctaatggtcgcctcagtgccattccttgcagcaacaatg

SEQ ID NO: 43224 - protein, 55 aa, Zea mays
  misc_feature: Ceres CLONE 1443119-F
MAVATTGSKPVPAAGNLRRWQQPEPGPVPPVSEASMEPEGEPLMVASVPFLAATM

SEQ ID NO: 43225 - DNA, 633 bp, Zea mays
  misc_feature: Ceres CLONE 1443133-F
  misc_feature: Encodes the peptide sequence at SEQ ID NO. 43226
aaagctggagctccccgcggtggcggccgctctagatgtagtggatcccccgggctgcaggaattctgacgagatcattacctataacatcctaatctaaaagcaccgccaccgttacttaacatgcccatggcctttcgctagagagagagagagaaagatgtcttggttcgggcatcatcaccgcaaccaggcggctcgcccggcgttcgggcccaacctggtgttcaagatcttctgtcgggccaatgagaactactgcctggccgaccactacggcaccgtcttgctggccccagtcatcccctgggaagaccacttgcactggtacaaggacatgcgcttcctcacccgggtcaaggatgaggaaggtatgccggcgttcgcgctcgtcaacaaggccactgggctcgcaatcaatcactccctctgtcagtcccacccggtcaagctcgcacctttcaatccggaccaagaggactcgtccgtgctgtgtacggacagcaaagacgtgtgcaaaggcttccgctgcgtccgcatgggctacaacacctctttaaacttcaacgtcttcaatggtgactaggaccaaggcgggttgcacaacggtaccgcttacgtgctctgggagtg

SEQ ID NO: 43226 - protein, 141 aa, Zea mays
  misc_feature: Ceres CLONE 1443133-F
MSWFGHHHRNQAARPAFGPNLVFKIFCRANENYCLADHYGTVLLAPVIPWEDHLHWYKDMRFLTRVKDEEGMPAFALVNKATGLAINHSLCQSHPVKLAPFNPDQEDSSVLCTDSKDVCKGFRCVRMGYNTSLNFNVFNGD

SEQ ID NO: 43227 - DNA, 642 bp, Zea mays
  misc_feature: Ceres CLONE 1443134-F
  misc_feature: Encodes the peptide sequence at SEQ ID NO. 43228
ggagctccccgcggtggcggccgctctagaactagtggatcccccgggctgcaggaattcgcacgagaccattacctagaacatcctaatcgaaaaaccgattcggcgaccgggctaatcgatatgcgtgggattccaactccggaaccgaatccctccaccgacccaaaccctagcgcgcacccttatccgtcgtcctttcctggcgcgcgggccagtgtcagatatgcgggagctgctcgcggaaggcgggatggcactggcggtgtcgcccgatgccaaccagtcgtaaggtggcactgagatgtctctaggggcgttatcgtgggcgtcggagtgccacggggtactgtacaacctggccttaatgctgccatcgctggcctttgtagcgatcctggcgtggcaggcacggcggagcttccgtaggctcagctacggtcgctcatccgtcattgtcgtcacatactatgcgctcctctgggccgtcggcgtactcaatctcctctggtgcttccggaaggcatggcgatgtactgctgacggagcattctcttggaatggactgtcactgcttactaaatcaggaatgtgattcttgggaagtagtctcataaccttctctacttcagagatatgatc

SEQ ID NO: 43228 - protein, 96 aa, Zea mays
  misc_feature: Ceres CLONE 1443134-F
MSLGALSWASECHGVLYNLALMLPSLAFVAILAWQARRSFRRLSYGRSSVIVVTYYALLWAVGVLNLLWCFRKAWRCTADGAFSWNGLSLLTKSGM

SEQ ID NO: 43229 - DNA, 638 bp, Zea mays
  misc_feature: Ceres CLONE 1443135-F
  misc_feature: Encodes the peptide sequence at SEQ ID NO. 43230
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaacaaacacgtgacacctccgcccaccctcgccccctccctaccggcaccgcccagatggcctgctcccacatcgtcgccgccgcgggggtctcctcccccgccgcagcggcggctcgttccccggcgcattctcccgctgccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggtcgcccggccacggagaagcagcccatcatcgtcatcgacaactacgacagcttcacatacaacctctgccagtatatgggggagcttggattgaacttcnaagtataccgcaatgatgaactgaccatacaaaatgtgagaaggaacgacccaagggggaatacttatttctccaggaactgtgaaccacaaggatcgggaatatcattgcagactggttctgaattaggccaaccaatcccaatttttggagtttgcatgg

SEQ ID NO: 43230 - protein, 160 aa, Zea mays
  misc_feature: Ceres CLONE 1443135-F
  misc_feature: SWISSPROT Homolog: EC 4.1.3.27 Anthranilate synthase
  misc_feature (107)..(107): Xaa is any aa, unknown, or other
MACSHIVAAAGVSSPAAAAARSPAHSPAAAFARLRSTPRFASAGLSVKGNGAAFPLVAAAGPAAAAPVADLDGRPATEKQPIIVIDNYDSFTYNLCQYMGELGLNFXVYRNDELTIQNVRRNDPRGNTYFSRNCEPQGSGISLQTGSELGQPIPIFGVCM

SEQ ID NO: 43231 - DNA, 631 bp, Zea mays
  misc_feature: Ceres CLONE 1443154-F
  misc_feature: Encodes the peptide sequence at SEQ ID NO. 43232
aagctggagctccccgcggtggcggccgctctagaactagtggatcccccgggctgcaggaattcgcacgagaccattacctagaacatcctaatcgaaaaaccacagagtcagagtgcggaggtgaacgtgacgtgacgctcctcctctataagaggagacgcctgtgctgcagtgtgcacagcacagcccgtcgcgcgccgctgcattgaggttgagccaaggcgcaatggcaacctccacctcagttcccgtcctcctgctcctcggcgacgccgacggcctcctcctgctccccggcatcgctggcgaggcagagcagcaactgtgcaccgggctcgcccggtagaggctcgccgacgtggccttcacccggctccggctccggcggaggacacaggccgcctcaccatagcaagccgcccatgcaccaccatgaaaagcccgccaaaatccctgcgggcactcttccggacgtgtctcggatctctcgagggatacagccctacgtgctaacataagtcccgccggaggatacgtcatcagcttctccatgacgggaccggggtcaaacccggtccaaccataacaagtgggaggttggcggcctaggggcttcaatacatagcct

SEQ ID NO: 43232 - protein, 31 aa, Zea mays
  misc_feature: Ceres CLONE 1443154-F
MHHHEKPAKIPAGTLPDVSRISRGIQPYVLT

SEQ ID NO: 43233 - DNA, 859 bp, Zea mays
  misc_feature: Ceres CLONE 1443162-R
  misc_feature: Translation starting site: 678
  misc_feature: SWISSPROT Homolog: EC 2.4.1.207 Xyloglucan:xyloglucosyl transferase
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (756)..(756): n is a, c, t, g, unknown, or other
  misc_feature (765)..(765): n is a, c, t, g, unknown, or other
ccgattgggtaccgggccccccctcgaggtcgacggtatcgatattttttttttttttttttgaaatctcgaaaagggagggcagaatcgtttttcgttcccaaaatcccccccattcacttgtttctacaaaaaaaacccccgcgggttcacccacgcaggggtcgccaacaatgccactttcaataagggaaaacagagttccaaacagaaaaacccctttgttgcaaacccacaaacacaaacccccacggtccaccaaaaaaaacaagcatttccttttccaccccccccaacaaaatcctttgccatgccttgcccggatcaacgtaggtgggtaaggagctcaccggccggcccactcgggcggttgcacgggaaagcggtcggtgtcaacccaaaattcctaaacaagggggggcgcgcccccccacacaacctgggggctttggggcacgctaatttccaaaatttctttctctttccacaagaaggggccctccttgccccacaagaactcgttgcacgggggcgcctccggggagtccccttccggggggttgcccgccaaggggaaccggtccacgcgcacttccggaaacgtggccttgaagggcgcgtgcaacaagtccttcttcacgcgcccgccctgggtcacccagtcgtccgcgttccaaatggagttgtacacggccatcgggtggggcccgggaaacggcccgggcaacacccaacgggggggnnnnngggttttgncccctttgnccccccgacgccacccccccaatccgatgggggcccatggccgggtgcttttgcggaaacgggtctttttgccacaacccaaggggggggtccc

SEQ ID NO: 43234 - DNA, 632 bp, Zea mays
  misc_feature: Ceres CLONE 1443164-F
  misc_feature: Encodes the peptide sequence at SEQ ID NO. 43235
aagctggagctccccgcggtggcggccgctctagaactagtggatcccccgggctgcaggaattcgcacgagaccattacctagaacatcctaatcgaaaagacgctcgacgcctctcctcctctcctcccccacccgtccatcgcccctccctccggtctgcgctcccacagcctcacccctgcgcccccgacgattcgcatcgccctttgttggaaggaacgatggagcaaaccttcatcatgatcaagcccgacggcgtccagcggggcctgatcggggacatcatcagtcgcttcaagaagaaagggttctacctcaaggggatgaagttcatgaacgtggagagatccttcgcgcagcagcactactctgacctttccgacaagcctttcttccccgggttggtggagtacatcatttccggccccgagatggccatggtgtgggaggggaaggacatcttgttgactggccgtaggatcattggggccaccaggccttgggaggcagcccccggaaccattcgtggggactactccgtggaagtcggcaggagaacatccctttctttgtactcgatcaggtgtgctttgctgcgaatgttttactttggacactttaatagccat

SEQ ID NO: 43235 - protein, 136 aa, Zea mays
  misc_feature: Ceres CLONE 1443164-F
  misc_feature (2)..(120): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFKKKGFYLKGMKFMNVERSFAQQHYSDLSDKPFFPGLVEYIISGPEMAMVWEGKDILLTGRRIIGATRPWEAAPGTIRGDYSVEVGRRTSLSLYSIRCALLRMFYFGHFNSH

SEQ ID NO: 43236 - DNA, 618 bp, Zea mays
  misc_feature: Ceres CLONE 1443170-F
  misc_feature: Encodes the peptide sequence at SEQ ID NO. 43237
  misc_feature (467)..(467): n is a, c, t, g, unknown, or other
tggagctccccgcggtggcggccgctctagaactagtggatcccccgggctgcaggaattcgcacgagaccattacctagaacatcctaatcgaaaaatcggcattactgggcgcacgagactagggatttcccccttgcaatcacgaatccatggcggatgctgaacctgttgatcagaagaattaccttgaggaacgttgcaagccgcaatgtgtaaaaacattgtatgattatgagaaatgcgtcaagagagtcgagagcgacggaagtgggcagaagcactgcaccggccaatacttcgactactggtcatgcgttgacaagtgtgttgcaccaaagctcttcgacaaactgaaatgataacggaacgcaactttgaaggcgcggctcctttcaggaagtcaaatagctccaataaacccatgccttggcctctggaatttgtttgctgaacctgtggcaggnagcctcattttgatacgttttgctgaaccgtctttgtttttttttcccctgaatctgtgtggatccccagcgtcgagcctaatttcttttgtataagataatgaggtgcccataaaaataggccccaagaagattgtccgatgtccccagc

SEQ ID NO: 43237 - protein, 69 aa, Zea mays; identical to SEQ ID NO: 38638
  misc_feature: Ceres CLONE 1443170-F
  misc_feature (7)..(69): Pfam Name: UCR_hinge Pfam Description: Ubiquinol-cytochrome C reductase hinge protein

SEQ ID NO: 43238 - DNA, 612 bp, Zea mays
  misc_feature: Ceres CLONE 1443178-F
  misc_feature: Encodes the peptide sequence at SEQ ID NO. 43239
gcggtggcggccgctctagactagtggatcccccgggctgcaggaattcgcacgagaccattacctagaacatcctaatcgaaaagctcgccgcgtgctccctttgtgactgaaccgcatcctccccgcgccgacctgctccggcgagttaaacatggccgtcctcctccgcggcacctccgctgccgcctcgactgctggcccctcctcggcgctgctcgccaccaccttccgccgctcccgcggctgccttctgccccgtgccgcgccgcagcgccgcttgtatgtggcccgcgcctcggcccagccccttgaggtctgcgctaaggagtccatcatcatccctggccgcctcggagactgtcctttcacacagagggttttgttgactatagaggagaagcatctgccttatgatctgaagctagttgatctagctaataagccagattggttatttgaaatcaacccagaaggtaaagtgcctatcgtgaagctcgaggaaaaatggattggtgattctgatgttataacacaagcattagaggagaaataccctgaaccacccttggcaactccaccagaaaaagcttcagtgtatgtgatatttcc

SEQ ID NO: 43239 - protein, 152 aa, Zea mays
  misc_feature: Ceres CLONE 1443178-F
  misc_feature: SWISSPROT Homolog: EC 2.5.1.18 Glutathione transferase
MAVLLRGTSAAASTAGPSSALLATTFRRSRGCLLPRAAPQRRLYVARASAQPLEVCAKESIIIPGRLGDCPFTQRVLLTIEEKHLPYDLKLVDLANKPDWLFEINPEGKVPIVKLEEKWIGDSDVITQALEEKYPEPPLATPPEKASVYVIF

SEQ ID NO: 43240 - DNA, 573 bp, Zea mays
  misc_feature: Ceres CLONE 1443180-F
  misc_feature: Translation starting site: 294
  misc_feature (33)..(33): n is a, c, t, g, unknown, or other
  misc_feature (266)..(266): n is a, c, t, g, unknown, or other
ggagctccccgcggtggcggccgctctataacntagtggaatcccccgggctgcaggaattcgcacgagaccattacctagaacatcctaatcgaaaagttccgatccgtgtccgaccttgccactcgcccaccggccaccgccaccatcacaaggagaaacaaattcttctattttagctctagctcgctcgccatcccctgcccggctgctgcccccaacggaacgacggccagaggaagctaccagagtcgatcgatcgatcngagagagagagaagagagagagagagcatggctggcaggagtttcctgattcggtcccccaggggagagagtccacgcccgcgtcagagagctgtactgctgggagcaaagacgccgcatagctggtactgtggttgcagttccacgttggttggctgccgtgtctttcttgggcaaaagcaatcctcactaccctgcacaagcactcattatatctgcacccgggattgctggcttcttcatccctggtgaaaaaaacttttctcggaacgcccgaaaaaaccccttcggaaaacttgacaaatca

SEQ ID NO: 43241 - DNA, 692 bp, Zea mays
  misc_feature: Ceres CLONE 1443194-R
  misc_feature (692)..(692): n is a, c, t, g, unknown, or other
ttgcgttttccgccccaaatgggctattccctgattgttcacacttatataccaaaacagtggagaatttcgtctccagaatacagatagcaagaagtcacacaccacaatgtacatcaatcctaagcaagctgagcatttggtccaactctcctataatcagcacaggccatctcgtagttcagcttgagctcctcgtaagactgctgagatgcctgcgcagaactttgtcaggcggtcaagaaccgccgtcagtcttcaactgcagcccttcagctgatgctgcagaactcccacactaagccgccgcctcctgctcactactgttctccagcatctcgcactcttgcgactcgccgcttctggtgctgtactgcacatcgcggtgctcaaaacgaatcggggaggagctgcatcaagtctttgagggatcctgcatagggcatcgcacgggagaaggtctgtcctggacaaccaagtcgcacgagaagaattaatttgggaggggaagatgccttgccggagagggaaggaaaacttaggggttggcgtcttgcgccgggtcctgggggagggctattttggaaaaccttcctgggacccccgcctttgaggggacttgaacacttgatattttgggcgccgggtgaaccctcctttttctaaaaatttcggagaaataaacgtttttn

SEQ ID NO: 43242 - DNA, 637 bp, Zea mays
  misc_feature: Ceres CLONE 1443194-F
  misc_feature: Pfam Name: DUF630 Pfam Description: Protein of unknown function (DUF630)
tggagctccccgcggtggcggccgctctataactagtggatcccccgggctgcaggaattcgcacgagaccattacctagaacatcctaatcgaaaaaggctactgcactgtggaaccgggcggggtaggatctgaggagcaaaggccattacttatcgtaagcaagatttctaattggcggaagcttttatgtgtagctgactgttgaatttactggtctcaagtatagagtaggcaggcaatctgcagtttagtggaacccaatgggttcttctccttccaaagccactggagaggatgccctggttctgtgcaaggatcggatgcgccacatcagacaagctattgactcgagagatgcactgtcagcagcgcacttatcttacacacaatctctccgtagtgtgggtactgcactgcggcagtatgctgagtctgagatctcaccggaatcatcgctctccatttcagaagtggataagtcaccatcacattcctctatggcatctccttcgccttcgcgtgcagtagagagtgttgcctctctggggcatcgagcaagtccatctattactccacccctcacacgaatccattgcatgaaaacagcagcaaccactcccttttgactttgtg

SEQ ID NO: 43243 - DNA, 614 bp, Zea mays
  misc_feature: Ceres CLONE 1443207-F
  misc_feature: Encodes the peptide sequence at SEQ ID NO. 43244
tctgaactggtggatcccccgggctgcaggaattcgcacgagaccattacctagaacatcctaatcgaaaactaacacttgctgatgctttggtctatgcttgcaaccaaggtgttgaaaagattattgatttggcaacgctgaccggcgcttgcgttgtcgcactcgggcctagcattgccggaattttcacgccgagcgacgagcttgccaaggaggttgccgctgcttccgaggtatccggcgagaagttctggagactcccgctggaagagagctactgggagtctatgaagtctggcgtggctgatatggtcaacactggcggcaggcagggaggttctattaccgccgcgctgttcctgaaacagttcgtcgacgacaaggtccagtggatgcacatcgacatggccgggccagtgtggagcgacaagaggcgggccgccacccggttcggggtttcccccctgggggagtgggttctcaacaactcgtcctcgtcgtgaacaaaacccatacctcccctcgaatcacaatgccctttccatggcgtttttatttttgttcccccctctttttgtgctaccatttccctagttggcaaaccggcagag

SEQ ID NO: 43244 - protein, 71 aa, Zea mays
  misc_feature: Ceres CLONE 1443207-F
  misc_feature: SWISSPROT Homolog: EC 3.4.11.1 Leucyl aminopeptidase
MKSGVADMVNTGGRQGGSITAALFLKQFVDDKVQWMHIDMAGPVWSDKRRAATRFGVSPLGEWVLNNSSSS

SEQ ID NO: 43245 - DNA, 746 bp, Zea mays
  misc_feature: Ceres CLONE 1443209-F
  misc_feature: Encodes the peptide sequence at SEQ ID NO. 43246
  misc_feature (75)..(75): n is a, c, t, g, unknown, or other
  misc_feature (76)..(76): n is a, c, t, g, unknown, or other
ggggcggcccccactcacctaacatataaacaaccgacctcccccgagagcgcgcgtagtagaacccccccccgnnccccaatactggagctccccgcgggggcggccgcatctttccagaggatcccccgggctgcaggatttccacgagaccattacctagaacatcctaatcgaaaaagggaaaaggaagacgcatcgctagagctgagatgtccttcttcttccgcatggcgtcgcggctgcggccgtcgacgccggaggaggtggtgcgctccatcaaggactccttcctcgcgctccacacgcgcacccacgccaaggctccggaagaggtcgagaaaaatatgtcatccttgagattgttgatctttggtgatggagaagtcgaaccaaatgaagagcaggtcctgcaaataacccttgagatttgaaaggagggacgtcatttccctgagcggcgaggatctgccttccttgggctggggagaaagaaaagatctggctatctgcgggtgcctctcgccgacgcagaagggcgaagaaactgattgcctgggtgcccgccctgtgcaaaccccccgcgggcatcttagattcgccctggtgggttgcctcaaagaaaccgcgtaacatcgcatttgaacctgccgaaaactacgtctcagaagaacggcaatacaggtacgcccaccacccgcgccggaagcaccacccgtgggacaaccctcgccgcacccctccca

SEQ ID NO: 43246 - protein, 73 aa, Zea mays
  misc_feature: Ceres CLONE 1443209-F
MSFFFRMASRLRPSTPEEVVRSIKDSFLALHTRTHAKAPEEVEKNMSSLRLLIFGDGEVEPNEEQVLQITLEI

SEQ ID NO: 43247 - DNA, 628 bp, Zea mays
  misc_feature: Ceres CLONE 1443211-F
  misc_feature: Encodes the peptide sequence at SEQ ID NO. 43248
  misc_feature (577)..(577): n is a, c, t, g, unknown, or other
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaactaatttttactccacgccagtgaaacacgacccgctggccgctgctacgctcccacgcccgagcccgagcccgggaccacgaggcagccagaagacgcgcgcgcccctctcgggtctcggccgcgccgtcgcgctcaccaggtctccaccatcaccagagtggcggcgctctctcctatcgcggcgagcgacggcggcgatgggaggaggggagatggcggggtggctgaaggcactggcgtacagcgccgggggcgtagcggtggccggcctagcggcgttggttgcactgcaggagcgcctcgtctacgtgcccgtgctcccgggtctggcgcgctcgtaccccatcacgcccgcccgcctcggcctcatctacgaggatgtctggctccgtgccgcggacggcgtgcgtctccactcctggttcatccgtcactcccccagctaccgaggtccaaccattctgttcttccnagaaatgctggcaacatcgctcaccgtttggaatttgtcgactaatgatgn

SEQ ID NO: 43248 - protein, 108 aa, Zea mays
  misc_feature: Ceres CLONE 1443211-F
  misc_feature (92)..(92): Xaa is any aa, unknown, or other
MGGGEMAGWLKALAYSAGGVAVAGLAALVALQERLVYVPVLPGLARSYPITPARLGLIYEDVWLRAADGVRLHSWFIRHSPSYRGPTILFFXEMLATSLTVWNLSTND

SEQ ID NO: 43249 - DNA, 774 bp, Zea mays
  misc_feature: Ceres CLONE 1443213-F
  misc_feature: Encodes the peptide sequence at SEQ ID NO. 43250
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (105)..(105): n is a, c, t, g, unknown, or other
  misc_feature (774)..(774): n is a, c, t, g, unknown, or other
tttccccccattcgtggcgccgggcgcgcacaacattcccaccctaaaaggggaacgggtgaaccccaggggagagaccnnnntgaaagcggcactccccgcggnggcggccgctccttcccaaagggacccccgggctgcaggattccccacgagaccattacctagaacatcctaatcgaaaaaaaaaatgggctaaaattaaaaaaatcgaccgccttcctcccagcccaagtggatgtgcaggaccgcgaacacgaggaggcaggggagcagcatccacaaccacaagccatggcggggaggaccaacatccccactaacaactccgccctcatcgcaatcatcgccgacgaggacaccgtcactggcttcttgatggccggcgttggcaatgttgatctgcgcaagaaaaccaattacctcctcgtcgacaacaagacgacagttaaacaaatcgaggacgcggtcaaagaatttactacaagggaggatattgccacccgcgcccaacagccaggagatggccaaactgaaaagaatatctgggggatagctacaacaaggcccgtcccctgccaatccggggagaaccccacccaaggaccactccaaatgaagcaagcggaacaacctcgggcggctggcccgccgaggggaaaggaaccgcccgtcctcgcggacggaaaacaggggaggccggcctctgaataacggccccaaggaaaagggcaacccccccgggtgggccgcagaagagcagccaccctgctn

SEQ ID NO: 43250 - protein, 139 aa, Zea mays
  misc_feature: Ceres CLONE 1443213-F
  misc_feature (15)..(111): Pfam Name: ATP-synt_F Pfam Description: ATP synthase (F/14-kDa) subunit
  misc_feature: SWISSPROT Homolog: EC 3.6.3.14 H(+)-transporting two-sector ATPase
MAGRTNIPTNNSALIAIIADEDTVTGFLMAGVGNVDLRKKTNYLLVDNKTTVKQIEDAVKEFTTREDIATRAQQPGDGQTEKNIWGIATTRPVPCQSGENPTQGPLQMKQAEQPRAAGPPRGKEPPVLADGKQGRPASE

SEQ ID NO: 43251 - DNA, 741 bp, Zea mays
  misc_feature: Ceres CLONE 1443215-F
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (741)..(741): n is a, c, t, g, unknown, or other
tgtgttgggggcgtgtggcgtttgtggggcgggggcgtgcggggcctcggggccggggggcgttttttatnnnngggtggtgnnnnttataacgggagctccccgcggtggcggccgctctataactagtggatcccccgggctgcaggaattcgcacgagaccattacctagaacatcctaatcgaaaagattgatcgcacagagctcgcctcacatccacacagcccgagctgctgcccgcccacccgcctgtagctcccctcctcacggagcaggcaggcaggcaggctgggattcccgtcgaagcagggcaggagctagggcgggtggaggagcctttgcccgggaacgaggagaggaggtggcagtggcaccccgcggctagggcagcgagagaggggcgaagaggaaggcgggcgggcgcgtccgccatggctagcgaggaagactccacaaggtccagaatcttatagagcgctgccttcagattgtacatgaacaagaaagaagtggttgatgccctctcccaccactcccggaaagaaccctgtatcactgaacttgttttgggaacaacttgagccacagaatccctctggttttcaaagcataccaaaagggggctaatgcctaaagaatcaaataaggggctttcaacagggcttctcccaggaaccggttccagattatgaaataaagaattttccttccaggggaccccttccaaggggtccctccn

SEQ ID NO: 43252 - DNA, 901 bp, Zea mays
  misc_feature: Ceres CLONE 1443222-F
  misc_feature: Encodes the peptide sequence at SEQ ID NO. 43253
  misc_feature (22)..(22): n is a, c, t, g, unknown, or other
  misc_feature (62)..(62): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (901)..(901): n is a, c, t, g, unknown, or other
gttttttttcgttttctttttnctggggagcgcgtgcgcgggcgcgccgctgggcgattaangannnggggnnnnnttaatattggtactcctcttagtggcggccgctcttttaatagtggatcccccgggctgcaggatttcgcacgagaccattacctagaacatcctaatcgaaaaatacatacctactagtctactaccccttcacctaccttcacctggcaactggcattggtcccgtatagtgccttgctgtcagttgcatggacgggctgacggacgagcagaggctcgcgttccatgaggccttctcgctctccgacaagaacggcgacggatgcatcaccatgtgaagagcttggcggaagtcaccccgtttccctcgggtctcccacccgaagcgcatcaggaggctcaatggatatgaatgagccgagggtccgattaccggaacgggaaaaggggaaccatcccaagtttcgcagggagctctctttaacccctcctattggtcccccccaagaattgtaagggaaggggtcgaaccggtccgaccaaaaagaagcctccatgggggaacaccccttcttgtgaaggggctccctggagaataacacgaacccattacaagggggcctccccattccctccccccccgcggtctgagcacttgagccacaccgtgtggattggacaccacagttccccgcgggacaagccaaagataggaacccgcaaccgacggcaaggcgttcgaaacacccagattgcacccaacgggccaacgtgggtaatacccccttcaccgggggaatagggtgctagaggcgtgaaatctatccaagaaggaaggtcccgacgtcctccccttggattgcacaagaccaccccctgagan

SEQ ID NO: 43253 - protein, 29 aa, Zea mays
  misc_feature: Ceres CLONE 1443222-F
MDGLTDEQRLAFHEAFSLSDKNGDGCITM

SEQ ID NO: 43254 - DNA, 827 bp, Zea mays
  misc_feature: Ceres CLONE 1443224-F
  misc_feature: Encodes the peptide sequence at SEQ ID NO. 43255
  misc_feature (34)..(34): n is a, c, t, g, unknown, or other
  misc_feature (36)..(36): n is a, c, t, g, unknown, or other
  misc_feature (38)..(38): n is a, c, t, g, unknown, or other
  misc_feature (49)..(49): n is a, c, t, g, unknown, or other
  misc_feature (561)..(561): n is a, c, t, g, unknown, or other
ttttttattccgttttggtttggctcgcccccancncntttttaacatnatatacggcgcatcggtaataaacccggaggggtccttgtccgtttagtgggagtcgccgagggggcgcgcgctctattcctagtggatcccccgggctgcaggaattcgcacgagaccattacctataacatcctaatcggaaaaaacaaagcatcttgtagtgttcgacagcgagccatggagaagacgtccgagaacgccatcccgccggcggcatccccgctgatgctgttcgggtcgtgggcgagctcgtacacgcaccgcgtgcagctggagctgcggctcacgggcctggagtacgactaggtggaaggaggagctgggggaacaagagcgacgagctggggtggcgcagccggcgtctacaaaaaggggcgccgtgctcgtcccagggcgggccgcgcggctccctcgagtccggccttctatcctccccgtaccttggaccgacggtctgggccggcagaacccgctcccgttgctccccccggcgaaatcgcttttatgacnggtggcgtttcgcggcgggcgtgttggaggccccctttccgtcctcaacaagatacgcttcaggccccacgccatggtggggacgccgcgctggttcacccctccttctagttggggaggggcccttaattatacgcgacctggctcccagggcgaggtggcatcgaaggacaccctgggggtcgcattaaatgggagggactcagaaagtctgcactgccctacggcaagcacgcttgcgcggccgggtcacctcctcccccatt

SEQ ID NO: 43255 - protein, 42 aa, Zea mays
  misc_feature: Ceres CLONE 1443224-F
MEKTSENAIPPAASPLMLFGSWASSYTHRVQLELRLTGLEYD

SEQ ID NO: 43256 - DNA, 649 bp, Zea mays
  misc_feature: Ceres CLONE 1443231-F
  misc_feature: Encodes the peptide sequence at SEQ ID NO. 43257
tggagctccccgcggtggcggccgctctagaactagtggatcccccgggctgcaggaattcgcacgagaccattacctagaacatcctaatcgaaaaaaatcaaatttcgccttcgtcgtcgtcttctcgtctcagatttgactccatgtcggcggcgctcgcggtgacggacgaggtggccctgccgatccgggcggtgggggatctggcggccgccgccgaggtctcgcgggaggaggtcgccgtcatcacccagtgcgcggcgctcggtgggaagttgccttttgaagatgcatcagttggtgcggttcttgcagtcattaaaaacgtggaaagcttgagggagcaattggttgctgaaatcaggcgggtgctgaaagctggtggaagagtattggtgcagagccctgccccctcatccagtcagaagccgaacactgatattgagcgcaagttactgatggcgtggatttgctgaagtgcaatcttctgctgcaaacctcgcaggatagcgtgccaatctgttacagttaaagccaaaaaaggttagcctggagcatggggctcttcctttttcccctttaggaaaaccacgaaaggcccttccccaagattccaaattggaacgaccaactccttgacctggat

SEQ ID NO: 43257 - protein, 110 aa, Zea mays
  misc_feature: Ceres CLONE 1443231-F
MSAALAVTDEVALPIRAVGDLAAAAEVSREEVAVITQCAALGGKLPFEDASVGAVLAVIKNVESLREQLVAEIRRVLKAGGRVLVQSPAPSSSQKPNTDIERKLLMAWIC

SEQ ID NO: 43258 - DNA, 744 bp, Zea mays
  misc_feature: Ceres CLONE 1443232-F
  misc_feature: Encodes the peptide sequence at SEQ ID NO. 43259
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (744)..(744): n is a, c, t, g, unknown, or other
ttgttgtgtgctttcctttttaccacacatgagtatgattcttttctctgcgtgcctgcgcccccccgnnnttgtnnnnnnnnttaatactggcgctccccgcggtggcggccgctctagactagtggatcccccgggctgcaggaattcgcacgagaccattacctagaacatcctaatcgaaaactgttcgcaggtcgcagcagccgctagcacccagatcccagagtcccagaccatgccgccactgtgccttcttattttgtccgccgaacaagccagtagtggctacatcgtgaagggcggcaaggcagatctagggcgatcatggcttacgtcgagagaggtgttggaaggtctcgtttatctgcatgaacaaggtgtcattcatagagatatcaagggcgcaaatatactgagtaccaaagagggtcttggcaaacttgctgatttttggagttgccacctaaattgactgaagctgacatcaaccctatttctgtggccggcactccatactggaaggccccctgaggcgggtttttggctaaccctttgttgaaaaagacggtttttaccgcagagaatggccccttgaaatcccccgaaattcggtgggccattgggtccaaaaccccctcctagaggggggtctcttcgacaaaaaaaaagcttgataccctttaaaaaagggaacggatcacaaaaaaacttcggaacggtggttggtcctgcaaccggctn

SEQ ID NO: 43259 - protein, 78 aa, Zea mays
  misc_feature: Ceres CLONE 1443232-F
  misc_feature: SWISSPROT Homolog: EC 2.7.11.1 Non-specific serine/threonine protein kinase
MPPLCLLILSAEQASSGYIVKGGKADLGRSWLTSREVLEGLVYLHEQGVIHRDIKGANILSTKEGLGKLADFWSCHLN

SEQ ID NO: 43260 - DNA, 590 bp, Zea mays
  misc_feature: Ceres CLONE 1443233-F
  misc_feature: Encodes the peptide sequence at SEQ ID NO. 43261
  misc_feature (98)..(98): n is a, c, t, g, unknown, or other
  misc_feature (129)..(129): n is a, c, t, g, unknown, or other
  misc_feature (137)..(137): n is a, c, t, g, unknown, or other
ggagctccccgcggtggcggccgctctataactagtggatcccccgggctgcaggaattcgcacgagaccattacctagaacatcctaatcgaaaaanatcagccatcgccaccacctccctccgcggnctccgccnttccgccgcgaacacgccgctgtctcgaccccttgtcctcctccttcagcaagatggcggagattgagataaaaacagcacctgctgacttccgcttccctacaacaaaccaaacaaggcattgttttactcgctatgtcgagtaccacaggtgtttgaatgccaaaggggatgatgctggtgtttgcgaaaaatttgccaagtactacagggtccctttgccctggagaaatgggttgagaaaatggaacgagcaggagggagcatggggacgttttcaggaacctctcttgattgtcccgcccgagaacctccaggtggaaccaagccacaaagttgggccagggaagcctaactggttccattctgcatttcctactttccaagaacggaaaaaggccttttgggcccttgggcccttaaaaccggtccccccaaaaactgggtttgggt

SEQ ID NO: 43261 - protein, 133 aa, Zea mays
  misc_feature: Ceres CLONE 1443233-F
  misc_feature (4)..(78): Pfam Name: COX6B Pfam Description: Cytochrome oxidase c subunit VIb
  misc_feature: SWISSPROT Homolog: EC 1.9.3.1 Cytochrome-c oxidase
MAEIEIKTAPADFRFPTTNQTRHCFTRYVEYHRCLNAKGDDAGVCEKFAKYYRVPLPWRNGLRKWNEQEGAWGRFQEPLLIVPPENLQVEPSHKVGPGKPNWFHSAFPTFQERKKAFWALGPLKPVPPKTGFG

SEQ ID NO: 43262 - DNA, 701 bp, Zea mays
  misc_feature: Ceres CLONE 1443566-F
  misc_feature: Encodes the peptide sequence at SEQ ID NO. 43263
aaagctggagctccccgcggtggcggccgctctagaactagtggatcccccgggctgcaggaattcgcacgagaccattacctagaacatcctaatcgaaaaaagacgcgcgcttcagaaacacacctggtcgggctatattaagatgacagcttcttcggtcggcgacatggtggacgagaaaggcgcgttgcagtcagccaatggagtgggtgatcgaccacaagctcctggccgtctggacactgtggttcaccgacatcggctgctcgatctcctactgctggtcctggactggcttgatgacacaccgtggaatcaaccacgccagactgcctgctcatgctctcacgctggctgccttggctggagtgctctcttgtggagtactacgaccctgtggacgctctcgatccaaatttcgccgttatgcttagctactcctttcatctgataaccatatgggacaccatatcgactagctagtaatgtacttgcgaagagatgcacgcactaatgcgcgttatttcctgatcaactaattttgcctatggtacagtctgtgtataccatgacagaactttgcccgctcttctatgccatgcattctgctgaaacctgcactcatctaatgtcgtgtatgcagatggtaccctgcctgtgtttccctgaatggcttcgatgatacgaacggtcctttt

SEQ ID NO: 43263 - protein, 77 aa, Zea mays
  misc_feature: Ceres CLONE 1443566-F
MEWVIDHKLLAVWTLWFTDIGCSISYCWSWTGLMTHRGINHARLPAHALTLAALAGVLSCGVLRPCGRSRSKFRRYA

SEQ ID NO: 43264 - DNA, 715 bp, Zea mays
  misc_feature: Ceres CLONE 1443572-F
  misc_feature: Encodes the peptide sequence at SEQ ID NO. 43265
cagagctggagctccccgcggtggcggccgctctagaactagtggatcccccgggctgcaggaattcgcacgagaccattacctagaacatcctaatcgaaaaacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaaacactgcccctacccggtgtggctgggcatccaggctactccgggcacgacgtcctggagggcggcgggttcttcttccgccggttttccacaagtctttcccgggccgggcccacccctggtcggcccgatttggggcccccccggcttgcgggggccccggggcccaatttccttggcccccggggaaatgggggggcggtcccatgggggggggtcggggggccgggccccccaacctttggataggggaacctccccccggggaaaccccaaaccttttggggggggcggggggggagggttttcaaggggggttttttggaaccccccaaaagagggcggggaaaatcttcctctttttttctggcggaaaaccccccaaaaaaccctccccgggggtgttatttttttctcctcccggggggaggattccttctgggagaaa

SEQ ID NO: 43265 - protein, 183 aa, Zea mays
  misc_feature: Ceres CLONE 1443572-F
MASPKPLLLLATSFLSCGLLVAADYAPMTLTVVKHCPYPVWLGIQATPGTTSWRAAGSSSAGFPQVFPGPGPPLVGPIWGPPGLRGPRGPISLAPGEMGGRSHGGGSGGRAPQPLDRGTSPRGNPKPFGGGGGGGFSRGVFWNPPKEGGENLPLFFWRKTPQKTLPGGVIFFSSRGEDSFWEK

SEQ ID NO: 43266 - DNA, 763 bp, Zea mays
  misc_feature: Ceres CLONE 1443582-F
  misc_feature: Encodes the peptide sequence at SEQ ID NO. 43267
  misc_feature (415)..(415): n is a, c, t, g, unknown, or other
  misc_feature (427)..(427): n is a, c, t, g, unknown, or other
agagctggagctccccgcggtggcggccgctctagaactagtggatcccccgggctgcaggaattcgcacgagaccattacctagaacatcctaatcgaaaaaaccatcaggacgcggacgcggacgcggacgcggctcacatcaaacacccccttcagctgtgctcagtgctcactgccgcaaaaccacagccacacagggaagcgcccagcgccctttcacatcaccacatccacgctcctccgttccatggccatgtcgagcagcgccagcaagaagcaagcccaggcccaggcccaggcccagaaggccgggcggaggcccccggcggtgtcgtcggccgcggccgcggacgcggagatgcagaaggtgttctcgcgcatcgacgcggacggcgacgggcggatctccccnccccacctggcngcggtgtcgcgcggcatctccccgccggcaagctcctcgcacgggccgcgcgaggtggcggccatgatggaagagcttgacacggaccgcgactgctttcttggaactgggcaatttcagggcgttcaacccccgcggcgcggctttggggggaacaaacaccaccaaccccgagctccgcccccccttcccccttgtacaaagcccaacggcgaaagggggattcccggccgcccaaactgggcaacttggtcccccccccttccgcccggggggggcaaccccccaagagaagcccccccgaaaaaatccccggggtttaacacccaaagggat

SEQ ID NO: 43267 - protein, 171 aa, Zea mays
  misc_feature: Ceres CLONE 1443582-F
MAMSSSASKKQAQAQAQAQKAGRRPPAVSSAAAADAEMQKVFSRIDADGDGRISPPHLAAVSRGISPPASSSHGPREVAAMMEELDTDRDCFLGTGQFQGVQPPRRGFGGNKHHQPRAPPPLPPCTKPNGERGIPGRPNWATWSPPLPPGGGNPPREAPPKKSPGFNTQRD

SEQ ID NO: 43268 - DNA, 726 bp, Zea mays
  misc_feature: Ceres CLONE 1443601-F
  misc_feature: Encodes the peptide sequence at SEQ ID NO. 43269
  misc_feature (396)..(396): n is a, c, t, g, unknown, or other
  misc_feature (424)..(424): n is a, c, t, g, unknown, or other
agaagctggagctcaccgcggtggcggccgctctagaactagtggatcccccgggctgcaggaattcgcacgagaccattacctagaacatcctaatcgaaaactgatttcttctcttaactctcgcgtctcgcgtccttttcccttcctcccctccgttgcgtccgtcgtctgcgttgcgtccctccgtccgtccgtccgttggcccgttcgtcgtcaccagcctcctccctcgcgcccaccgccgggatccggccctcctcgtctgcgcccgcctcggtctagatttctgagaaaatggcgagaagtgcgggaactaggaggcgtgtggctcgccagctcaagtccacacatcccattttttcataccgatggaaggcggaggggatgaaaaancccataaaaaaatctttccccccccaantgttgccaaccttgcaaaagatggactgggaagatgccaattgctctgtgtgcatgaaatacccacataatgctgtgctcatcctttgttcatcccatggaaagggttgtcctccttatatgtgtggaaatagctaccgccactctaaatgcttggatcaattaaaaaagcttacaccaagggggcaattcttggaagaatttcctggtaaaaatggtggccctaaaactggatttcagcgccattgactgaaaaaaaaaatgactccttttaccttagatttccctttgtgtgtgggcaat

SEQ ID NO: 43269 - protein, 124 aa, Zea mays
  misc_feature: Ceres CLONE 1443601-F
  misc_feature (52)..(125): Pfam Name: DUF1644 Pfam Description: Protein of unknown function (DUF1644)
  misc_feature (33)..(33): Xaa is any aa, unknown, or other
  misc_feature (43)..(43): Xaa is any aa, unknown, or other
MARSAGTRRRVARQLKSTHPIFSYRWKAEGMKXPIKKSFPPQXLPTLQKMDWEDANCSVCMKYPHNAVLILCSSHGKGCPPYMCGNSYRHSKCLDQLKKLTPRGQFLEEFPGKNGGPKTGFQRH

SEQ ID NO: 43270 - DNA, 638 bp, Zea mays
  misc_feature: Ceres CLONE 1443602-F
  misc_feature: Encodes the peptide sequence at SEQ ID NO. 43271
ctccccgcggtggcggccgctctagaactagtggatcccccgggctgcaggaattcgcacgagaccattacctagaacatcctaatcgaaaacacttctgtagctgtagactgtagttctgttcctccccactcactcctgcgcttcctcgccgcgcggttccttctccctgatcctcctttggcttcgcggttcatggcgatgtggagggccgccgctaggcagctggtcgaccgggcgctcggctcaagggccgcgcacacgtctacaggcagcaaaaagatagtcggggtgttctacaaggccggggagtatgccgacaagaaccccaacttcgtcggctgcgtcgagggtgcactcggcatccgcggctggctcgagtcgcagggccatcaatacattgtcaccgatgacaaggaaggccccaactgtgaactggagaagcacattgaagacatgcatgtcctgattaccaccccattccacccagcttatgtcactgcagagaggataaagaaggcgaaagatcttgagctttctctcacggcaggaatcgggctcccaaccatattggatcttccagcaactgctgcttgcgggctttactgttggctaaaggcccttggaaacaaacccgg

SEQ ID NO: 43271 - protein, 147 aa, Zea mays
  misc_feature: Ceres CLONE 1443602-F
  misc_feature: SWISSPROT Homolog: EC 1.2.1.2 Formate dehydrogenase
MAMWRAAARQLVDRALGSRAAHTSTGSKKIVGVFYKAGEYADKNPNFVGCVEGALGIRGWLESQGHQYIVTDDKEGPNCELEKHIEDMHVLITTPFHPAYVTAERIKKAKDLELSLTAGIGLPTILDLPATAACGLYCWLKALGNKP

SEQ ID NO: 43272 - DNA, 698 bp, Zea mays
  misc_feature: Ceres CLONE 1443606-F
  misc_feature: Encodes the peptide sequence at SEQ ID NO. 43273
  misc_feature (433)..(433): n is a, c, t, g, unknown, or other
ctggagctccccgcggtggcggccgctctagaactagtggatcccccgggctgcaggaattcgcacgagaccattacctagaacatcctaatcgaaaaaaatcattaataaaaagtttgctagtgagtcgagaagagagagagaggcgtccggaattcatcgccagcgatgtctccgtccgccgacgcccccggcccggcctcctccgcctcggcgcccccgctcgcgcccctcatcgccgcgcagctcaactacctcctctcgcactccaagctgcccattagggtggtacagatctggtccggctgccgcaacggtcgccctgccgatcggttcaggctcgccatccccttctgcctcgactacgtccactgggatttcgtgtacaatgcgctgtctccccaggtggcacccagacgtgtgttcggtcccngagatgaaagggtcagccgctggtcgattaccctgctgctggaatggcgaataaacctgctgggccccttgggtttgcccgccccccagggatccatggccccgaaaggaattccaaaatgtccttgaaccccaaaggacgggttccactgggagataaccgaaaataggtttttaataaaccaattttctttaagagggggattaaaatcccgggggccctctcgggaaagggcaaagaagcaaaattgtgggccccccttggg

SEQ ID NO: 43273 - protein, 130 aa, Zea mays
  misc_feature: Ceres CLONE 1443606-F
  misc_feature (89)..(89): Xaa is any aa, unknown, or other
MSPSADAPGPASSASAPPLAPLIAAQLNYLLSHSKLPIRVVQIWSGCRNGRPADRFRLAIPFCLDYVHWDFVYNALSPQVAPRRVFGPXDERVSRWSITLLLEWRINLLGPLGLPAPQGSMAPKGIPKCP

SEQ ID NO: 43274 - DNA, 680 bp, Zea mays
  misc_feature: Ceres CLONE 1443611-F
  misc_feature: Encodes the peptide sequence at SEQ ID NO. 43275
ctccccgcggtggcggccgctctagaactagtggatcccccgggctgcaggaattcgcacgagaccattacctagaacatcctaaatcaaaaaagaaaattccgtttgcgcaaacctagagctacctccgccgccgccgccggcaatcaagacagctgatggatcctatgcagtcatcactgacaggccgcacgtcttcgttgcatgctgatgctgtcataactattggaggagtccgacctgcaccacccccacaaacatccacacaacatgtatgtcacgatcacgcgatggtcaccagctgggatccctcctggatgtctggttacagcactcacccctgccagggtggtcattacacttctggacacaacctccacgccgcatcaattagagaaatgaacctcacatctcataagctgaaatatcggaataagcctcacaattggcatgcgccaccatcatgtcaatgccgaaagatttcccggcaagaaaagctgatgtagaaaaaacgcctggcacagaaacccctcaagaattgttatcgatgacccctttcctctggaataaggctgaaaccgatgtatgtgatccccctcttcgatctaattcgcacgtgagttttcttcaagggccccccctcaactgacttaagatccttgatgcgcactctagcacgg

SEQ ID NO: 43275 - protein, 115 aa, Zea mays
  misc_feature: Ceres CLONE 1443611-F
MDPMQSSLTGRTSSLHADAVITIGGVRPAPPPQTSTQHVCHDHAMVTSWDPSWMSGYSTHPCQGGHYTSGHNLHAASIREMNLTSHKLKYRNKPHNWHAPPSCQCRKISRQEKLM

SEQ ID NO: 43276 - DNA, 729 bp, Zea mays
  misc_feature: Ceres CLONE 1443630-F
  misc_feature: Encodes the peptide sequence at SEQ ID NO. 43277
cagagctggagctccccgcggtggcggccgctctagaactagtggatcccccgggctgcaggaattcgcacgagaccattacctagaacatcctaatcgaaaaaatcctaccccgcggggggaattctctctcagttctctcggcgacgactgggagaccgccgccgccgccatcctactccaggtgccctgagaactcgatcggagtcttcgctggcgacgaacacccaccaggcggcgtggttagctgctgccttcaagcatgcagagacccaatgcgccgtcggcttgcgctaccatcaccttcgcggaggctctaaggagggagatggagtaccgcaagtgggtggagaggacccacccacatctgctcgtcggaatctgcggagcccctgaaatgcagagagatttcactgcaggatcagtacctgatgcgatcaagagaaaactagctgccgagaccagtgtgcctccacaacaatcaagtttcagctgtgtaactggacagaagcagccccaaaactggtaccccacaaagaaaaaggtgaaagttccacatcttgcgtcgcagattctgcagtgtcccagaccaaacgtggtgccatccttctggtgcaaaatctgcaaggtcgactgtgtcaccgagttcaatttcagcgctcacgttggaggcaaaaagcacaaggccaaaaagctagagattctaggtaagaggaacgctggggggcc

SEQ ID NO: 43277 - protein, 155 aa, Zea mays
  misc_feature: Ceres CLONE 1443630-F
MQRPNAPSACATITFAEALRREMEYRKWVERTHPHLLVGICGAPEMQRDFTAGSVPDAIKRKLAAETSVPPQQSSFSCVTGQKQPQNWYPTKKKVKVPHLASQILQCPRPNVVPSFWCKICKVDCVTEFNFSAHVGGKKHKAKKLEILGKRNAGG

SEQ ID NO: 43278 - DNA, 688 bp, Zea mays
  misc_feature: Ceres CLONE 1443640-F
  misc_feature: Encodes the peptide sequence at SEQ ID NO. 43279
aagctggagctccccgcggtggcggccgctctagaactagtggatctcccgggctgcaggaattcgcacgagaccattacctagaacatcctaatcgaaaatttgctttgcctctccttcacttcacttcaactccatcgcccgttgcagcggcggcggcggcaatcatatcacccagacgcggacgccatagtagattagattgatctctccgtggggaggaagaggagcaagagccatgtccagccccacgcacgtccgcaaggccatccgcttcgcctccctgcgggcaaagatcgcgcagcagggtaagacaggcctggcgctgcgcctgctcctcgccgccgcactcgccggcttcctcctcgtgttcgccgcgcgcaccctggtcacgccgtcccctgccccgacctcgtcgtcccaggcgcaggaatatcaccaggacgccgcgccggagtgcggcaaggggaacgcgggcctgccgctggcggtggcggaggcgctggtgcactacaccacctcgaacgtgacgccgcagcagaccgcggacgagatcggggtgtcgctgcgcgtgctgcagcgccgcgcgccctgcaacttcctcgtcttcgggctgggcctcgacagccctatgtgggcggcgctgaaccacggcggccgcaccgtgttcctggaggaagacgcgtcc

SEQ ID NO: 43279 - protein, 150 aa, Zea mays
  misc_feature: Ceres CLONE 1443640-F
  misc_feature (60)..(150): Pfam Name: DUF579 Pfam Description: Protein of unknown function (DUF579)
MSSPTHVRKAIRFASLRAKIAQQGKTGLALRLLLAAALAGFLLVFAARTLVTPSPAPTSSSQAQEYHQDAAPECGKGNAGLPLAVAEALVHYTTSNVTPQQTADEIGVSLRVLQRRAPCNFLVFGLGLDSPMWAALNHGGRTVFLEEDAS

SEQ ID NO: 43280 - DNA, 744 bp, Zea mays
  misc_feature: Ceres CLONE 1443642-F
aaaactggagctccccgcggtggcggccgctctagaactagtggatcccccgggctgcaggaattcgcacgagaccattacctagaacatcctaatcgaaaaaagaggataaaatgttatcttctacctccttagctgctcttctccatggccgcccccattatcctttccctgcgtcgaaggcgcatcttttcctagctctccccaacaaccctacccgtttcctggcctccgcctccgtccgggtcgcctatcctccccggtggcctctccgcgccgccgacggggagcgggacaaccccgtgcaggagctgatggtgcccgattcttggctgacccctgcaggagcaacgcaggaatctgaatggttgagggagacactgcgcaagtggctccactaccactactcccccccaccctggcgacgtggagatcagcagcaccgccgcgcggccgcatcgcgaatccctgacattccggcaacctgatctcggacagatcttgctgcagacggggggtcgacctgaacactctgccgtacccgggagagcctccccggcccccttctcgccgccaaacgctgcagtccgtttgatcgccccacaggaacggagactcactcccctgacaacattcacagtggtgccgcaaccatgaaatttcctatatgggacccaccttctgaggaaactcggccggcataacatgaaccttctttagcgaaaaactaacttcactctaccg

SEQ ID NO: 43281 - DNA, 655 bp, Zea mays
  misc_feature: Ceres CLONE 1443647-F
  misc_feature: Encodes the peptide sequence at SEQ ID NO. 43282
  misc_feature (491)..(491): n is a, c, t, g, unknown, or other
  misc_feature (518)..(518): n is a, c, t, g, unknown, or other
  misc_feature (523)..(523): n is a, c, t, g, unknown, or other
  misc_feature (524)..(524): n is a, c, t, g, unknown, or other
  misc_feature (542)..(542): n is a, c, t, g, unknown, or other
  misc_feature (624)..(624): n is a, c, t, g, unknown, or other
ctggagctccccgcggtggcggccgctctagaactagtggatcccccgggctgcaggaattgattcgacaagacattacctagaaatcctaatcgaaaaaatccaggcagccagccagccagcaagccgcttgggggcgctctctctctagagcttctaccctcgaagaaagatccggggcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaatatgattcgtctggtctggcgcgcgtgagtccagctcgtgtgtcgtgcgtgtctctgtgtgaaggtcngccggcgtgtgtgtatgtatggagtcngccgnncgcgcgcggaagaagaangtgtgcgctggtggggtggtacgtgcttcgacgcgccccagttgtcgcgcgatctgtacaccctgctgcgttttctgttatncatgagatgatttatttgattcaaaaaaaaa

SEQ ID NO: 43282 - protein, 57 aa, Zea mays
  misc_feature: Ceres CLONE 1443647-F
MAGLRMKFVAVAAMAAALVASAAAAEAPAPAPASDAAAAVPLAAASLAAAAFGYLFC

SEQ ID NO: 43283 - DNA, 696 bp, Zea mays
  misc_feature: Ceres CLONE 1443649-F
  misc_feature: Encodes the peptide sequence at SEQ ID NO. 43284
  misc_feature (422)..(422): n is a, c, t, g, unknown, or other
ctccccgcggtggcggccgctctagaactagtggatcccccgggctgcaggaattcgcacgagaccattacctagaacatcctaatcgaaaaaccgcgcgcgcccacctgccttccgccgtccctgcagccgcaagaaagctcttcttccgctgcagggccgcgtccaccatgaacgaggcatcggcgagctcgccggacgccgaggagaagaagacgactactgtcttcgtggcctgctcgacggggcgcaccggcaagctcgctgtggagaagctgctggccaagggattcggcgtcgtcgccgggacgacggacgtgagaagggaccgaggcagcctgaaccaaaaccccaaccttccgctcggtcggggctgacggcgacagaaggcggtcgactaagctgaccccccccccgtgacncggccgtcaaatgctgtccgtctgcgctcacgggcattgcggcgcgtccctttgaacccctctgcgctccggggcaaatgtataacagacttgtggctacatctgaaacccgggttcgaacccatccctaatagcgctggagccgacccaagaattctagacttccgtccggcgaccatttttaaaacaaagggtggccacctttgggttacaaccttccggaatactggaaccttaaagatggggcgcgccggcggccttcgggatcaaagga

SEQ ID NO: 43284 - protein, 124 aa, Zea mays
  misc_feature: Ceres CLONE 1443649-F
PRGGGRSRTSGSPGLQEFARDHYLEHPNRKTARAHLPSAVPAAARKLFFRCRAASTMNEASASSPDAEEKKTTTVFVACSTGRTGKLAVEKLLAKGFGVVAGTTDVRRDRGSLNQNPNLPLGRG

SEQ ID NO: 43285 - DNA, 654 bp, Zea mays
  misc_feature: Ceres CLONE 1443662-F
  misc_feature: Encodes the peptide sequence at SEQ ID NO. 43286
  misc_feature (654)..(654): n is a, c, t, g, unknown, or other
ctccccgcggtggcggccgctctagaactagtggatcccccgggctgcaggaattcgcacgagaccattacctagaacatcctaatcgaaaagaccaaaagattcccacgggctcgccgctcgcatctcgccagcgcgaacgcagcctccgtgcatatcaccagcctcctcgcgcacccggtcccgcttgcctttccccacctactcgccgtcgcggtgccgtgcgccggtgctgttcagtctagggtttcggccctcgcccgccgatccgtccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaatgttgcctcttgtattccgtgtttcgcggtgttccagttggtttgcttgatccgaagatgtttcagcctctcatctgcn

SEQ ID NO: 43286 - protein, 62 aa, Zea mays
  misc_feature: Ceres CLONE 1443662-F
  misc_feature (1)..(62): Pfam Name: TMA7 Pfam Description: Translation machinery associated TMA7
MSKQGGKAKPLKAPKVDKKEYDESDLAYLQKKKDEEKALKELKAKAQKGAIGGSGLKKSGKK

SEQ ID NO: 43287 - DNA, 685 bp, Zea mays
  misc_feature: Ceres CLONE 1443674-F
  misc_feature: Encodes the peptide sequence at SEQ ID NO. 43288
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (17)..(17): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (60)..(60): n is a, c, t, g, unknown, or other
  misc_feature (63)..(63): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (370)..(370): n is a, c, t, g, unknown, or other
  misc_feature (378)..(378): n is a, c, t, g, unknown, or other
ggccctgnnnngactgnggcggggggggnnggnaaataacttgaccgccacggagaacanccnaatcgaaaatcatgtggcacttcaagttttgcccggccattgggccaacatcgggcccattaaaaattatatacgagggggggcggggtacggcggccctcggttccgtggcggggagtgttttccaggccgcggcgcggtaacgtgaaacctggcgaccgagcaagcgacggccatggcgttctggcagacgcgcgattttctcttctgtggcatatgcggcaccctcctcaccttcaactccgtccgctccgcctcctgccctctatacatttttaatcgcgaaggggaaaggagggannnaaanaaatacantacaccaccattggtttaggatattcgaagagggttaaagacacaaaccgaggacgttgttgggcaaagaccagtgacaaataaagcctgtccaaaatgcgaccatccaaaagctgaattttacaacatacagatgcgttcagcagatgaaggagagacgacctcctacacgtgtaaaagatgccgctgtactttcaaagacgaatgaggagtgatcctaccacttctaccgaaatatggcattagtgccgaagaaatttccagccattgacaaactagaactccctccccccctttttttatttat

SEQ ID NO: 43288 - protein, 52 aa, Zea mays
  misc_feature: Ceres CLONE 1443674-F
  misc_feature (42)..(42): Xaa is any aa, unknown, or other
  misc_feature (43)..(43): Xaa is any aa, unknown, or other
  misc_feature (44)..(44): Xaa is any aa, unknown, or other
  misc_feature (47)..(47): Xaa is any aa, unknown, or other
MAFWQTRDFLFCGICGTLLTFNSVRSASCPLYIFNREGERRXXXKYXTPPLV

SEQ ID NO: 43289 - DNA, 679 bp, Zea mays
  misc_feature: Ceres CLONE 1443690-F
  misc_feature: Encodes the peptide sequence at SEQ ID NO. 43290
  misc_feature (88)..(88): n is a, c, t, g, unknown, or other
  misc_feature (191)..(191): n is a, c, t, g, unknown, or other
  misc_feature (379)..(379): n is a, c, t, g, unknown, or other
  misc_feature (383)..(383): n is a, c, t, g, unknown, or other
  misc_feature (384)..(384): n is a, c, t, g, unknown, or other
  misc_feature (415)..(415): n is a, c, t, g, unknown, or other
  misc_feature (421)..(421): n is a, c, t, g, unknown, or other
tggagctccccgcggtggcggccgctctagaactagtggatcccccgggctgcaggaattcgcacgagaccatacctagaacatcctnatcgaaaaaagacgatctgcgaaacaaacactaatgcgtttgcgagagaaaccgagaaagagaagctacagagtcactgaccgaccgctatggcatcgaggcngaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctggagagcgtgcaggagggcnccanntccttggccagcgccgtgggtcgcaccttcnctggcnccaaggacgcgaccgtggacaagacctcgcagacggcgcacaccgcgggcgacaagctcggcgagtacagggactacaccgccgacaaggcccgggaggccaacgacagcgtctcgcgtaagacgggcgagacggcggaggccaccccggacaagctgggcgagtacaaggacagcgccgtggagaaagcgagggagaccaaggacgcggtggcgcagaagacgagcgagaccgcggaagcgaccaagaacaactcgg

SEQ ID NO: 43290 - protein, 167 aa, Zea mays
  misc_feature: Ceres CLONE 1443690-F
  misc_feature (116)..(159): Pfam Name: LEA_4 Pfam Description: Late embryogenesis abundant protein
  misc_feature (72)..(115): Pfam Name: LEA_4 Pfam Description: Late embryogenesis abundant protein
  misc_feature (5)..(5): Xaa is any aa, unknown, or other
  misc_feature (68)..(68): Xaa is any aa, unknown, or other
  misc_feature (69)..(69): Xaa is any aa, unknown, or other
  misc_feature (80)..(80): Xaa is any aa, unknown, or other
  misc_feature (82)..(82): Xaa is any aa, unknown, or other
MASRXNTREARAEADARRAVEELARARDEHLEKAEVNARSAADEIARSRADRGAAGGGGILESVQEGXXSLASAVGRTFXGXKDATVDKTSQTAHTAGDKLGEYRDYTADKAREANDSVSRKTGETAEATPDKLGEYKDSAVEKARETKDAVAQKTSETAEATKNNS

SEQ ID NO: 43291 - DNA, 692 bp, Zea mays
  misc_feature: Ceres CLONE 1443695-F
  misc_feature: Encodes the peptide sequence at SEQ ID NO. 43292
  misc_feature (373)..(373): n is a, c, t, g, unknown, or other
  misc_feature (374)..(374): n is a, c, t, g, unknown, or other
ggagctccccgcggtggcggccgctctagaactagtggatcccccgggctgcaggaattcgcacgagaccattacctagaacatcctaatcgaaaaatccatggcataagccgcgcccgcctccgcacgccccgctccgatggcagccgcggctgtgaccctgccctcctcgggcacgcccttcgccgtcgccacaaccgcctcttcctcatccgcccgccgctgcctgctcctgccctccgcggctccccgccgagctctccgcgtcgtggcctccgccgctaccgaggcgccgcccaagcccacgcagccgccgacatcgccctccggcatcgtgctcgtcgacccatccgaagcccagaaggtgcacccnncccaggccgtctacgaccagaaggtcgtcccgctcatcaccgaggagttcggctacaccaatgtccaccaggttcccaagctcgagaagattgtggtggaacctgccgtcttgggcgccgaggcaaggaacttccaaggggctggatgccgccatgaaagacctggccatgaatcccccggggaaggggccccgtcaagaaccagagggcccaggaaaatcccctggccaagctttccaagatcccgtgaaggaaaaacaccccttccggatttttcccagtcacccttccccggggcgggaataaatggtccacact

SEQ ID NO: 43292 - protein, 184 aa, Zea mays
  misc_feature: Ceres CLONE 1443695-F
  misc_feature (79)..(79): Xaa is any aa, unknown, or other
MAAAAVTLPSSGTPFAVATTASSSSARRCLLLPSAAPRRALRVVASAATEAPPKPTQPPTSPSGIVLVDPSEAQKVHPXQAVYDQKVVPLITEEFGYTNVHQVPKLEKIVVEPAVLGAEARNFQGAGCRHERPGHESPGEGAPSRTRGPRKIPWPSFPRSREGKTPLPDFSQSPFPGAGINGPH

SEQ ID NO: 43293 - DNA, 581 bp, Zea mays
  misc_feature: Ceres CLONE 1443696-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (284)..(284): n is a, c, t, g, unknown, or other
  misc_feature (287)..(287): n is a, c, t, g, unknown, or other
  misc_feature (304)..(304): n is a, c, t, g, unknown, or other
  misc_feature (391)..(391): n is a, c, t, g, unknown, or other
nnnnnnnnnnnnnnnnnnnnnnnnnnnnnnnnnnnnnnnnnnnnnnnnnnnnttaggggnnnnnnnnnnnnnnnnnnnnnnnnnnnnnnnnnnnnnnnnccaagctggagctccccgcggtggcggccgctctagaactagtggatcccccgggctgcaggaattcgcacgagaccattaccaagaacatcctaatcgaagccgccatcgcttcaagcagcgaaccctagccgccctcagcgactgattgcagatcccccagccatgacgttcagcgggagacnggncgacgcacagcacgggncgcggcacgtcaagacatacgctgctcccactgcgccagtgctgtccaaaggataggctatcagcgttcttggtgagaacattgttnaccaagttcctttaagggactgccaggaggctgggggccataaagaaaagttccttcccaaattgtccccaaagggtctccactggggtttatgggggaatcctgggacaattttgttgtggccccccccccggaaaaaacgggggaaacctgggcccccccaaggttttttggggccgggggggagggg

SEQ ID NO: 43294 - DNA, 633 bp, Zea mays
  misc_feature: Ceres CLONE 1443710-F
  misc_feature: Encodes the peptide sequence at SEQ ID NO. 43295
ggagctccccgcggtggcggccgctctagaactagtggatcccccgggctgcaggaattcgcacgagaccattacctagaacatcctaatcgaaaaaggaactattacttttcgccgaagaagaagattccctctctaacctacgtcgataaatctacgagggagcttgaccttgagcaacagagagagagagagagagatgggtttcttctcgtttcttggaagagttcttttcgcttctctcttcatcctctccgcttggcaaatgttcaatgactttggagttgatggtggtcctgcagctacagagctggctccaaagcttcatctgggccagtcacatctatcttctagattaggtgtaaactttgcctagcgtagaggtaaaaacaagtcgtgctgctataagtgcgttaaaaggagttggaggcctaactctttgttatcggaaacatctttcggggctaaccttcgggcttctaccctggggtgggcagccccattcgggtggaattttccaacttgcgagcttgaggaggggcttttccccccgtggggaacgggttttttgcgaaaaggtggcccctttgggggaaataccctttttttttggggagagaaaacccccccccc

SEQ ID NO: 43295 - protein, 58 aa, Zea mays
  misc_feature: Ceres CLONE 1443710-F
  misc_feature (1)..(59): Pfam Name: HR_lesion Pfam Description: HR-like lesion-inducing
MGFFSFLGRVLFASLFILSAWQMFNDFGVDGGPAATELAPKLHLGQSHLSSRLGVNFA

SEQ ID NO: 43296 - DNA, 776 bp, Zea mays
  misc_feature: Ceres CLONE 1443716-F
  misc_feature: Translation starting site: 208
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (422)..(422): n is a, c, t, g, unknown, or other
  misc_feature (468)..(468): n is a, c, t, g, unknown, or other
  misc_feature (472)..(472): n is a, c, t, g, unknown, or other
  misc_feature (484)..(484): n is a, c, t, g, unknown, or other
ttttttgtgtcgtgtccacaacaacaacaacnnnnnnaaaaannnngnccatactggagctccccgcggtggcggccgctctttcacaatggatccccccggctgcaggaattcccacgagaccattacctagaacatcctaatcgaaaaggataggtagcaccggagcaggcacaacgctgcacaatccccttcgacgacgccaagatggtgaacgttcctcagaccaagaagaagtactgcaagaacaaagagtgcaagaagcacacactcgagaaggtgactcactataagaggggaaaggatagcctgtctgctccgggaacgcgccgtgagtgaccgcacgcagtcaggatatgggggtcagaccaagcctgtcttccacaagaaggccgagaccaccgataagatagttcttaganctgcactgaaacagctgcaagcactactcacagaagaaagtctgtnccangcgggcggtttnaaattggaggagacaagaagggcaaggggaacatcctcttttccaagactactaaccaaccttgcctgcaggtaaagaggaagctgcgggtcttaccactactggtgcaaaaaatctctccgccaacctccaaaggttaatggtagcaaatgaaaggaagaccatgctatgtattcagaagtcccaaatgcccggacactcggattgggggggaggtgggcaaactatttgggcctccatgcgaagggggaggttaacctgccgggccgcatacttgtaacccgaagaaaca

SEQ ID NO: 43297 - DNA, 630 bp, Zea mays
  misc_feature: Ceres CLONE 1443717-F
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
ggagctccccgcggtggcggccgctctagaactagtggatcccccgggctgcaggaattcgcacgagaccattacctagaacatcctaatcgaaaaataccatcatcgtccttcctctcatcccctctctctcccacagagacacatcactctctctctctcccatctccatctctgtcagaaggggaggcccagaggggacgaaagggcaattggacctgacaaacagccttcttgaaggaccctcttttccccctaaagagggaccccccgccccccggggaatccaaagccttggggagattttttcccccccgctgtggtggggcccccccccatgtggttttttctcaagggggccccccccccccccgcgggggggggggcccccttttacccccccttttttataaccccacaaaaaaaaaaaaggggggggaacacccccccgggggggggtttcccccccccccccaaagggtggggggaggggccccccccccccccccacccaaaaannnngggggggagaaaaaaaaaaaaataatttttccccctccccccaccccacacccccccnnnnggggttttttttttttttgtagggggggggcggcgcccccccccccc

SEQ ID NO: 43298 - DNA, 655 bp, Zea mays
  misc_feature: Ceres CLONE 1443719-F
  misc_feature: Encodes the peptide sequence at SEQ ID NO. 43299
acccgcggtggcggccgctctagaactagtggatcccccgggctgcaggaattcgcacgagaccattacctagaacatcctaatcgaaaaaaaccagataggagtcttcttcctccccgaccacaccgctcctctccttccaagccctcgtcaccaccagcctgctctcattcctgtgccacctggatctcaactgcttgcgctcaacatgctccccacacactctcgctgcggcgtgtgcccgcccaacccgtgcatcgctctctgtcgcttccgcctcatcataggtgatggcgtcgtcgtccccgcagcagcacacgaggtggcagcaacttttgatagacaaccttgttggatatgatactatacctacaaacagcttggtgatttctcctggtcatggttatttatacaactttgagatgaaggagctaaatggtcttagttatggccatgaaacaccagaaggtcctacaaaatttggagcttggaagatggtgctacgattttcaagagctgctagccaacgccaatgcatctcgtttaagatcgtgcatgtgacctttcctctcctctcctgatgttaggccttcacaacttgtattatgtgcgggcagaaaaatccactcttttatatagcaaccacctgctgtta

SEQ ID NO: 43299 - protein, 96 aa, Zea mays
  misc_feature: Ceres CLONE 1443719-F
MASSSPQQHTRWQQLLIDNLVGYDTIPTNSLVISPGHGYLYNFEMKELNGLSYGHETPEGPTKFGAWKMVLRFSRAASQRQCISFKIVHVTFPLLS

SEQ ID NO: 43300 - DNA, 692 bp, Zea mays
  misc_feature: Ceres CLONE 1443721-F
  misc_feature (473)..(473): n is a, c, t, g, unknown, or other
ctggagctccccgcggtggcggccgctctagaactagtggatcccccgggctgcaggaattcgcacgagaccattacctagaacatcctaatcgaaaaaccacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgcttcttcttcttctggacaccatctgtctttgcccacgcagaaagcggcgccggcgcgcatgaacgacgacaccagtagtagtgacatgcaggtcatcacaccccgcgccgctcgctatctcgacggcggctcgaatggggccgggacgntgcctcgggggaggacgtggcggtgtaccagaaaagggccaaccttttggccagggggatcccggcctacaccggggcattatcaagtttggaagggggggtggaccttttaaaagttcaggttcctgggggaatttggtccacggatttgcaacccggcaatttccgggggtggtttaaaaatgggttttaaggggggggggcctctaacccaaaaaa

SEQ ID NO: 43301 - DNA, 668 bp, Zea mays
  misc_feature: Ceres CLONE 1443726-F
  misc_feature: Encodes the peptide sequence at SEQ ID NO. 43302
aaagctggagctccccgcggtggcggccgctctagaactagtggatcccccgggctgcaggaattcgcacgagaccattacctagaacatcctaatcgaaaaaaaaaaatcgtcgtctccctaccgcaatcgaagaaagggccgggctcaaccgagccctcaaatcgccgcatcgcgcccctagctctctccgtctccctcatcctgacctcgattcgagctagtttcgggaagcaaaggtaccggatcaacccccttgatcacccatggtgcccagggatagggcgcacagcgccgctgctgccaccgcgcccccgacggagaagcccgttcaagggcctatccagaacaacaagtgcgaaaagaaggctccaaagaaggtgcataaatctgagagagagaaacgtaagcgggacaagcagaatgatctctttggtgagctgggaaacatgctagaacctgatagacagaacaatggaaaggcatgcatattaagtgacactacacgaatacttaaagatctactttcacaagtagaatctcttcgaaaggagaacaacacgctgaagaatgagtctcattatgtcgctttggagagaaatgaactactggatgaaaccaatatgatccgtggcgaaatatcagaccttcaaaacgagatgaggatg

SEQ ID NO: 43302 - protein, 134 aa, Zea mays
  misc_feature: Ceres CLONE 1443726-F
  misc_feature: The sequence is a functional homolog of SEQ ID NO 1185 in the 11/479,226 US patent application
  misc_feature: The sequence is a functional homolog of SEQ ID NO 532 in the 10/412,699 US patent application
MVPRDRAHSAAAATAPPTEKPVQGPIQNNKCEKKAPKKVHKSEREKRKRDKQNDLFGELGNMLEPDRQNNGKACILSDTTRILKDLLSQVESLRKENNTLKNESHYVALERNELLDETNMIRGEISDLQNEMRM

SEQ ID NO: 43303 - DNA, 655 bp, Zea mays
  misc_feature: Ceres CLONE 1443744-F
  misc_feature: Encodes the peptide sequence at SEQ ID NO. 43304
ccgcggtggcggccgctctagaactagtggatcccccgggctgcaggaattcgcacgagaccattacctagaacatcctaatcgaaaaaacaggaaaaaaggcctagaggcagtgccgtgaccgattcgagacgcaagagaaggatcgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaagtgctctgtccattgaagattttgttgacagcaacagggtagatgttggtagctgctctgcaacaaactgatacaacctaacaccaaaccatgccaacctcagccaaagggcaaaga

SEQ ID NO: 43304 - protein, 119 aa, Zea mays
  misc_feature: Ceres CLONE 1443744-F
  misc_feature (42)..(113): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSYSRGSSERYGSRSPYSRSTRYRSRSRSVDSSDAENPGNNLYVTGLSARVTDRDLEKHFSTEGEVIDASVVYDPWTRESRGFGFVTMAAVKDADRCIKYLDRSVLQGRVITVEKCSVH

SEQ ID NO: 43305 - DNA, 691 bp, Zea mays
  misc_feature: Ceres CLONE 1443750-F
  misc_feature: Encodes the peptide sequence at SEQ ID NO. 43306
  misc_feature (551)..(551): n is a, c, t, g, unknown, or other
  misc_feature (558)..(558): n is a, c, t, g, unknown, or other
aagctggagctccccgcggtggcggccgctctagaactagtggatcccccgggctgcaggaattcgcacgagaccattacctagaacatcctaatcgaaaaaatcagcaataatctcgccgtctcatcgcaaaacccagcgccccaaagcgaccccaccgaagcgtcccagcccgaccggaatggcgatggcaccgtgcgcacccgcctccgtctcctccttccccgcccgtccagtgcggaccccttccgctgtccggccgcgcggcgccgcgatccgcgccgctgcggcggcggtggagggtggcaggtggtgggcgccactactggggtggtcggggaaggccgactaccttgaggccccggccccggccccggcggtgccgcaggacgacgacgcggccgcggcgcgcaggcagttcgtggggggcctgacggaagaaaaggccccgcagctgcgggcgcggatggcgcagacggagtccttccacgacgccatgtaccactccgccatcgcctcacgcctcgcccgctccgcctaaacaggccggnccgcccngccgcccgcccgccgccgtagatctagagctcccgcccgctttttgtgtttactgggtttcggctttcatttttcgggggaatgtctttgttttccactaccccatttgtcgtcgtccgtcgtcgttcgtgga

SEQ ID NO: 43306 - protein, 119 aa, Zea mays
  misc_feature: Ceres CLONE 1443750-F
MAMAPCAPASVSSFPARPVRTPSAVRPRGAAIRAAAAAVEGGRWWAPLLGWSGKADYLEAPAPAPAVPQDDDAAAARRQFVGGLTEEKAPQLRARMAQTESFHDAMYHSAIASRLARSA

SEQ ID NO: 43307 - DNA, 725 bp, Zea mays
  misc_feature: Ceres CLONE 1443753-F
  misc_feature: Encodes the peptide sequence at SEQ ID NO. 43308
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
catagctggagctccccgcggtggcggccgctctagaactagtggatcccccgggctgcaggaattcgcacgagaccattacctagaacatcctaatcgaaaagtcaacgacgacgtctgccggcagtgctcctgctcctcctcctcctccttcccggccgccgcgcgagcttggtgggttagtgtctcttcttcgcggagacctgtgagaggagccatcatcatggccgccgttgagactgttgtcctcaaggttgctatgtcatgcgagggttgcgcgggggcggtcagaagagtgctctccaagatggaaggagttgaaaccttcgacatagacctcaaggagcagaaggtgacagtcaaaggggcatgtcagcctgaggacgtcttccagacggtttccagtcggggaaagaagacctcctactgggagggcgaacccacggcccgaaacctgggggggttttgggaaccaaaacattcccgggaccccgggaaaaaaggcccccctgttgttttctcggggggcccaaaattaccccccccacaaaggtaaccccgtgtccccccctttttttcccccccctggggggggggggggggggcccccaaattttatatttaaaaaaggggggggagtgggtgtttttaaacctttgtttccccgcccncnnggtgttttttttatttggttgaaacacccccccccccggggtgttttctct

SEQ ID NO: 43308 - protein, 110 aa, Zea mays
  misc_feature: Ceres CLONE 1443753-F
  misc_feature (7)..(68): Pfam Name: HMA Pfam Description: Heavy-metal-associated domain
  misc_feature: SWISSPROT Homolog: EC 3.6.3.4 Copper-exporting ATPase
MAAVETVVLKVAMSCEGCAGAVRRVLSKMEGVETFDIDLKEQKVTVKGACQPEDVFQTVSSRGKKTSYWEGEPTARNLGGFWEPKHSRDPGKKGPPVVFSGGPKLPPPQR

SEQ ID NO: 43309 - DNA, 663 bp, Zea mays
  misc_feature: Ceres CLONE 1443758-F
  misc_feature: Encodes the peptide sequence at SEQ ID NO. 43310
aagctggagctccccgcggtggcggccgctctagatctagtggatcccccgggctgcaggaattcgcacgagaccattacctagaacatcctaatcgaaagaaggaaggttccagcgaccgcggtcgtggagtaggactgtatgagaaagcgcgatggggaagaagcggcagcttatctgcctcgcagccgccgtcaccgccgcggccatcctcctgacagcgtcggccaagaagtccagcgacgtcaccgagcttcacatcggcgtcaagtacaaacctgagtcatgtatcctacaagcacacaacggagacaaaattaaggttcattatcgtggggcactcgctgacagatcagtttttgattctagctatgacagaggtgacccgtttgaatttactcttggaaatggccaagcgaccaaaggctgggaccaaggattgctaggtatgtgcctcggtgaaaagcgcaagctaaagatacctgcaaagatgggctatggcgagcgaggctccccaccgaacattccaggcggagcgactctggtcttcgacacggagcttatcaccgtcaacggaaagacatctggcggtgcgaatcctcaaactgatagtgagctatgatactatgcattgcatggagagtttcagctcgtaggagtact

SEQ ID NO: 43310 - protein, 155 aa, Zea mays
  misc_feature: Ceres CLONE 1443758-F
  misc_feature (43)..(137): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGKKRQLICLAAAVTAAAILLTASAKKSSDVTELHIGVKYKPESCILQAHNGDKIKVHYRGALADRSVFDSSYDRGDPFEFTLGNGQATKGWDQGLLGMCLGEKRKLKIPAKMGYGERGSPPNIPGGATLVFDTELITVNGKTSGGANPQTDSEL

SEQ ID NO: 43311 - DNA, 716 bp, Zea mays
  misc_feature: Ceres CLONE 1443763-F
  misc_feature (1)..(1): n is a, c, t, g, unknown, or other
  misc_feature (317)..(317): n is a, c, t, g, unknown, or other
  misc_feature (319)..(319): n is a, c, t, g, unknown, or other
  misc_feature (403)..(403): n is a, c, t, g, unknown, or other
  misc_feature (404)..(404): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (428)..(428): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (513)..(513): n is a, c, t, g, unknown, or other
  misc_feature (517)..(517): n is a, c, t, g, unknown, or other
  misc_feature (518)..(518): n is a, c, t, g, unknown, or other
  misc_feature (522)..(522): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
naaatctggagctccccgcggtggcggccgctctagaactagtggatcccccgggctgcaggaattcgcacgagaccattacctagaacatcctaatcgaaaaaaatcacaacccgcactcgcccaaaaccctactgctcccgctccgctcctgcttggtcgagatcacttcgccgccgccgctttcgagatctccgggtggagcaagcgagcaaaggcagcagccatgtcgctccgcgtgctgaaccctaacgccgaggtgctcaacaagtcggcagcgctgcacatgaacatcaaacgcggccaagggcctcccngnacttgctctagaccaacctcggccccaagggcaccctcaaaatttttttcccccccccccgggggggaaagaaagggggggaannattnnnaacccccctctttaaccnaaatccaaaaaaaaaaaacccaacttgcattcgtggtggggggggggcnnnttcccccccccccccccccccccccccnnnaaanaaannaaanaaaaatttttatatttatttgaggaaactaatgaaagtattttgaagcgggttcctccgaattaaggaaagttctcgccaaaacccattaggtataataagtttctgacacttcccctcaaagagagcagactctccattctcgccccgaaagcgcggggnnnnnnnnnnnnnnnnnnnnnnnnnnnnnnnnag

SEQ ID NO: 43312 - DNA, 703 bp, Zea mays
  misc_feature: Ceres CLONE 1443767-F
  misc_feature: Encodes the peptide sequence at SEQ ID NO. 43313
  misc_feature (396)..(396): n is a, c, t, g, unknown, or other
  misc_feature (397)..(397): n is a, c, t, g, unknown, or other
  misc_feature (401)..(401): n is a, c, t, g, unknown, or other
  misc_feature (408)..(408): n is a, c, t, g, unknown, or other
aacgctggagctccccgcggtggcggccgctctagaactagtggatcccccgggctgcaggaattcgcacgagaccattacctagaacatcctaatcgaaaaccccgccgcctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgactcccgtgtcccgaggaagttcaagggatgccccttgatgcccaacattggttatggttctgacaagtcgaccaggtattttctcccccccccctggggggaaagaaagggggccnncacntttcctnaccttcaccccccccctgatgaaacaaaaagaccctaactgccctgaaattggggcgccaccgggcccccctaaaaaaacccaaggaaaatccctgaaaccctgcctccccaccccccacctttgttgggcacgaaacaacccttgcctaaggccccccaccccagcaaggaacagagacgcctggtttctctgtccttaacgcaccaaacggcatagtcgccccctccccttccccagagaaaaacaactttgcgttgggcccttagccaaaacctgaaaaccccaaacccacc

SEQ ID NO: 43313 - protein, 94 aa, Zea mays
  misc_feature: Ceres CLONE 1443767-F
  misc_feature (14)..(94): Pfam Name: Ribosomal_L32e Pfam Description: Ribosomal protein L32
  misc_feature (79)..(79): Xaa is any aa, unknown, or other
  misc_feature (83)..(83): Xaa is any aa, unknown, or other
MAVPLLTKKIVKKRVKQFKRPHLDRYKCLKPSWRRPKGIDSRVPRKFKGCPLMPNIGYGSDKSTRYFLPPPWGERKGAXTFPXLHPPPDETKRP

SEQ ID NO: 43314 - DNA, 781 bp, Zea mays
  misc_feature: Ceres CLONE 1443768-F
  misc_feature (371)..(371): n is a, c, t, g, unknown, or other
  misc_feature (375)..(375): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (472)..(472): n is a, c, t, g, unknown, or other
aaagctggagctccccgcggtggcggccgctctagaactagtggatcccccgggctgcaggaattcgcacgagaccattacctagaacatcctaatcgaaaaataccgagtagaatagagaggggagagggctagggttcagagcacgacgagccataacttcaacaagcagcgggcgggtctcgggcggcgcgcgggcgcttggtggacgacgctcaagcggaggcgggcagcgcttgggagtcaggcgtgcgaccttgcggctgtgctcaggcggggcgttgcgtgaagcgctagggagtcgggtgtgcgacgggcggcgctcgttcctcaggcatgtgcggaccacgctcccaccccttgtttgtgtngaanaaaagggggacgacgcctactccaacccannnntcaggtccccccccccaccattgggccttcggtgtgggggcaccccgctccctccccggcgaanaacaaccaccttaaaaccgggtagttttatgggagcactgggttacccgaccttagcctcccggaggtgcgctaagggctccatgcccccggcagggctgcccgcacgcccccccaaccaatgaacgagcgccaaaccccccccggcccccccctgttttcccatttccaaaaaggggggtgcccctttgacaaaaggctctacccccccaaactttcaacacgcggtctcctacaccagcctacagcgcccccgccaccccaacctccgcccctcctctcgcccgccacccgtgtttcccccctcccc

SEQ ID NO: 43315 - DNA, 684 bp, Zea mays
  misc_feature: Ceres CLONE 1443779-F
  misc_feature: Encodes the peptide sequence at SEQ ID NO. 43316
aagctggagctccccgcggtggcggccgctctagaactagtggatcccccgggctgcaggaattcgcacgagaccattacctagaacatcctaatcgaaaaagtctctcgcccctctctcccaccccgcagccgccgcgcaggtagccctagcacccgcgacgagcaggacctgcccagttgctctttgagtagttcccccaactgtcaccatgcagaacgaggagggtaagactgtggacctctatgtccctaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttgttgggttccttctgagtttgatgtgtggtgttcgtttaattcccttgtacaaccccatttagtatcattgtgatgattttggattcaattttgctcgagtcagggtac

SEQ ID NO: 43316 - protein, 81 aa, Zea mays; identical to SEQ ID NO: 6959
  misc_feature: Ceres CLONE 1443779-F
  misc_feature (1)..(81): Pfam Name: Ribosomal_S21e Pfam Description: Ribosomal protein S21e

SEQ ID NO: 43317 - DNA, 772 bp, Zea mays
  misc_feature: Ceres CLONE 1443787-F
  misc_feature: Encodes the peptide sequence at SEQ ID NO. 43318
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (280)..(280): n is a, c, t, g, unknown, or other
  misc_feature (415)..(415): n is a, c, t, g, unknown, or other
  misc_feature (420)..(420): n is a, c, t, g, unknown, or other
  misc_feature (451)..(451): n is a, c, t, g, unknown, or other
  misc_feature (459)..(459): n is a, c, t, g, unknown, or other
  misc_feature (465)..(465): n is a, c, t, g, unknown, or other
  misc_feature (514)..(514): n is a, c, t, g, unknown, or other
  misc_feature (520)..(520): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactggaactccccgcggtggcggccgctctagaactagtggaacccccgggctgcangaattcgcacgaaaccattacctagaacatcctaatcgaaaaacgttcagcatccgtccgtcctttcgaaaatgtggttcggtggcggaaccatcgacgcggcgggcgcgctgcgcggcttcctgcgggaaacangcggntgcgccgtggtggaccggggtctcggcacgnagctggangcgcancgcgcggacctgcacgacgcgctctggagcgcccaagtgctcgcctccngcccgnatctcatccgcaaggtccatctggactacctcgaagcaagccccgacgtcataatcttctgcgtcttaccagccacaattgagggggttccaatccaggggcttcccccgggaacaaaaccaggaacttctgccgcctaaccgggaactccccccaaaaggcccccaaggcctttcccggcttaaggccaaaggggattcccgcccccgaaaccccccccgggggtttgggggcgccctcctccccggaaac

SEQ ID NO: 43318 - protein, 102 aa, Zea mays
  misc_feature: Ceres CLONE 1443787-F
  misc_feature: SWISSPROT Homolog: EC 2.1.1.10 Homocysteine S-methyltransferase
  misc_feature (22)..(22): Xaa is any aa, unknown, or other
  misc_feature (34)..(34): Xaa is any aa, unknown, or other
  misc_feature (36)..(36): Xaa is any aa, unknown, or other
  misc_feature (38)..(38): Xaa is any aa, unknown, or other
  misc_feature (55)..(55): Xaa is any aa, unknown, or other
  misc_feature (57)..(57): Xaa is any aa, unknown, or other
MWFGGGTIDAAGALRGFLRETXGCAVVDRGLGTXLXAXRADLHDALWSAQVLASXPXLIRKVHLDYLEASPDVIIFCVLPATIEGVPIQGLPPGTKPGTSAA

SEQ ID NO: 43319 - DNA, 639 bp, Zea mays
  misc_feature: Ceres CLONE 1443788-F
  misc_feature: Encodes the peptide sequence at SEQ ID NO. 43320
tggcggccgctctagaactagtggatcccccgggctgcaggaattcgcacgagaccattacctagaacatcctaatcgaaaaacccaagcgcttgcaatccacttgacttttctcctcctcgtctccttgtcctcacctctccgccgccatgtccatccccggtaacgggcaccttcccgcgtccgcttccctcccggaccactcctccgcctctgactccgacgccgatccggaatccgactaccggccaatcaccaccgccgactccgactccgaccccgacttcgacgccgccttgccccaccaccgcatcgaggagacagaaaacggcatctccgcgctggatctcgcgtccgacgaggacgaagcggcagaaggcgcggaggaagacgatggggacggagacccgaggcccggggaggcggcggcgcgggccttctcggaggacgagcgtcgccgccgcgccccgctgcccgcgggcgccgcggcgcggatcgtggacgcgatgcgcggcgtcgagttccccggcgcgccgccggcgtgggcgggcagcgtccccgaggaccagtggctcgaccgcctccagtctctccgtgccggtcgtcccaactgatgtgatgagcagaacacaatgggtc

SEQ ID NO: 43320 - protein, 154 aa, Zea mays; identical to SEQ ID NO: 42397
  misc_feature: Ceres CLONE 1443788-F

SEQ ID NO: 43321 - DNA, 659 bp, Zea mays
  misc_feature: Ceres CLONE 1443793-F
  misc_feature: Encodes the peptide sequence at SEQ ID NO. 43322
  misc_feature (601)..(601): n is a, c, t, g, unknown, or other
  misc_feature (602)..(602): n is a, c, t, g, unknown, or other
ctccccgcggtggcggccgctctagaactagtggatcccccgggctgcaggaattcgcacgagaccattacctagaacatcctaatcgaaaagcaacgattacggtaacgccgtcgccgccctacggctcagatcttcgtcgtcatcttctccggcaacgagcacccaaggatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagttccaagcttcatacgcaacagttcttaaggcccatatgcatgctctgaagaaaagggagaggaaagacaagaagaaggctgcagatgctgagaaggcaattgagaccgcacccaagaagcagaagaaagcatcttcaaagaaatcttcggggtccaagtcataaggcgctcgcagaaatcagtgtcttctcccttctnngtgtaccgcaccgccagactaattagagtgtcgtgaattttatctggtttttatccg

SEQ ID NO: 43322 - protein, 131 aa, Zea mays
  misc_feature: Ceres CLONE 1443793-F
  misc_feature (4)..(93): Pfam Name: SRP14 Pfam Description: Signal recognition particle 14kD protein
MVVLQPDRFLSELTSMYERSTEKGSVWVTMKRSTLKGKAQLRKMENKGQEVEHRCLVRASNGKKNISTSVSLKEYTKFQASYATVLKAHMHALKKRERKDKKKAADAEKAIETAPKKQKKASSKKSSGSKS

SEQ ID NO: 43323 - DNA, 753 bp, Zea mays
  misc_feature: Ceres CLONE 1443799-F
  misc_feature: Encodes the peptide sequence at SEQ ID NO. 43324
aagctggagctccccgcggtggcggccgctctagaactagtggatcccccgggctgcatgtattcgcacgagaccattacctagaacatcctaatcgaaaagaaaaaggacatcatcaccctcaggcacaaggtatcgcaccatcgtgggacccgtacagcgcaccgcccagccgccggatctgcgccggcgacgcgcccggacgtcggatctacgcagccgcaagatgggggaggcggtgctgtggccgttctctgcccgtgagcgcccggatccgtcccgccgcatggataatggatccgacacacaagccaaatgtatcgagcagtccaccaacaccacggctggactgcataaaatgctttgatatgctctggttctgttactcaccattccgccagatgcaaagggcccccccccccccccaaaaccaacacatgggtttgggaagcggtagaaatcctaatggcctgtctcgcttctccagacaaatcgtacggcagacgttggagttatatcctcttttcgggtgaaaacggccaaacctcgttcttttggtttttctcggacggggcggcgtatgcaattcggaacaattggtggggctaagggacaagccattcctggtaaaggatgtccccccctttttacggttattttttcagttttccctccccaggtccccaacgaattccttgtctcctcccaagggggaattttctcacgatttggccccggtcctgggtctcttgt

SEQ ID NO: 43324 - protein, 79 aa, Zea mays
  misc_feature: Ceres CLONE 1443799-F
MDPTHKPNVSSSPPTPRLDCIKCFDMLWFCYSPFRQMQRAPPPPQNQHMGLGSGRNPNGLSRFSRQIVRQTLELYPLFG

SEQ ID NO: 43325 - DNA, 673 bp, Zea mays
  misc_feature: Ceres CLONE 1443802-F
  misc_feature: Encodes the peptide sequence at SEQ ID NO. 43326
ctggagctccccgcggtggcggccgctctagaactagtggatcccccgggctgcaggaattcgcacgagaccattacctagaacatcctaatcgaaaaatataaaccgaccccaacgcatccattatattcagcttcttgatctcacacgaaggcatggcgacggagatccagggctactacgatgacggcaccgccgtggtgtcgttcgacgtgcacaacatcgacaccacgctgacgaacttgggcagcgtggtggagtggtggctgggtgagacctatcgcctccaccaccgcggccggaggctctacgaaggcgactactagggtctagggttacggtatgctgtctggtttagcaatgccatgcgtgtcaggccggcgtatcagtattagcagtcgtcgatggtcttcagtttgcgttgcagttgtgtcctctaatttctctgcctaataagttgtactagctagtatcacgcgcgtgatctcttttgtgtgcgccaccactcgtcatgcatatggcatttcgacttcaaaatttgaatgctatcttgaagcccaaaaaaaaaaaaaaaagcttatcgataccgtcgacctcgaggggggggccggtacccattcgccctatagtgagtcgtattacgcgcgctcactggccgtcgttttaacacgtc

SEQ ID NO: 43326 - protein, 56 aa, Zea mays
  misc_feature: Ceres CLONE 1443802-F
MATEIQGYYDDGTAVVSFDVHNIDTTLTNLGSVVEWWLGETYRLHHRGRRLYEGDY

SEQ ID NO: 43327 - DNA, 667 bp, Zea mays
  misc_feature: Ceres CLONE 1443803-F
  misc_feature: Pfam Name: DnaJ_C Pfam Description: DnaJ C terminal region
ctggagctccccgcggtggcggccgctctagaactagtggatcccccgggctgcaggaattcgcacgagaccattaactagaacatcctaatcgaaaagatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgaggggatgccaatttaccagaggcctttcatgaaggggaagctgtacatccatttcacggtggagttccctgactcgttggcaccagagcagtgcaaggctctcgagacagtacttccaccaggccttcatccaagctgacagacatggagatagatgaatgcgaagagacgactatgcatgatgtgaacaacatcgaggaaaagatgcgcaagaagcaagctcacgctgcccaggaaggctacaaagaagacaaccaaatgccgggcggaccccaaaaagtgcaaggcccccaaccgaagccaacttcctcaaggcatttgggaagggtgggggcccttaaaaatgggaaaggatcccctggttttccttcccccaattggaaaaagaaa

SEQ ID NO: 43328 - DNA, 601 bp, Zea mays
  misc_feature: Ceres CLONE 1443808-F
  misc_feature: Encodes the peptide sequence at SEQ ID NO. 43329
tggagctccccgcggtggcggccgctctagaactagtggatcccccgggctgcaggaattcgcacgagaccattacctagaacatcctaaccgaaaagcatcacgccacaaccacaccacacggcaccagcctcctccgtcgtcaccacctcgggcctcggccgatcgatcgggtctggcggcggccacaagcgtcgctgtttaataaatagccctgagcggcctccccctgcccctcagttcagcctcggctggacatcgagtttgtaccgggaaacagcttggtagtataaccactgaagatggtcagtgggaggccgcatggtgaattggactcatggttcaagagcctcatggtgacctctagcaccgagagggggcaggctgggagtggtggtccagcgccaacattaacaggatggaaggaccttccgatggagctcctggtgcggataatatccacagttggagatgataggatggtcatcgtggcgtctggtgtttgcacaggctggcgtgacgcgctgggatggggggtcactaatctttcacttacatgatgagagtgtggttgctcttgccaacggatgtccgcacctgc

SEQ ID NO: 43329 - protein, 85 aa, Zea mays
  misc_feature: Ceres CLONE 1443808-F
MVSGRPHGELDSWFKSLMVTSSTERGQAGSGGPAPTLTGWKDLPMELLVRIISTVGDDRMVIVASGVCTGWRDALGWGVTNLSLT

SEQ ID NO: 43330 - DNA, 656 bp, Zea mays
  misc_feature: Ceres CLONE 1443815-F
  misc_feature: Encodes the peptide sequence at SEQ ID NO. 43331
  misc_feature (434)..(434): n is a, c, t, g, unknown, or other
  misc_feature (435)..(435): n is a, c, t, g, unknown, or other
  misc_feature (440)..(440): n is a, c, t, g, unknown, or other
  misc_feature (442)..(442): n is a, c, t, g, unknown, or other
  misc_feature (443)..(443): n is a, c, t, g, unknown, or other
  misc_feature (472)..(472): n is a, c, t, g, unknown, or other
  misc_feature (473)..(473): n is a, c, t, g, unknown, or other
  misc_feature (594)..(594): n is a, c, t, g, unknown, or other
tggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacgggcggtgcaagtgcggcggcaactgccagtgcgacccctgggcactgcggcagtgagctaggtgctccaccctgcanngccgncnngagaacctagctaattatttatagctaanntaagtatagcggcgtccgctgtgtgtgtttcgagtcagtcagtcaattatttgcgtgccatggctggcatgctctgattctgaaatgatgatgatgctgatgggcggctccggtcctgaantccttccctgccccctcgggcgcttcggcggcaaaacattgtgttggttttgttttgggggt

SEQ ID NO: 43331 - protein, 82 aa, Zea mays
  misc_feature: Ceres CLONE 1443815-F
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAAAGAENGRCKCGGNCQCDPWALRQ

SEQ ID NO: 43332 - DNA, 677 bp, Zea mays
  misc_feature: Ceres CLONE 1443817-F
  misc_feature: Encodes the peptide sequence at SEQ ID NO. 43333
  misc_feature (290)..(290): n is a, c, t, g, unknown, or other
  misc_feature (675)..(675): n is a, c, t, g, unknown, or other
ggagctccccgcggtggcggccgctctagaactagtggatcccccgggctgcaggaattcgcacgagaccattacctagaacatcctaatcgaaaaagtgaagttagccatcagtacgcggacacgctccatcagcgtcaggccacagccaccatggtgaagctggcgacggcgcgcgagtgccgcgcatacagcctcggcgccggcgcggggtccggcacgggggttgcgcaaccggtgggagtacatcaacgccggggtgtacatcttcccggcgggtctcctgttcngcgggttcctggcgcaactcctgccgtggggcgggcccagcagcccggggctcgtggtcgccgcgatcgggctcgccggcttgctggccgtcaaaacgaaagacctcctcgggcacgccgccgggggtcaattaccgcctcgggatggtggtcgggcttgaaccccaaatggggctcgtcgagctcggcgtccccgccgtgcaaaattcgtggcacccgcgctcaagctccgccgcttgccgtcttcctttgtgatttcaaatggaaaaaagggttcccgggaacagccctaagccatgcaacggcctggaaccctggttcataagaccggaccgggcattggtggtggcccggggggtcctgttgacaaaaaatcttggcccantc

SEQ ID NO: 43333 - protein, 36 aa, Zea mays
  misc_feature: Ceres CLONE 1443817-F
MVVGLEPQMGLVELGVPAVQNSWHPRSSSAACRLPL

SEQ ID NO: 43334 - DNA, 637 bp, Zea mays
  misc_feature: Ceres CLONE 1443819-F
  misc_feature: Encodes the peptide sequence at SEQ ID NO. 43335
ctccccgcggtggcggccgctctagaactagtggatcccccgggctgcaggaattcgcacgagaccattacctagaacatcctaatcgaaaaaaaaaatgggctaaaataaaaaaaatcgaccgccttcctcccagcccaagtggatgtgcaggaccgcgaacacgaggaggcaggggagcagcatccacaaccacaagccatggcggggaggaccaacatccccactaacaactccgccctcatcgcaatcatcgccgacgaggacaccgtcactggcttcttgatggccggcgttggcaatgttgatctgcgcaagaaaaccaattacctcctcgtcgacaacaagacgacagttaaacaaatcgaggacgcgttcaaagaatttactacaagggaggatattgctattgtgctcatcagtcagtatattgccaacatgataagatttctggtggatagctacaacaagccagtccctgctattctggagatcccatccaaggaccatccatatgatccagcgcacgactcggtgctgtctcgagtgaaatatctcttctctgcggaatcggtggcgtctgataggcgatgaggcatccttgtgtagtgtaccccttggggtatctgttttgtta

SEQ ID NO: 43335 - protein, 130 aa, Zea mays
  misc_feature: Ceres CLONE 1443819-F
  misc_feature (15)..(115): Pfam Name: ATP-synt_F Pfam Description: ATP synthase (F/14-kDa) subunit
  misc_feature: SWISSPROT Homolog: EC 3.6.3.14 H(+)-transporting two-sector ATPase
MAGRTNIPTNNSALIAIIADEDTVTGFLMAGVGNVDLRKKTNYLLVDNKTTVKQIEDAFKEFTTREDIAIVLISQYIANMIRFLVDSYNKPVPAILEIPSKDHPYDPAHDSVLSRVKYLFSAESVASDRR

SEQ ID NO: 43336 - DNA, 627 bp, Zea mays
  misc_feature: Ceres CLONE 1443822-F
  misc_feature: Encodes the peptide sequence at SEQ ID NO. 43337
gcggtggcggccgctctagaactagtggatcccccgggctgcaggaattcgcacgagaccattacctagaacatcctaatcgaaaaaatgcttccaatccttggtctccagctccgcctcgcgtcttcctttccgctgcaggaaagtgcaaacccccactcaactaaaaaaagccgcaaggcaaagagaaaaagcaacgcgaagcaaaccaccatttcggcctccccacccccatcccatctcatcccctccgaggctccagggacggcgtgatgaggccagcggcgccggctgcggcggcggacgcgcaccagtcgcggctgctctacgagctctgcgcgctcctgctgaccgtcctcggagcgtcgccggacgacggggcgggggcgcggccgctgctgccgcggcaggtgacacctgccggggtggcgtccatgctgctgggcgcgtccatggcgctgatgctctgcggctcggtcaccttcatgctcggattcttcctcatgccctgggtcgtcgggctcggcttcctcttcctcttcgtcggcttcgtcaccaacctctccggggatctggagggccatcctcctctggccctccgccgcgtgctcgcccaaggaagcatcc

SEQ ID NO: 43337 - protein, 118 aa, Zea mays
  misc_feature: Ceres CLONE 1443822-F
MRPAAPAAAADAHQSRLLYELCALLLTVLGASPDDGAGARPLLPRQVTPAGVASMLLGASMALMLCGSVTFMLGFFLMPWVVGLGFLFLFVGFVTNLSGDLEGHPPLALRRVLAQGSI

SEQ ID NO: 43338 - DNA, 654 bp, Zea mays
  misc_feature: Ceres CLONE 1443827-F
  misc_feature: Encodes the peptide sequence at SEQ ID NO. 43339
ctccccgcggtggcggccgctctagaactagtggatcccccgggctgcaggaattcgcacgagaccattacctagaacatcctaatcgaaaattcctcccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagataggaacttgagattgtatgaatttgagatatggtgatatgagctgatgatttttattatgcttattgttgctcctctgagctgttatttttgaacgctatccaaataaatttgaaaccagattgctgcaaaaaaaaaaaaaaaaagcttatcgataccgtcgacctcgaggg

SEQ ID NO: 43339 - protein, 62 aa, Zea mays; identical to SEQ ID NO: 6893
  misc_feature: Ceres CLONE 1443827-F
  misc_feature (3)..(61): Pfam Name: Ribosomal_S30 Pfam Description: Ribosomal protein S30

SEQ ID NO: 43340 - DNA, 426 bp, Zea mays
  misc_feature: Ceres CLONE 1443833-F
  misc_feature: Encodes the peptide sequence at SEQ ID NO. 43341
  misc_feature (251)..(251): n is a, c, t, g, unknown, or other
atagctggactccccgcggtggcggccgctctagaactagtggatcccccgggctgcaggattcgcacgagaccattacctagaacatcctaatcgaaaaaaacagcctccaggtctagctagggtttcgtctccgccgcttgctctaatcctctcccggcacgcgacacgcgagggcgcagcgtttatggcggcgacaccggcggacgcgaagaccgaggccgccaagatggacctcctcgaggacgacngacgagttccgaagaagtttcgagatcgacccaaaaatggggatggaaaaaggaaaaaggggcaatggaaacctgtcccacccatgggggaaggaataaattgggaaattaaaccaaaaaaggggaaaaaggaaagaattttttcccccctgtggaaattttaaaaaaaaaaaaa

SEQ ID NO: 43341 - protein, 75 aa, Zea mays
  misc_feature: Ceres CLONE 1443833-F
  misc_feature (22)..(22): Xaa is any aa, unknown, or other
MAATPADAKTEAAKMDLLEDDXRVPKKFRDRPKNGDGKRKKGQWKPVPPMGEGINWEIKPKKGKKERIFSPLWKF

SEQ ID NO: 43342 - DNA, 673 bp, Zea mays
  misc_feature: Ceres CLONE 1443835-F
  misc_feature: Encodes the peptide sequence at SEQ ID NO. 43343
  misc_feature (673)..(673): n is a, c, t, g, unknown, or other
ctggagctccccgcggtggcggccgctctagaactagtggatcccccgggctgcaggaattcgcacgagaccattacctagaacatcctaatcgaaaaccgatcgacgcgcacaacacagcgcccacacacacacagacagtcttacgcgacgacacacacgcaaggcggacggacatggatatgagaggagggcacaacatgggcggcatggcaccgccgccgtcccctcacggcggcatgcgaaagcgctacgtccacatgaccttcttctggggcaagaactcggagatcctcttcacggggtggcccggcgcgcgcggcggcatgtacgcgctggcgctcgtcgccgtcttcgctgtcgcgctcctgctcgagttcctaagctcccgccgcctggacgcgctcctctccgccgcggccggccggcgcgcggcagcggcgggggcggcgcgcacggcggtgtatgccctgcgcgtgtgtggagcgtacctgctcatgctggcgctcatgtcgttcaacagcggcgtgctcctcgttgcagtcgcgggccacgccgctggcttcctggcgttcagggccggcctgttcggcgaccggcgggcgcaagtggagggcgacggcaaggatgaggtcccgcccgacgtgtgcttgtaagctccgtccgttgtccn

SEQ ID NO: 43343 - protein, 159 aa, Zea mays
  misc_feature: Ceres CLONE 1443835-F
  misc_feature (27)..(145): Pfam Name: Ctr Pfam Description: Ctr copper transporter family
MDMRGGHNMGGMAPPPSPHGGMRKRYVHMTFFWGKNSEILFTGWPGARGGMYALALVAVFAVALLLEFLSSRRLDALLSAAAGRRAAAAGAARTAVYALRVCGAYLLMLALMSFNSGVLLVAVAGHAAGFLAFRAGLFGDRRAQVEGDGKDEVPPDVCL

SEQ ID NO: 43344 - DNA, 655 bp, Zea mays
  misc_feature: Ceres CLONE 1443840-F
  misc_feature: Encodes the peptide sequence at SEQ ID NO. 43345
  misc_feature (655)..(655): n is a, c, t, g, unknown, or other
tccccgcggtggcggccgctctagaactagtggatcccccgggctgcaggaattcgcacgagaccattacctagaacatcctaatcgaaaaacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgcctactaccaagcatacagagtcctctgtcgccgcccgcgcgcgtcgtcgaccttgcccgcgcagccgctgtcgcgtcgtcgaccccagagactgcgtccgcctgcttcggccttcgcgtctccgtgcaggacgactgctggagggcctccacatctccgtgcacgcggcctacagggaggagatccgggcgttgatggcgcgtgggcaggagggcgtgccgccgcagcacttcgtggatggcctgtacctcgacgacgtcgaagaggn

SEQ ID NO: 43345 - protein, 142 aa, Zea mays
  misc_feature: Ceres CLONE 1443840-F
MSGRGKGGKGLGKGGAKRHRKVLRDNIQGITKPAIRRLARRGGVKRISGLIYEETRGVLKIFLENVIRDAVTYTEHARLLPSIQSPLSPPARVVDLARAAAVASSTPETASACFGLRVSVQDDCWRASTSPCTRPTGRRSGR

SEQ ID NO: 43346 - DNA, 713 bp, Zea mays
  misc_feature: Ceres CLONE 1443842-F
  misc_feature: Encodes the peptide sequence at SEQ ID NO. 43347
  misc_feature (590)..(590): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaatcctatgaatgtgctttctaataggccttcttcactcgctcgtttcaggcattggtggcgagtacctctccgacgccacggcaggaagcctatcgacgatcttcgacgtcggcggcgtgctgggaggggtcctggcgggccacatctccgaccgcctgaacgcgcgcgcgatcacggccgcgagcttcacttactgcgcgatccccgcgctcttcctgtaccgcacgtacgggagcatgtcgatggcgtggaacgtctcgctcatgttcgtcacggggatgttcgtgaacgggccctacgcgctgatcacgacggcggtgtcggccgacctcggcacgcacagctcgctcaacggcaactcccgggctctggccaccgtgacggcgatcatcgacgggacggggtctgtcggagccgccatcgggccgctggtgacggggtacgtctcgtcgaggagctggagcgccgtgttcaccatgctgatggcngcggctctcctcgctgggctcctctttgagcagctcgtgtgcgctgagctgctagggaaaacgcattccagcgtgagcaaggacgcnaggcgtgaacatggtgcctactcagatgaagtgtaa

SEQ ID NO: 43347 - protein, 200 aa, Zea mays
  misc_feature: Ceres CLONE 1443842-F
MCFLIGLLHSLVSGIGGEYLSDATAGSLSTIFDVGGVLGGVLAGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLFEQLVCAELLGKTHSSVSKDARREHGAYSDEV

SEQ ID NO: 43348 - DNA, 700 bp, Zea mays
  misc_feature: Ceres CLONE 1443844-F
  misc_feature: Encodes the peptide sequence at SEQ ID NO. 43349
  misc_feature (496)..(496): n is a, c, t, g, unknown, or other
aaagctggagctccccgcggtggcggccgctctagaactagtggatcccccgggctgcaggaattcgcacgagaccattacctagaacatcctaatcgaaaactggtcctccattcaagctccactccacacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagattgcgtgcgcgcaggacgcgctgagacacaaggcatcatcctatccccacgtgaccggtggaagccctaggagtgcangggtcgtctttcctggtgacgtgttcctcgaaaagaactgcccggggttgctcgcccccctgcttggaggccttcaacaaatggggggctaagggtgtccaaggcccccgggttctggggcaaaatcctttccttttaagggccgggggggagaaaaaacgtggggaaaaacggggaacaaacacccgtgaaaaaaggggtccc

SEQ ID NO: 43349 - protein, 110 aa, Zea mays
  misc_feature: Ceres CLONE 1443844-F
  misc_feature (81)..(81): Xaa is any aa, unknown, or other
MMSRERKKAAALQEKLKILRSITHSHALSNTSIIMDASAYIKELKQKVVRLNQEIACAQDALRHKASSYPHVTGGSPRSAXVVFPGDVFLEKNCPGLLAPLLGGLQQMGG

SEQ ID NO: 43350 - DNA, 684 bp, Zea mays
  misc_feature: Ceres CLONE 1443855-F
  misc_feature: Encodes the peptide sequence at SEQ ID NO. 43351
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgtcgtgtcctcccctggcctcctggggcgcttctggcgagcagtgtgttgtgttgtgtgggtgccgcacgctagcaggctagccatgtgccctgctgtgttgtgtcaccatccat

SEQ ID NO: 43351 - protein, 82 aa, Zea mays; identical to SEQ ID NO: 43085
  misc_feature: Ceres CLONE 1443855-F
  misc_feature (1)..(80): Pfam Name: Metallothio_2 Pfam Description: Metallothionein

SEQ ID NO: 43352 - DNA, 645 bp, Zea mays
  misc_feature: Ceres CLONE 1443861-F
  misc_feature (246)..(246): n is a, c, t, g, unknown, or other
  misc_feature (248)..(248): n is a, c, t, g, unknown, or other
ctggagctccccgcggtggcggccgctctagaactagtggatcccccgggctgcaggaattcgcacgagaccattacctagaacatcctaatcgaaaaagaaggagcacccattgattccgcatctcgtgcaggctctccccaccgcactcccacgcctgataccataccattccgccgccgcatcgacttctcctcctctgaaccccgcgcgggggcggacggagatccagccggacctggatcngnctactccgacaccgctttttggaagataaacaagactggccttcagcctaatgctctgaaaaagtgggaaggatttcccggttccatccccgataatcctgcccccagaacagaacccccctcccaaaaaaaggagtgggaagggggtccgtccctcccaaacttttggaaaaacccccaaggggggttggaaattcagggcctcccccacacccctaaaaaggtcgcccccaaacccaaaaataccagggcttttacccccggggttcaaactcttaaaaaaaaggggggggtaaactcccggaaaaaaaaatttcgccccaaaaatttttccaaaggtgggccccccccccggggaaaaaaggggccccgttttgtcccaaaaagacccccgggc

SEQ ID NO: 43353 - DNA, 652 bp, Zea mays
  misc_feature: Ceres CLONE 1443866-F
  misc_feature: Encodes the peptide sequence at SEQ ID NO. 43354
ggagctccccgcggtggcggccgctctataactagtggatcccccgggctgcaggaattcgcacgagaccattacctagaacatcctaatcgaaaaacgtcaatcctttccacgacacacagttgcggtgagcaattgcaaggcgatgagcttgaggtacatgagccgtgtgggagcgcgggtggtgcgggagagcacgggcaggtcggtcaaggcgcaggcgcacgcggcgtccatggctaggagcggcggcagcagggcgccggccgccgggtctgtggagtcggggagagcgagcgccatgccggcggcggcagcggcccggaggacggcggaggaggagaagcggcggcgcgcctagcaggtgctgcgcaccgtcatgttcctctccgtctggggccccatcacctaggcctagtaggaatcaaaggagtgttagcatcttgtgtaccgttctgtgcacatttgtttgtttgatgttcctagtacagagtgtagatttgttacagtggtataatctttgaagacctcacatccctacgttgattcttgataagtttggatccttaccattagttgatgaatcaaggaagcttatcgataccgtcgacctcgagggggggcccggtacccaatgcgccctatagtgagg

SEQ ID NO: 43354 - protein, 71 aa, Zea mays
  misc_feature: Ceres CLONE 1443866-F
MSLRYMSRVGARVVRESTGRSVKAQAHAASMARSGGSRAPAAGSVESGRASAMPAAAAARRTAEEEKRRRA

SEQ ID NO: 43355 - DNA, 595 bp, Zea mays
  misc_feature: Ceres CLONE 1443871-F
  misc_feature: Encodes the peptide sequence at SEQ ID NO. 43356
acccgcggtggcggccgctctagaactagtggatcccccgggctgcaggaattcgcacgagaccattacctagaacatcctaatcgaaaaaaatcttattaggttgtaatttgtatgaaagctactaggcccccgcatcgcccctttggcgacttgggcggctacaagcctagccgccgccaactcccctccctccccatctctttgcctcgccgccgccggagctagctggtgggttgcccgcgcggctagcgatgaaggcggtggcggggtgcttgctgcgctgctcgcgcgtccaacccgcggcggcggtgtccgcccactctggcagctagcctgcggctgggtgcgcgcccgcgtggctggcccgacggcggcatctgcccatcgctgatgctcggggggttggaggtgtgcctggactgcgtgctcgcacaactgatgcgcggagggctggatctggcgcccctagggctgggagcagtgccagcgcgtggagggatggatctggcgcgcgcgaggttggcggtctccgtgtgccggccgtcggaggcgctgagaggctggtctcaggccagcgcatgagccggggtgg

SEQ ID NO: 43356 - protein, 63 aa, Zea mays
  misc_feature: Ceres CLONE 1443871-F
MLGGLEVCLDCVLAQLMRGGLDLAPLGLGAVPARGGMDLARARLAVSVCRPSEALRGWSQASA

SEQ ID NO: 43357 - DNA, 642 bp, Zea mays
  misc_feature: Ceres CLONE 1443891-F
  misc_feature: Encodes the peptide sequence at SEQ ID NO. 43358
  misc_feature (293)..(293): n is a, c, t, g, unknown, or other
  misc_feature (295)..(295): n is a, c, t, g, unknown, or other
ctccccgcggtggcggccgctctagaactagtggatcccccgggctgcaggaattcgcacgagaccattacctagaacatcctaatcgaaaactctttctaggtttctacccctcatcggtcctcgctccacggccatggtgaggatgaagcaggtaaagatctcggtaaagaaggacgtggattcgtacacaatccgcggcactaacaaggtcgtccatgtgggcgactgcgtgctgatgcgggcgtcggactcggacaagcagccgtatgtggcgcgggtggaagagatgnangccgacggacgcggcagcgtgcgggtgcaggtgcgctggtactaccgccctgagaatccaaggggcgtcgccggcagttccacggcgccaaggagcttttcctttccgatcattttcgacctacagagcgcccacaccatcgaggggaaatgtgttgtccactctttcaagaactacaccaagcttgataatgtcggggcctaagacttcttctcccgatttgagtacaaggccgcccaccggttcgttcacccctgaccgcgtggcagtgtattgcaaatgtgagatgccctacaacccggattgacctcatggtgcattgcgaacttggcaagggactgaagggg

SEQ ID NO: 43358 - protein, 120 aa, Zea mays
  misc_feature: Ceres CLONE 1443891-F
  misc_feature (25)..(121): Pfam Name: BAH Pfam Description: BAH domain
  misc_feature (53)..(53): Xaa is any aa, unknown, or other
MVRMKQVKISVKKDVDSYTIRGTNKVVHVGDCVLMRASDSDKQPYVARVEEMXADGRGSVRVQVRWYYRPENPRGVAGSSTAPRSFSFPIIFDLQSAHTIEGKCVVHSFKNYTKLDNVGA

SEQ ID NO: 43359 - DNA, 649 bp, Zea mays
  misc_feature: Ceres CLONE 1443900-F
  misc_feature: Encodes the peptide sequence at SEQ ID NO. 43360
  misc_feature (537)..(537): n is a, c, t, g, unknown, or other
  misc_feature (560)..(560): n is a, c, t, g, unknown, or other
  misc_feature (570)..(570): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
ggagctccccgcggtggcggccgctctagaactagtggatcccccgggctgcaggaattcgcacgagaccattacctagaacatcctaatcgaaaaaggaaggctttgctggtagttgtagcacacacggcacaccacacggtttcgtcctcgtccaccatgctatcgtcctcccacctggttaagctgcccctcctgccgcgcggcctcctctcgtacctccccgcatccatcctcccgagcgggcgcgagagcaccgcggacgcagcaccttccacgccgccttcttccaagaagatgtcgtcatccgcacagcagcagcagcagcagcagcaagcgggcagcagcaagggcgagtcggcggagctggcgcgcgtgttcgagctgttcgacaaggacggcgacgggcgcatcacgcgggaggagctgggcgagtcgctgcgcaagctgggcatgggcgtgccgggcgacaagctggcgtccatgaatgcgcgcgtggacgccacggcgacgggtgcgtggacaaagaagaagtcngggagctctaccgcgcattggcnggcccccccngaaaaaaaggggagaaaannnnnnntttcctaaaaaaaaaaaaaaaaaaatttgcgggaaggcttcccccgtttttcaa

SEQ ID NO: 43360 - protein, 147 aa, Zea mays
  misc_feature: Ceres CLONE 1443900-F
  misc_feature (69)..(97): Pfam Name: efhand Pfam Description: EF hand
  misc_feature (134)..(134): Xaa is any aa, unknown, or other
  misc_feature (144)..(144): Xaa is any aa, unknown, or other
  misc_feature (145)..(145): Xaa is any aa, unknown, or other
  misc_feature (146)..(146): Xaa is any aa, unknown, or other
MLSSSHLVKLPLLPRGLLSYLPASILPSGRESTADAAPSTPPSSKKMSSSAQQQQQQQQAGSSKGESAELARVFELFDKDGDGRITREELGESLRKLGMGVPGDKLASMNARVDATATGAWTKKKSGSSTAHWXAPPEKKGRKXXXS

SEQ ID NO: 43361 - DNA, 653 bp, Zea mays
  misc_feature: Ceres CLONE 1443911-F
  misc_feature: Encodes the peptide sequence at SEQ ID NO. 43362
  misc_feature (409)..(409): n is a, c, t, g, unknown, or other
acccgcggtggcggccgctctagaactagtggatcccccgggctgcaggaattcgcacgagaccattacatagaacatcctaatcgaaaactggcaggaccgcctcttcgacaacagcaacggccgcctcgagttcagcggcaacacctggacctccctctggcccggcaccggcaagcctggcctctgggtcacctctagctcccgcatggccgcgctctacaccctcatcgtccgcgaggaggagatacacatcacgcagcgagcgcgagatacacatggccgggacgaggacatggacctggtgatccccccggtgttcaacggctgcacccgattgctcaacgccgaggaccagaaggtggcacgagacctctactgggaggcggtatacggcgaggaggcgtcngactggctcaaggtggagcagctcctccagcagagcattgccaagaacccgtttgtgggggaaccacacctggtgcttgcccaggtgtacgttaacatggagaggtacggcgaggcgcaaaggcaggcagaggagggtctgaggctgttgctggaggggggcagcagctgggacaggaggatgccaggggagggctgggtggcctgggggcagggcgatgctgaccaaagccacccgacaggaa

SEQ ID NO: 43362 - protein, 148 aa, Zea mays
  misc_feature: Ceres CLONE 1443911-F
MAALYTLIVREEEIHITQRARDTHGRDEDMDLVIPPVFNGCTRLLNAEDQKVARDLYWEAVYGEEASDWLKVEQLLQQSIAKNPFVGEPHLVLAQVYVNMERYGEAQRQAEEGLRLLLEGGSSWDRRMPGEGWVAWGQGDADQSHPTG

SEQ ID NO: 43363 - DNA, 768 bp, Zea mays
  misc_feature: Ceres CLONE 1443913-F
  misc_feature: Encodes the peptide sequence at SEQ ID NO. 43364
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
ttattccgttcccctctcccctctcttgcggttcccnnntttacttccccaccnnnannannnnnnnnaagttccnnnnnnagaaccggagctccccgcggtggcggccgctctatactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggaccaggacgacaagcagtgcaagaccgcccacgcgttcggtggggggaccctccttctgcgtccctctttttttcccccccccgccccccggggcgggggcgatactggggttcggccccgtccgggcggggcccaccccccggcgcgggccccctttcggcgggttttcgaaggcgggcgtcggcccctttgttggcccgacggagcaagcatgaagcaggaagccctgtgccccccgcgccttcccccggggagccttggtaaacaaactccgcgggcaagggccctcgccatgttttgctccgccgtcccccccggggatcccaggggttcgtgtctgata

SEQ ID NO: 43364 - protein, 160 aa, Zea mays
  misc_feature: Ceres CLONE 1443913-F
MAAKWWLVASLLLCLAVASAAARATPRDCDTTAAFAAGDGSAGAVDQDDKQCKTAHAFGGGTLLLRPSFFPPPAPRGGGDTGVRPRPGGAHPPARAPFRRVFEGGRRPLCWPDGASMKQEALCPPRLPPGSLGKQTPRARALAMFCSAVPPGDPRGSCLI

SEQ ID NO: 43365 - DNA, 646 bp, Zea mays
  misc_feature: Ceres CLONE 1443914-F
  misc_feature: Encodes the peptide sequence at SEQ ID NO. 43366
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaaatcgatcctgtcctgtccagcaagggagacctggactggaggaggaggacctacttacccggcctccagctctctcgtctcttcctcctcctcctcgaagctccgatccgatcccccaatgtctgacagcagtccagctcccggcgcctactactccggccctcccgccgcgccgccgcccgagtctaagcccgttgacggcggccaggtcaacgccgatgttcctggctactactcctccgcccctgctgcgaaatctggcgccggcggccagcagggcagctccgctgctcccaaggaatcgggcttcttcgccagctgttgtgggtgcttctctggcggcgaaaccgcgagatagatagattcagtgttggaccgagaaccatggatggatggatggaacatgcatgcccagtgattgtttgcgccgatgaaagttcaatttgtccggatttattttctctgaaatagtatatgtttttttttctccatcggtgagccggtgatcttgntcatttgtacaataatcattatatgcaaccaac

SEQ ID NO: 43366 - protein, 79 aa, Zea mays
  misc_feature: Ceres CLONE 1443914-F
MSDSSPAPGAYYSGPPAAPPPESKPVDGGQVNADVPGYYSSAPAAKSGAGGQQGSSAAPKESGFFASCCGCFSGGETAR

SEQ ID NO: 43367 - DNA, 644 bp, Zea mays
  misc_feature: Ceres CLONE 1443915-F
  misc_feature: Encodes the peptide sequence at SEQ ID NO. 43368
  misc_feature (369)..(369): n is a, c, t, g, unknown, or other
  misc_feature (521)..(521): n is a, c, t, g, unknown, or other
ctccccgcggtggcggccgctctagaactagtggatcccccgggctgcaggaattcgcacgagaccattacctagaacatcctaatcgaaaaatcaagaaggttcaacatctcaaaccatacctcatcgcattctttctttaataaatatatatcggaaatttctaaagcttttctatagttttctacagccatggccgctaagaaagctgtgttgcaattgagtgtccacgatgagagaatcagaaagaaagcgtttgtgaccgtctctcgatctcaaggggttacttcgataacaatggaagacaaaacagggaaaatgacagtagttggagaagttgatacaccggttctcgtgatgaagctaaangaactgtgtaatgcagaaatcgtttcggttgaagttgttaaccacctgagaaaaagcctgaaccagcgaaaccggctccagctaaacctgatacggctaaaccagctgaaatttgtgctttttccagtacggatatgaactacccgtaccantattattcgtcctatgcgaattcgcactatcagccatacgggaattctagagttgtggtggaagaaccaaatacttgtgtgcttatgtgattaactagctagattattttaagtatggtagtg

SEQ ID NO: 43368 - protein, 104 aa, Zea mays
  misc_feature: Ceres CLONE 1443915-F
  misc_feature (6)..(73): Pfam Name: HMA Pfam Description: Heavy-metal-associated domain
  misc_feature (59)..(59): Xaa is any aa, unknown, or other
MAAKKAVLQLSVHDERIRKKAFVTVSRSQGVTSITMEDKTGKMTVVGEVDTPVLVMKLXELCNAEIVSVEVVNHLRKSLNQRNRLQLNLIRLNQLKFVLFPVRI

SEQ ID NO: 43369 - DNA, 807 bp, Zea mays
  misc_feature: Ceres CLONE 1443917-F
  misc_feature (709)..(709): n is a, c, t, g, unknown, or other
tctctggagctccccgcggtggcggccgctctataactagtggatcccccgggctgcaggaattcgcacgagaccattacctagaacatcctaatcgaaaacgggttctggctcgccaaaccctagccgccgagtgccgcccaccgcccgcccgccctccgccgcgcgtcggacggtgcccacggaagaggcaccctgcggttggagaactgctggttctgctcctctaccatccaccccgggcctgcaatcccgctcgcccgcaactacgccccggtcttcctctctttctcggcggcgcggcagaaaacttccacatttattacaacccgtcggacggctaattgggcgcgaccctttttttttctcgattggaaagggcgggggggaaggataacacccctatctataaacccccccccctcccctgcactaatagtcacccgcccgtaactgcgggggccaacctagtctcttaaaggccgtccccccggaaccccccccacatatctccccccgtccgcggttcgccctttttttttttttctagccgtaacccctaccgccgccggctagcgcgcgttttttttctttgtccacgaccgggcgacttgccctacggcgttgctatcgcgcggctctcctttcacgcattgcttcagaactacctctctatttgtcctgttttaccccctcataaccttccctnatgatactatgccttcctgtgcccgcctcccggctcgtccaacgacccatttacaaataaacatgtggatttcgcgcccctccacccctattcccttt

SEQ ID NO: 43370 - DNA, 688 bp, Zea mays
  misc_feature: Ceres CLONE 1443918-F
  misc_feature: Encodes the peptide sequence at SEQ ID NO. 43371
  misc_feature (642)..(642): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaaaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgtttgtgagcttgatcagcgagaggatggctcagaaattcaggatgccttactttgaaatagttggccaggcgtactggtcccccaaagtttttggtcaatggaaaagcccctgggggggtcttgaccaacctggtgaatccctcaaaaagggggaaaacttgggctaaaaacttctttaaaaaaacctcggaaaaaaaaaagaaaacaaccacctttttttttgggaagaaaggggtattataatnttcttccccccccccccccccccngtttttttggtttttttttttt

SEQ ID NO: 43371 - protein, 90 aa, Zea mays
  misc_feature: Ceres CLONE 1443918-F
  misc_feature (44)..(91): Pfam Name: Glutaredoxin Pfam Description: Glutaredoxin
MVALLGRRIGVAAAAAAFIALVAFGSASSSPKSFVKSTVSAHDVVIFSKSYCPYCKRAKAVFKELELKKEPYVCELDQREDGSEIQDALL

SEQ ID NO: 43372 - DNA, 650 bp, Zea mays
  misc_feature: Ceres CLONE 1443919-F
  misc_feature: SWISSPROT Homolog: EC 2.7.11.1 Non-specific serine/threonine protein kinase
ctccccgcggtggcggccgctctagaactagtggatcccccgggctgcaggaattcgcacgagaccattacctagaacatcctaatcgaaaaattatagacatgctgcatacctatttggctgaaattttaaccgtgtggatgccattacttaatactgatgcagttcagactagactgaaatatggtatttggcacctgagtatgcatcttctggcaagctaacagaaaaatccgatgtattttccttcggagtcatgcttcttgagcttattactgggcggcgaccagttgacacaacccaaacatatatggatgacagcttggttgactgggcaaggccattactgatgcgagcacttgaggatggtgaatatgattctttagtggatcctcggctgggaaaggacttcaatcctaatgagatggcaagaatgatagcctgtgcagctgcatgtgtacgccattctgcacgtcgtcggccacgtatgagtcaggtcgttcgggctttggagggcaatgtgtctttggaggaccttaatgaaggtgttcggcctggccatagccgcttctttgggcatacagcagctccgattacgattctggccagtacaacgaggacatgaagaagttcaagaagatggcattcaa

SEQ ID NO: 43373 - DNA, 694 bp, Zea mays
  misc_feature: Ceres CLONE 1443933-F
  misc_feature: Encodes the peptide sequence at SEQ ID NO. 43374
  misc_feature (423)..(423): n is a, c, t, g, unknown, or other
ctccccgcggtggcggccgctctagaactagtggatcccccgggctgcaggaattcgcacgagaccattacctagaacatcctaatcgaaaagcattcctactctactccggcactgcacactcacgagctgtggatagctgatactctcccccggcgccaagaaaccacgaaatcgccccccacacacaccttcccttcggtccatcccgatcttaccaagaatccgagatccgcctgcgacagctagcggtcctatcttgatccgatggtgtcaccggcgccgggatgtagggattcgggggaagatggcggcaaggccgattgcctgatctacgcttttgtcgcgcccggaatcgcggtgctggcggagtaacccgaatttcacgggaaatttccccgccatcccccgaaaaggcctggnaggtctacccccccgggtctcccttcgccaaacaccgggcctaaaggcccggggggcccccccggtacgttttcaacttttgttgggagggggaccattttaattttcccctggcccggggttcccccttttgtgtgtttgcaaaaaaaccccccccaaaaaaagctccccggcgttttttggggaggggaaaaggaatttttcaaaaaaaattgtggggcggaaaaaataaaaccccttttctcaaaattctataaaaaagaggcgccgc

SEQ ID NO: 43374 - protein, 35 aa, Zea mays
  misc_feature: Ceres CLONE 1443933-F
MVSPAPGCRDSGEDGGKADCLIYAFVAPGIAVLAE

SEQ ID NO: 43375 - DNA, 765 bp, Zea mays
  misc_feature: Ceres CLONE 1443934-F
  misc_feature: Encodes the peptide sequence at SEQ ID NO. 43376
  misc_feature (62)..(62): n is a, c, t, g, unknown, or other
  misc_feature (76)..(76): n is a, c, t, g, unknown, or other
  misc_feature (77)..(77): n is a, c, t, g, unknown, or other
  misc_feature (81)..(81): n is a, c, t, g, unknown, or other
  misc_feature (637)..(637): n is a, c, t, g, unknown, or other
  misc_feature (690)..(690): n is a, c, t, g, unknown, or other
tggtccccccgcgtgcgcccgtatccgcgcgcgctggatgccctccaaaactactcccccancccatctccacttnntttntttaaactggaactccacgcggtggcggccgctctttcctagtggatcccccgggctgcaggaattcgcacgagaccattacctagaacatcctaatcgaaaagtacaaacaccgtttctatacaggccaaggcgacaagcttcgtccagctctgcatcaaagaaggaaggaagttatggaccgcacctactacaagggcggcatcaaggcgtactggaagcgccggggctactaccgcatcgacgccaccgccgcgcagcgccgcccgccgttccccaccgcggagctcggaggtggcgtgggcgtcgcccaggcccagccgccgcaggcgccgccgccggagggtggctcgggccggcgccgtttgccgcgggtggcgcgtgcgctgcggccagttgcggtggtggttgtttcgggcaccgcctccgccccgggggcatcgtggggctccgcgaacccgacatgtcccccatgctggggcttggcgtccccccccccgccgtcgggtaccggggccggggccgcccctactggcggcacgggagggcctttccnggcgggccgggccgcacctcaggggagtacgaaacaaaaaacggtggcttggnggggagaaatttaacaggggccccataacctccccgggggcgcggtggggtccttggggctccccaactctgtcc

SEQ ID NO: 43376 - protein, 148 aa, Zea mays
  misc_feature: Ceres CLONE 1443934-F
  misc_feature (127)..(127): Xaa is any aa, unknown, or other
  misc_feature (145)..(145): Xaa is any aa, unknown, or other
MDRTYYKGGIKAYWKRRGYYRIDATAAQRRPPFPTAELGGGVGVAQAQPPQAPPPEGGSGRRRLPRVARALRPVAVVVVSGTASAPGASWGSANPTCPPCWGLASPPPPSGTGAGAAPTGGTGGPFXAGRAAPQGSTKQKTVAWXGEI

SEQ ID NO: 43377 - DNA, 600 bp, Zea mays
  misc_feature: Ceres CLONE 1443935-F
  misc_feature: Encodes the peptide sequence at SEQ ID NO. 43378
  misc_feature (300)..(300): n is a, c, t, g, unknown, or other
ccccgcggtggcggccgctctagaactagtggatcccccgggctgcaggaattcgcacgagaccattacctagaacatcctaatcgaaaagccagagcggtcaccgaatctgaggtctgagcccagcgggccgcggcggctatgtcctcatcctcctccttccccaactcccgcttccccttcgcagccggcgccggggcctccggcggaagcgggagcagcgtgcggccgtggggttcgagcggcgggacatcggtgtcttcatctgggaaacggatacagaaggagctgctggacctncacgcctccgactgctccgcggggcccaagggcgacaacctctaccactggctctccactatcatcgggcccccaggatcgcccgtatgaaggaggatatttttcctggacatagtgtttcctcctgatatcccctcaaacctcccatggtacattcaaaacgaggattaccactgcaatattgattcactggtaaagtgcattttggacattctgagggatggctggagtcccactttccctaatttcaaaggtgtaattgggccctcaagaactcttcaggaattcagaatccctacc

SEQ ID NO: 43378 - protein, 82 aa, Zea mays
  misc_feature: Ceres CLONE 1443935-F
  misc_feature: SWISSPROT Homolog: EC 6.3.2.19 Ubiquitin--protein ligase
MSSSSSFPNSRFPFAAGAGASGGSGSSVRPWGSSGGTSVSSSGKRIQKELLDLHASDCSAGPKGDNLYHWLSTIIGPPGSPV

SEQ ID NO: 43379 - DNA, 655 bp, Zea mays
  misc_feature: Ceres CLONE 1443942-F
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (539)..(539): n is a, c, t, g, unknown, or other
  misc_feature (541)..(541): n is a, c, t, g, unknown, or other
  misc_feature (542)..(542): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (575)..(575): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (607)..(607): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (626)..(626): n is a, c, t, g, unknown, or other
  misc_feature (640)..(640): n is a, c, t, g, unknown, or other
aagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgagggcaagcagcaggtctggccgggcggcggcgnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnncnnnnnnnnnnggggggnnnnnnnnnnnnnnnnnnnnnnnnntntnnnnnnnnnnnnnnnnnnnnnnnnnnacnnnnnnnntnnnnntnnnnnnnnnnnnnnnnnnnnnnnntnntnnnnnnnnnnnttnnntnnnnnnnnnnnnttttnnnnnnnnnnnnntntnntttttttttnnnnnnnnnnnnntnnnnnnntnntnnnntttnnnnnnnttttttttttttttttnccnnnccttctcctttttnttccccctttttcncttccttctttccca

SEQ ID NO: 43380 - DNA, 617 bp, Zea mays
  misc_feature: Ceres CLONE 1443945-F
  misc_feature: Encodes the peptide sequence at SEQ ID NO. 43381
gctctataactagtggatcccccgggctgcaggaattcgcacgagaccattacctagaacatcctaatcgaaaagattcagcgatttccgatctttccgtcctcggtcttcttgatttttccttcctacctccacctgctagcgccgtccgccgttcctcaggaaaatcctctcacctgagtatggagcagcaccccacttgcgcccagccaccggcgccggcgcccctggctgggcccgtcgtcccggtggacttcaaggtcgtcaagaagggacccgagatggcgatgcacgacgcgatcggccgcctcgccttccgcgtcgcgggcagcgccggaggggccacagcgctccaggatgacgctggaggtgtcctggtcaccgcccccccccccggccagggtgagtggcaagcattcagtgggaatagtttggaggagagacacatcattttcactgcaaaagctatacctgcttcttcaagtcgagaggaggtacatgtgttcatctcaccaagaagcactgttgaagattcaaaacccagctacggactcgtaggaagtgcattccaaagagcgtgcacagttataaagggggactccttcgttgctcagaaa

SEQ ID NO: 43381 - protein, 145 aa, Zea mays
  misc_feature: Ceres CLONE 1443945-F
MEQHPTCAQPPAPAPLAGPVVPVDFKVVKKGPEMAMHDAIGRLAFRVAGSAGGATALQDDAGGVLVTAPPPGQGEWQAFSGNSLEERHIIFTAKAIPASSSREEVHVFISPRSTVEDSKPSYGLVGSAFQRACTVIKGDSFVAQK

SEQ ID NO: 43382 - DNA, 609 bp, Zea mays
  misc_feature: Ceres CLONE 1443946-F
  misc_feature: Encodes the peptide sequence at SEQ ID NO. 43383
cgcggtggcggccgctctagaactagtggatcccccgggctgcaggaattcgcacgagaccattacctagaacatcctaatcgaaaatttcctttggctgctacgcctcgccacaggcatcctcgatggtcgccaaccttgtggagggcgtgtcgtaccccttcgtctactcgctcgccgacatgggtaccctccccgaccacccccacaagaacatcgctcgcctcctcaaggctaagcgcttccgcaagcccgacatctctgagaccatccaggagctgctcggcggcgaggtggggagggggcaactatccggtgggttggtggtggacgtgggagccaatgttggcatggcatcattcgtggtcgccgtgatggggtttcgggtgctggcattcgagcccgtgttcgagaatctgcagcggatatgcgacggggtgtacctcaaccgggtgcaggaccgcattgtggtgtatcacgctgcgtcgctgcagcttctgatcgagttgggactattacgatgcacaaggtgattggtcgactggacaacagtgctatatctgcagatggtacaaagttagcattcaagtctaatgcagaaattgctgt

SEQ ID NO: 43383 - protein, 135 aa, Zea mays
  misc_feature: Ceres CLONE 1443946-F
MVANLVEGVSYPFVYSLADMGTLPDHPHKNIARLLKAKRFRKPDISETIQELLGGEVGRGQLSGGLVVDVGANVGMASFVVAVMGFRVLAFEPVFENLQRICDGVYLNRVQDRIVVYHAASLQLLIELGLLRCTR

SEQ ID NO: 43384 - DNA, 653 bp, Zea mays
  misc_feature: Ceres CLONE 1443949-F
  misc_feature: Encodes the peptide sequence at SEQ ID NO. 43385
ctccccgcggtggcggccgctctagaactagtggatcccccgggctgcaggaattcgcacgagaccattacctagaacatcctaatcgaaaagagcccccaaaaccctagccctaaatttgggggcgcttgggacaaagagacgtgggggaggaatcgacccggtggcttgcggcggcatcagcgatggcggcgaagcgggagatctcgagcaccctcaggaacctcaagtttatgcagcgcggcgcggctgcgcagaaggccgaggagaaggccgaggtggaggtacaggaggaggtggtgacggcgccgagtggaggcttctcctcgtccgcgcaggtcgttaggaagtgcatagttatcatggagggtaatcctcatccaggagctataaagggtcggatgtctttccaaaatttcaatccatctatcgataaactaaatgaagaggcaagaggtgaccaccaaacagaatcagcttccctcagtaactgtgaccaagacaatgcacactccagcagaggggatgaagttccagcattaagatgtagagattttggcattcccagttcagaaagcatatctctaaatgaactgaagaggaaggagcccgaccttgatatcgaaacaccggcgtcttacaagaaccaaaac

SEQ ID NO: 43385 - protein, 156 aa, Zea mays
  misc_feature: Ceres CLONE 1443949-F
MAAKREISSTLRNLKFMQRGAAAQKAEEKAEVEVQEEVVTAPSGGFSSSAQVVRKCIVIMEGNPHPGAIKGRMSFQNFNPSIDKLNEEARGDHQTESASLSNCDQDNAHSSRGDEVPALRCRDFGIPSSESISLNELKRKEPDLDIETPASYKNQN

SEQ ID NO: 43386 - DNA, 681 bp, Zea mays
  misc_feature: Ceres CLONE 1443959-F
  misc_feature: Translation starting site: 140
  misc_feature: SWISSPROT Homolog: EC 1.1.1.200 Aldose-6-phosphate reductase (NADPH)
  misc_feature: SWISSPROT Homolog: EC 1.1.1.2 Alcohol dehydrogenase (NADP(+))
  misc_feature (640)..(640): n is a, c, t, g, unknown, or other
ggagctccccgcggtggcggccgctctagaactagtggatcccccgggctgcaggaattcgcacgagaccatacctagaacatcctaatcgaaaactagcatccgcgcgcggggtctgagagcagagcggcagggcgccatggcggcatcggtggcgctgagcagcgggcaccggatgccggcggtggggctgggcgtgtggcggatggagaaggcggacatccgcggcctcatccacacagcgctccgcgtcggctaccgccacctggacttgcgccgctgactaccagaccgaagctgaagttggtgacgcgctcgcagaggcattccaaaccggattcgtcaagcggaaggacctgttcttcacaaccaacctgtggagctggggacatgggcatgtgcttgaatcctgcaagcacagcccgaaaaacctgcggctagactaatgcgacccctacctcatcaatttcccagtggccactcggccacccgggaacccggaacgacttcctaccccttctgggagacaaagggggagctggcccttttaaacccccttttctcccccggatcccactttgccaccccgatggcaaaactttcttccccttggggttgggtgcccctcctttggcttccnggtatctccagaatttttcccctcccaaaaaaattcgcttg

SEQ ID NO: 43387 - DNA, 613 bp, Zea mays
  misc_feature: Ceres CLONE 1443967-F
  misc_feature: Encodes the peptide sequence at SEQ ID NO. 43388
  misc_feature (355)..(355): n is a, c, t, g, unknown, or other
tggagctccccgcggtggcggccgctctatactagtggatcccccgggctgcaggaattcgcacgagaccattacctagaacatcctaatcgaaaagagaagcaggtccaggaccaggagaaaggaaaaggaagcccagctctctctagcctggagccgagaagccgagggagcgagggagcagcaagtcatggaggagcccgttccggctgatccccccaggattttctggaaagtcaggagatcagccaatggccggagccctgcacaagagcctgacaaagacgctacccgagaaaactaacgagcaggctcaagagggaccccatgaagaccgacgacgccacggattccngcaccacagctacagtttgaccgtacccgaaagctaaccctttcgaaaaaccgaaaggttctcttcaagcccccccaagccaaataaagggaaaacccgggcctttccaaaaaacttcctccccccccccggaaattttggaccccctcccaaccccccaggggggggcgggggggggacaaaaaaacccaaccctccctccacaaaaaaaacctccgggaaaaaacttggcgggaaaatctcccccccccccaaaaa

SEQ ID NO: 43388 - protein, 37 aa, Zea mays
  misc_feature: Ceres CLONE 1443967-F
MEEPVPADPPRIFWKVRRSANGRSPAQEPDKDATREN

SEQ ID NO: 43389 - DNA, 644 bp, Zea mays
  misc_feature: Ceres CLONE 1443974-F
  misc_feature: Encodes the peptide sequence at SEQ ID NO. 43390
  misc_feature (504)..(504): n is a, c, t, g, unknown, or other
  misc_feature (562)..(562): n is a, c, t, g, unknown, or other
  misc_feature (573)..(573): n is a, c, t, g, unknown, or other
cggccgctctagaactagtggatcccccgggctgcaggaattcgcacgagaccattacctagaacatcctaatcgaaaaacgaaaaaagcgaaccgagggagaggaaggatcggcgcgttccggccggagatgaggggcggatccagaccggccccggtcgtcctgtttctcctcgctgcgtccgggatctgcgcccagttcaccgcagtgctagctggtgatccccaaacatccaacgatgataagaaggctgaagctcagccaaagggccataccggcaaaacagttttgttcgtcctcctaggagtgggggctgtcattctgttgtcatttgttattttcaagtattggcagaagaagaaaaggcaggaacagcatgcacgtctgctaaagctatttgaagaggatgacgacattgaggttgagcttggtcttcgagattgataatcttcaattgtacagcaagagtatcttggctgacaaggttttgctggcttgccttncaagcattttcatgttaatgtaaagaattttgtgtatttaaaacttgaaggctccacnagaaaggtctngtgtacttttagcttatatatatgatgaacatctctgtgtgcaggatgcttgataatagctttaaggagaa

SEQ ID NO: 43390 - protein, 104 aa, Zea mays; identical to SEQ ID NO: 39719
  misc_feature: Ceres CLONE 1443974-F

SEQ ID NO: 43391 - DNA, 546 bp, Zea mays
  misc_feature: Ceres CLONE 1443983-F
  misc_feature: Encodes the peptide sequence at SEQ ID NO. 43392
  misc_feature (333)..(333): n is a, c, t, g, unknown, or other
  misc_feature (420)..(420): n is a, c, t, g, unknown, or other
  misc_feature (454)..(454): n is a, c, t, g, unknown, or other
  misc_feature (455)..(455): n is a, c, t, g, unknown, or other
tggagctccccgcggtggcggccgctctagaactagtggatcccccgggctgcaggaattcgcacgagaccattacctaaaacatcctaatcgaaaaatcgcgctcaggctcgtgccgctcgtggtcgtacgctgcagcaggcgatcggagcaaactaagaagcgaacaggccgcccgtcgacgccatggcgccggatctggtgaacggcgtgctcaactgggtggggacgccggccatggtggccagcctgctgctcttctacccgccctactatctcttcaagacatgctactccttcctttcctggctcttccccgaggacctcgccggncaggtcgtcctcatcactggcgcttcctccggcatcggcgagcaactggccctacagtacgcgctgaatcgggcgtcccctcgcccntcgtcgcgagaaagggagttcgaagccttccggnnaggttttcccaaaaaaaaaaactatagtttggggggggggaaaatttctttttccccgggaaatcccccccccccccgagaaggggggggg

SEQ ID NO: 43392 - protein, 120 aa, Zea mays
  misc_feature: Ceres CLONE 1443983-F
  misc_feature (90)..(90): Xaa is any aa, unknown, or other
MAPDLVNGVLNWVGTPAMVASLLLFYPPYYLFKTCYSFLSWLFPEDLAGQVVLITGASSGIGEQLALQYALNRASPRPSSREREFEAFRXGFPKKKNYSLGGGKISFSPGNPPPPREGGG

SEQ ID NO: 43393 - DNA, 619 bp, Zea mays
  misc_feature: Ceres CLONE 1443996-F
  misc_feature: Encodes the peptide sequence at SEQ ID NO. 43394
  misc_feature (559)..(559): n is a, c, t, g, unknown, or other
  misc_feature (577)..(577): n is a, c, t, g, unknown, or other
ggtggcggccgctctagaactagtggatcccccgggctgcaggaattcgcacgagaccattacctagaacatcctaatcgaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctacggtggtggtgaagatatggtgntgggtggcgtgctatgtnggtgtgaggcatatttgggggggggggggcccgccgccgttg

SEQ ID NO: 43394 - protein, 151 aa, Zea mays
  misc_feature: Ceres CLONE 1443996-F
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (132)..(132): Xaa is any aa, unknown, or other
  misc_feature (138)..(138): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGGGYGGGEDMVXGGVLCXCEAYLGGGGPAAV

SEQ ID NO: 43395 - DNA, 660 bp, Zea mays
  misc_feature: Ceres CLONE 1444002-F
  misc_feature: Encodes the peptide sequence at SEQ ID NO. 43396
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (80)..(80): n is a, c, t, g, unknown, or other
  misc_feature (270)..(270): n is a, c, t, g, unknown, or other
  misc_feature (284)..(284): n is a, c, t, g, unknown, or other
  misc_feature (328)..(328): n is a, c, t, g, unknown, or other
  misc_feature (329)..(329): n is a, c, t, g, unknown, or other
  misc_feature (375)..(375): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (462)..(462): n is a, c, t, g, unknown, or other
  misc_feature (478)..(478): n is a, c, t, g, unknown, or other
  misc_feature (483)..(483): n is a, c, t, g, unknown, or other
  misc_feature (546)..(546): n is a, c, t, g, unknown, or other
nnnggattnnnnngaacatacgactccccgcggtggcggccgctctaaaactagtggatcccccgggctgcaggaattcncacgagaccattaactagaacatcctaatcgaaaaaagagatcgaggctcctatctggtataggacggagctgaacttctagcaacgtacagtgtatccgccatgagtcctttcggggcggtgatcacgccagaaaccctcaagtacatgtccaagtaccagggacgtgagatcacgcaggtggactgcncacgggaggcaatnaagctgatccccccggaatactacccccgcggggggaggactcnncgtgggattttattattaagttcggcaacggcgtgagcaccagggnttttttctcttcctaaccggggacaagaaaggggannnnnnnnnnnnnnnnnnnnntcccccttcaaaaaaaaaaaaaaaaaccccnaccccccccgccgccntcccntcatccccttcccctccccccaccccaccttcaataattaactcccttctccccccccactcntccccccaccatccccatcatatctcaccccttccctttctcccccccccctacaaatacattcccccactttattttttctccccccccctcttcacatcccccccccctccg

SEQ ID NO: 43396 - protein, 60 aa, Zea mays
  misc_feature: Ceres CLONE 1444002-F
  misc_feature (30)..(30): Xaa is any aa, unknown, or other
  misc_feature (34)..(34): Xaa is any aa, unknown, or other
  misc_feature (49)..(49): Xaa is any aa, unknown, or other
MSPFGAVITPETLKYMSKYQGREITQVDCXREAXKLIPPEYYPRGGRTXRGILLLSSATA

SEQ ID NO: 43397 - DNA, 753 bp, Zea mays
  misc_feature: Ceres CLONE 1444016-F
  misc_feature: Encodes the peptide sequence at SEQ ID NO. 43398
  misc_feature (753)..(753): n is a, c, t, g, unknown, or other
aaagctggagctccccgcggtggcggccgctctagaactagtggatcccccgggctgcaggaattcgcacgagaccattacctagaacatcctaatcgaaaagtaggtcggtaggtatacgtgcacgtctcaccaacgcaacacaccgttgcctgtgaagcagcgcagcgcggagcggaagggtccagcgaccgcgactgatggggaggagcggcggcgagacggcggggaagaggcagcagttcgggagcatggaggagttctggggcttctacctgagccagcactccaagccgggcacgcggcggtggcacttcctcggcacgctggcctcgctcgcctgcgcggtgctcgcggccgccactggccgcgccgcggtcctcctcgcgggccccgttctcgggtacggcatggcgtggtacagccacttcttcgtggagggcaaccgccccgccacgttcggccaccccgtgtggtccttcctctgcgacctccgcatgttcctgctcatcctcaccggccgtatcgacgccgagctcgcacgcctccgcgtccggccgacggccgagtccaccgacgccgcggcggcctctgcgcaccatgactgatccgtatcctccatgctcgtctgtcttgcctatccggctacccgtagcgcgtttgaagtgaaggcctaaatcaatcgattaccagcaggcagttcgtagctgtttcttggtatatctgtatcaacaacattttcacttgtatctn

SEQ ID NO: 43398 - protein, 135 aa, Zea mays
  misc_feature: Ceres CLONE 1444016-F
MGRSGGETAGKRQQFGSMEEFWGFYLSQHSKPGTRRWHFLGTLASLACAVLAAATGRAAVLLAGPVLGYGMAWYSHFFVEGNRPATFGHPVWSFLCDLRMFLLILTGRIDAELARLRVRPTAESTDAAAASAHHD

SEQ ID NO: 43399 - DNA, 702 bp, Zea mays
  misc_feature: Ceres CLONE 1444017-F
  misc_feature: Encodes the peptide sequence at SEQ ID NO. 43400
  misc_feature (589)..(589): n is a, c, t, g, unknown, or other
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaaataaccacgagccaagcgcgacggatcccaatccatcttctcctcatccccaccacgaccaaaaaaaatccggtcgccgatgccgtctgctgcctgacatcggtcagccagggtagatcgcgcaggcaggcagccccacacacataccaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatccccgacgccgacctcgcgcgcctccacccgtgggacctcctccccgccgccgcaccagggggatccggagccgacgccgacggggagcgcttcttcttccccgcccggcgacgcagtgctgcgcaagggcggcggcgcggccagggcggccggcaccggcgtctggaggccgtccngcaggagaccctcgtcctgtccccgcgctgncagcgccccgtcggcaccaagcgacgctcgtattctgccccccgccgcggcgcgcccgcaccactgggccatgcacgagtac

SEQ ID NO: 43400 - protein, 141 aa, Zea mays
  misc_feature: Ceres CLONE 1444017-F
  misc_feature (13)..(128): Pfam Name: NAM Pfam Description: No apical meristem (NAM) protein
  misc_feature (104)..(104): Xaa is any aa, unknown, or other
  misc_feature (114)..(114): Xaa is any aa, unknown, or other
MEGRRPGAPVAGLPIGFRFRPTDEELLLHYLRRKALACPLPAGVIPDADLARLHPWDLLPAAAPGGSGADADGERFFFPARRRSAAQGRRRGQGGRHRRLEAVXQETLVLSPRXQRPVGTKRRSYSAPRRGAPAPLGHARV

SEQ ID NO: 43401 - DNA, 760 bp, Zea mays
  misc_feature: Ceres CLONE 1444020-F
  misc_feature: Encodes the peptide sequence at SEQ ID NO. 43402
tggagctccccgcggtggcggccgctctagaactagtggatcccccgggctgcaggaattcgcacgagaccattacctagaacatcctaatcgaaaaccattccaaaactccgagcaatcagtccaaacccgtgtccaccgaaagtttgatgggatcaggcctctcaagcagcagcagccaccggagcagcggcgcgtcgtcgtcgcttcaccagccaccggcggcggccccggccctggtcgtcgcggtcgacggctcgctacgggagttcgtcacgccggcggcggtgccgctcctcccccccgtctccgtctccgacgtgctgggcgcgaatgcggacgacggccggtccttcgtgtgcagctccagcgcgctctacttcgagaccgacgtcccggcgctcggcgccagcgagctgctccggccggggcagctctacttcgtcctccccgcggcgatgctcggcaggccgctctcgggcgccgacatggccgcgctggccgtgcgcgccagccaggcgctggcggcgggagcgaggccgccgcgtggcgggcgacgccctcgcgggtccaccaaggcgcgcgtcgtgccggccgcggcggcgcaccacgcgcacgcgcacggcgacgaggaagctgtcaaccagaagctcaaccagaagactcttggcggcttccagacggctcctccacgtggcccggcctggaacccccctggtccggcgcgaccggccccccctgtgaatgtgactgtgactga

SEQ ID NO: 43402 - protein, 203 aa, Zea mays
  misc_feature: Ceres CLONE 1444020-F
MGSGLSSSSSHRSSGASSSLHQPPAAAPALVVAVDGSLREFVTPAAVPLLPPVSVSDVLGANADDGRSFVCSSSALYFETDVPALGASELLRPGQLYFVLPAAMLGRPLSGADMAALAVRASQALAAGARPPRGGRRPRGSTKARVVPAAAAHHAHAHGDEEAVNQKLNQKTLGGFQTAPPRGPAWNPPGPARPAPPVNVTVT

SEQ ID NO: 43403 - DNA, 763 bp, Zea mays
  misc_feature: Ceres CLONE 1444022-F
  misc_feature: Translation starting site: 256
  misc_feature: SWISSPROT Homolog: EC 2.7.4.3 Adenylate kinase
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (525)..(525): n is a, c, t, g, unknown, or other
  misc_feature (534)..(534): n is a, c, t, g, unknown, or other
  misc_feature (672)..(672): n is a, c, t, g, unknown, or other
  misc_feature (725)..(725): n is a, c, t, g, unknown, or other
ggagctccccgcggtggcggccgctctagaactagtggatcccccgggctgcaggaattcgcacgagaccattacctagaacatcctaatcgaaaagacccagccgatcgagaatacccggaaggccggaacccacctgctgcgcacctgcaagcctcgagtggagctcttccacggccccggtggagatggcggcgaatctggaggaagtgccgtcactggatctgatgcacgatctgctccgaccgctccgaaatgaagctcccaacccgacaagcgcctccacctcattctgggccactggctgctctgaagggaactcagtctcctattatcaagggatgactatttgcttgtggcacatctagccactggtgatatgcttgaaggctgctgtggcggccaagacaccctctaggtatcaaagcttaagaagctatgataaggggagagcttgttcagatggatttggtttgttgggcattatttgattaagctatgaagaaacctccnnntggcccaaanggttcattnctgatgcttttcctagactgtcactcagccagagctttgatgagatgtggcaaagcaggtgcccatgttgacaaagtcctgacttttgcattgatgatgctgtattgaaagacggattactgggtcgtggatcccctncagccagtggtaggactacccactccaaatttgcacttccaaggtctccaggnagttgatgatgtaacctgggagagccattgatcccaag

SEQ ID NO: 43404 - DNA, 763 bp, Zea mays
  misc_feature: Ceres CLONE 1444023-F
  misc_feature: Encodes the peptide sequence at SEQ ID NO. 43405
acaagctggagctccccgcggtggcggccgctctagaactagtggatcccccgggctgcaggaattcgcacgagaccattacctagaacatcctaatcgaaaagaaacccgtctcgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaggacccccccacatcatgcagtgcaggtcctgctggtgaggacatgtttcattggcaagcaacaattatgggaccacctgacagtccctatgctggtggtgtttttttagtggacattcatttcccccgcagatacccctcaaaccctcaaagtttcttttcagacaaggtcttccatcctaatatcaccgcaatggaagtttttgccttgacatcctcaaagacaagggaagcttgcgttgacattttcaagggcccgggttccacttggccccggggaacgagcccacccgggggagcccttttggccgggaatttccccttgtaaaaaagggccgccgaaaaaatatacaccgccccccgtgggccaaaaaaccgaggggttgaaaaatttttttttttccccccacggggggaaaaaaaaaattccggggccgccccccccaataattggggggggggggggccccccac

SEQ ID NO: 43405 - protein, 123 aa, Zea mays
  misc_feature: Ceres CLONE 1444023-F
  misc_feature (5)..(123): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVDIHFPRRYPSNPQSFFSDKVFHPNITAMEVFALTSSKTREACVDIFKGPGSTWPRGTSPPGGALLAGNFPL

SEQ ID NO: 43406 - DNA, 816 bp, Zea mays
  misc_feature: Ceres CLONE 1444031-F
  misc_feature: Encodes the peptide sequence at SEQ ID NO. 43407
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (369)..(369): n is a, c, t, g, unknown, or other
  misc_feature (376)..(376): n is a, c, t, g, unknown, or other
  misc_feature (386)..(386): n is a, c, t, g, unknown, or other
  misc_feature (428)..(428): n is a, c, t, g, unknown, or other
  misc_feature (766)..(766): n is a, c, t, g, unknown, or other
aagctggagctccccgcggtggcggccgctctagaactagtggatcccccgggctgcaggaattcgcacgagaccattacctagaacatcctaatcgaaaaatgcagttcacacactctcctctgacctctcctctcctctcctctcgacctctcccttctatctagccaccgaagccaagaccaaggaacggcatggctcagctgctgcacctgccggacctcgcggcggcgcggccgccggcgcggaggaggaggggtgtggcggtggcggtggcgggggggcgcgtcaagcagggggaggcggggcgggtgatcagggtcgccgaccccgtgcgggagggccggggatgcgctcnnntctcttgcngcgcggncacgccgtcngagtctccgccgggtcgcgggagccccgggaccaagaccacnaggtaaggcaagggcctccctcaactgggggtaccccatccggaaccctccgggagagacttccccaaaggtcttccaagggggccccccttttaacttcaaaaagaaaaatttggttctcccaaaccctttgaaaaaattcgagggccggtgaaaaataaaaaaaaaaatttggggggccttttttttagggggggatatttccttcgaagggttggggggggaaataaaaaaaaaaagggccgccccgggaaaaattattttttatttgttttgggtcccccgggttctctcaaaaataggggggggggggcgcccccccgggggggttttttttnccccccccggggggggggttttcctcaaagggcgcccctttttgtttttt

SEQ ID NO: 43407 - protein, 79 aa, Zea mays
  misc_feature: Ceres CLONE 1444031-F
  misc_feature (55)..(55): Xaa is any aa, unknown, or other
  misc_feature (56)..(56): Xaa is any aa, unknown, or other
  misc_feature (59)..(59): Xaa is any aa, unknown, or other
  misc_feature (61)..(61): Xaa is any aa, unknown, or other
MAQLLHLPDLAAARPPARRRRGVAVAVAGGRVKQGEAGRVIRVADPVREGRGCAXXSCXAXTPSESPPGRGSPGTKTTR

SEQ ID NO: 43408 - DNA, 809 bp, Zea mays
  misc_feature: Ceres CLONE 1444040-F
  misc_feature: Encodes the peptide sequence at SEQ ID NO. 43409
  misc_feature (393)..(393): n is a, c, t, g, unknown, or other
aaagctggagctccaccgcggtggcggccgctctagaactagtggatcccccgggctgcaggaattcgcacgagaccattacctagaacatcctaatcgaaaacagtgtgtccgctccccctcagtcctagcggtagcgtgcgcgcgggagacgtagatggcggcttcggcggcggcggcggcggcggcggcgacaccggtggcgccgacagaggggacggtgatcgcgatccacagcctggaggagtggagcatccagatcgaggaggccaacagcgccaagaagctggtggtgattgacttcactgcaacatggtgtcctccgtgcccgcgcatggctccaatttttgctgatatggccagaagtcccaaaatgttgttttcctgaaagtngatgtccatgaaatgaaaaccaatgctggacaattcaggcgtaagggccatgccaaattttccgtttcagagggggaggggcactccaaggacagggttttttggccccccaaaagaaagccctccagggaactttgaccccaccgggcgcccccaaaaacgtggggccccaaaggtaatttcctcccaaaaagaggggccccccccccccccccgaaaaaaaaaggggctcggggggggggtttctagaaaagggccccccccggggggggcccccccccggaggaaaaaaacacccccccctataagggccgcccgcgggtttttctaaaaaaaaaaaaaaaaataattttttttccccccccccggggggggggggcgccccccctcccctcgtgggtgggggtggggccggc

SEQ ID NO: 43409 - protein, 76 aa, Zea mays
  misc_feature: Ceres CLONE 1444040-F
  misc_feature (45)..(75): SWISSPROT Homolog: EC 1.8.1.8 Protein-disulfide reductase
  misc_feature (22)..(64): SWISSPROT Homolog: EC 3.5.1.52 Peptide-N(4)-(N-acetyl-beta-glucosaminyl)asparagine amidase
MAASAAAAAAAATPVAPTEGTVIAIHSLEEWSIQIEEANSAKKLVVIDFTATWCPPCPRMAPIFADMARSPKMLFS

SEQ ID NO: 43410 - DNA, 755 bp, Zea mays
  misc_feature: Ceres CLONE 1444046-F
  misc_feature: Encodes the peptide sequence at SEQ ID NO. 43411
  misc_feature (468)..(468): n is a, c, t, g, unknown, or other
  misc_feature (613)..(613): n is a, c, t, g, unknown, or other
  misc_feature (735)..(735): n is a, c, t, g, unknown, or other
gcgctggagctccccgcggtggcggccgctctagaactagtggatcccccgggctgcaggaattcgcacgagaccattacctagaacatcctaatcgaaaaacggagaagagaacaagagatagtacttgacactcctgtcctgctcctccactcccacgctcccagccgagctcgagcgcacgcacacgcgcacaagcaggagctcctgtcccgctagatcccaaacagtctcctgcccgcgcgcgtttgggggggggcgcgaaggaatcaccggatggcgatgttcgcgcggccgctgctggccaccctgctgctgctgccggcgttcctgctctctgccgcctcggccgccgacagcaagagcaaccctgctgatgggggcgtggcactgatcaacagcaaccgcactccccccaaggcatcttctgtttcggacaaccaaggtttgggatgcatcgctctgcantacaccaaaccatacgaaggccattgtgaccaggtggacgacaagaagccgatggagtcaaccttccccgacacgtttcgccccgacctgtggggccaaggccacaaccctctccaagaacaccgaaaggctggtggcttgccantccacgtacttggctccagctaagcctttggcgccttgttggggaacaacccaaaggcccccaaaaacggccaacaaaaaccccccgaagtcggggcggctgttaacgccacccatggcggngaccccacctcctgggcgcc

SEQ ID NO: 43411 - protein, 119 aa, Zea mays
  misc_feature: Ceres CLONE 1444046-F
  misc_feature (64)..(64): Xaa is any aa, unknown, or other
  misc_feature (113)..(113): Xaa is any aa, unknown, or other
MAMFARPLLATLLLLPAFLLSAASAADSKSNPADGGVALINSNRTPPKASSVSDNQGLGCIALXYTKPYEGHCDQVDDKKPMESTFPDTFRPDLWGQGHNPLQEHRKAGGLPXHVLGSS

SEQ ID NO: 43412 - DNA, 733 bp, Zea mays
  misc_feature: Ceres CLONE 1444051-F
ggagctccccgcggtggcggccgctctagaactagtggatcccccgggctgcaggaattcgcacgagaccatacctagaacatcctaatcgaatcgttcagctcctggtggtgctacgggggtgactgcgggggcgactgcggctggtggctgttgtcctcatcgaccatctcggcgacgtcctactcgagcgagatctcgctgcagtccctcgagatctggaggagattgacaaggagattgaggacaagaagacagagctggagcccaaggtcgtggaggcctacgaagcatctcctcctgaggtcaaggctctgttcaaggataagaagccagtcaaggtcatcaagaagaactcggctgcagtcaccaagttcctcgatgagctggctaagattggccgcacttgaagaaatcttatatcagtttgaggaaaaactccaagctgaaaaagtggaagctgctaggaagcaggaagagttgcaatctgtttgatgccttttctagaacatatctgtggttagaactttgtcagaactacgtgcaatctgtttcaatgcttcaaacctttgtggtggaacctttgtatgtttgaacctctgttgtggaagaactagtgtgctggaattgtgtatgacttgtgatgagaatgttgtgtatgatggcttttctgtgtattatgattctgtgagctatcatgagagctcagtgtgtcgccaaaaaaaaaaaaaaa

SEQ ID NO: 43413 - DNA, 781 bp, Zea mays
  misc_feature: Ceres CLONE 1444052-F
  misc_feature (317)..(317): n is a, c, t, g, unknown, or other
  misc_feature (391)..(391): n is a, c, t, g, unknown, or other
  misc_feature (516)..(516): n is a, c, t, g, unknown, or other
  misc_feature (519)..(519): n is a, c, t, g, unknown, or other
aagctggagctccccgcggtggcggccgctctagaactagtggatcccccgggctgcaggaattcgcacgagaccattacctagaacatcctaatcgaaaatatagaaagacaggcgggtactagagaggttgtgtggtgtccaagctacacacgggatgctactaactagctgcaggcaagggcgaagaatggcaagcctttcatggtgctcgggcggacggtgttgtccgttccggcgctctgcccgccaagctgttgctgtgcgccagctgctgcttccctacggcggctccagtcgcggacggagaagtgcangtgcttgcctgccgccagcatctccaccgctttgcgaagcgtcaggatctccgtcgccagcgcccgcgccgtcngcatcctcagctcgtcggcctccaccacagccgcgacagcgcggccttgtagttgtccagggcgcgttcaacctgggggcccggggttcataccgggccccccttgaaccgcccccgcccgcccnttnaaatttccctgtggaaaatttaatctccaaaccgtgcccggaaaaaaattcccctttccccaaatgggaaaaaaacggggccccaaatttccctcccggggggggaacccgcccccaaaaggggttccccttgggcccccccccgtttggggtggtttaaaaaacccccttggtgagtttttccccgcgccccgcgggaaagaaaccttttaaaaacaaaaaaaaccccctctttggttgcccccccccaaaaaaaagaaaa

SEQ ID NO: 43414 - DNA, 746 bp, Zea mays
  misc_feature: Ceres CLONE 1444058-F
  misc_feature: Encodes the peptide sequence at SEQ ID NO. 43415
  misc_feature (432)..(432): n is a, c, t, g, unknown, or other
  misc_feature (746)..(746): n is a, c, t, g, unknown, or other
ctggagctccccgcggtggcggccgctctagaactagtggatcccccgggctgcaggaattcgcacgagaccattacctagaacatcctaatcgaaaaagacgccctctactaatccagcccatttcgaactctctctagacgcttcctcggtctctctgttcaccgccgccccgtaccatactcctcttcgcgccgtagaaatggcgctgccgaatcagcagggcgtggattaccccagcttcaagctcgtcatcgttggcgacggtggaactggtaaaaccacatttgtgaaaaggcatcttactggcgagtttgagaagaatatgagcccaccattggtgttgaagtttcacctctggatttagcactaactgtggcaaaattcgcttttatttgctggacactgctgggcagaaaagttcggtggccnttagggatgctactacattcatggtcagtgtgccatcattatgtttgatgtcacttctaagctgacatacaagaatggtccgatatggcacagggatctgtgcagggtctgtgagacatccccattggtctttgtggtacaagggtgatggttcagacaagccagtccaaggcaagcaagttaaatcccaccggaagaaaacttgcagtacttatgaaatttctgccagaccaatacaactttgagaagccttccttttactcctaggaacttgcaggggatcaaaccttcctttggtgaactgtttctctgan

SEQ ID NO: 43415 - protein, 54 aa, Zea mays
  misc_feature: Ceres CLONE 1444058-F
MALPNQQGVDYPSFKLVIVGDGGTGKTTFVKRHLTGEFEKNMSPPLVLKFHLWI

SEQ ID NO: 43416 - DNA, 753 bp, Zea mays
  misc_feature: Ceres CLONE 1444060-F
  misc_feature: Translation starting site: 179
  misc_feature (482)..(482): n is a, c, t, g, unknown, or other
  misc_feature (602)..(602): n is a, c, t, g, unknown, or other
ggagctccccgcggtggcggccgctctagaactagtggatcccccgggctgcaggaattcgcacgagaccattacctagaacatcctaatcgaaaaatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgccctcggtacgcgatgggcagcgcggcgtcgccctcccgcgcgtgctgcagcggggtgcgctcgctcaacagcgcgcgtcgtcgacggcggaacggcaggccacctgcaactgcctcaagagcatgacgggccggctcggccggcgcgtcagcatggncaacgccgccaacatcccctcaaagtgcgcgtctccgtcggcgtgcccatcagcccccacgtcgactgcaccaagatcaactgatcgatggaaccatagtggaaggaactccctccattngatgcaagcgtaactggccattaacagcatgcaatcctccttcctaaaaaaaattccctacctacctgtgtgtcatgcatcaaaatggcccataataaagaaataaaatcttgcgccccaccccactaagggataactttccccaaggggc

SEQ ID NO: 43417 - DNA, 766 bp, Zea mays
  misc_feature: Ceres CLONE 1444061-F
  misc_feature: Translation starting site: 406
  misc_feature: Pfam Name: GRAM Pfam Description: GRAM domain
  misc_feature (451)..(451): n is a, c, t, g, unknown, or other
  misc_feature (459)..(459): n is a, c, t, g, unknown, or other
  misc_feature (766)..(766): n is a, c, t, g, unknown, or other
aagctggagctccccgcggtggcggccgctctagaactagtggatcccccgggctgcaggaattcgcacgagaccatacctagaacatcctaatcgaaaaatctcgtccacgaaacgtacggacttcgggcatcggccccaacgccagcggcaccgcacccgcaccaccaagctcgtcggcgacatgaatccgcccgcagcagccgcgtccaccggcgcaggaggccacgcctcggcgcctgcggcagccccggagtacgcgcactacccgaggctctcgccagaggaggtggccccgcccccgcccccgccttatcacgccgccaccgccgcgccgtccgcctacggaggcaacccctacatctactcccccgccggcggcgccgccacctccccgaagatacgatggactccgtgaaggacgtgctcggcaagatgggaaagaagtttnggcgagcngcccgcaagaccgagaccatcaccgggcatttctggcagcacttgaaaactggaccaagcattactgatgcagcaatgagcaggatctcacaggtcaccaaagtcattgcagaaggtggatatgacaaaattttcatcaaacttttgaggtcgcccctggtgaaaagctcaagaacgcatatgcatggtatctgtcaacctcggctggtcctggtatgggtgtgctttacctgtccaatgtaaaactggcattttgtagtgataacccacttgcataccaggttggaaacaaactgaatggaggttn

SEQ ID NO: 43418 - DNA, 2036 bp, Zea mays
  misc_feature: Ceres CLONE 1444067
  misc_feature: Encodes the peptide sequence at SEQ ID NO. 43419
aaaaaaaacacgaacccactagccctctctgcttcctctccgtttctcctccactcaccagtcaccactcctgattgctgtcgagtctcgatctgccagcgcgcggcgcgatggccgacaaggcggcgtccccggagaagaagtcatgggccgacgtcgaagaggaggaggaggccaaggctaaggcgaccgcggcagccgaagcggcggcggcggccgccgcggcgtcctcttcctcctccatcaccgagccggcggtggaggagcaggccaagcagatcgaggcgctctccctcgccccgtcggtggacgacgccgcaggcgaagagggcccgcccctcctcgatgactccgacgactcgcaaatccaagccgtgatttcgggtggcacggtgtacgagtcggccaccacgttcgaggatctgaagctgtcgcccgagctgcttaaggggctgcacgacgagatggggttcagccgcccgagcaagatccaggcgatcaccctgcccatgatcctcacgccgccctacaaggacctcgtcgcgcaggcgcacaacggctctggcaagaccacctgtttcgtcctcggcatgctcagccgcgtcgacccgcaacgcaagataccccaggctatctgcatttgccccaccagggagcttgcgcagcagaataaggcagttctcatgaggatgggcaagtttactggcattacatgcgcctgtgcaatcccgccagctcaaaaagactacatgccgatctcgaaaatggctccgatcactgaccagatcgttatcggcacatctggtacgctcatcaaatggattacccataagaagctggccacaagggacatcaagatacttgtgtttgatgaggcagatcatatgcttgctgaggatggctttaggagtgattctgaaaggatgatgagggatatacaaagaagcgctggtggttgtcaggtgcttctcttttctgcgaccttcaatgatagggtgaaggattttgttacaaaggtcattagggatggaaatcagatatttgtgaagaaggaagagcttactttggaaaaagttaaacagtacaaagttcaagtacctgatgaatcggcaaaaatagaggttataagggacaagatatttgaatttggacagaaagttggccaggttatcatatttgttagaacaaagcaaagtactaagaatgttcacaatgctttgacgagggaggactatgtgtgctcctcaatccaaggatcccttgaccaatcagagagggaaaagataatacaggaattcaaagatggctacaccaaggttcttatatcaactgatgttcttgctcgaggttttgaccaagcacaggttaacctcgtcatcaactacgacatgccaatcaaatttggtacaagagatgaacctgattatgaggtgtacttgcacagaattggcagagctgggcgctttggccggaaaggtgctgtgttcaacttgctgtgtggtcaaaccgataatgttgtgatgaagaagatcgaggactatttccagcacagtgtgcctgaggttcggaattggcaacgtgaagaagattttgaggctgctctcaaggatgcaggtttactttaaagtaaccaccgaaacctgtggtgagcagcgctctccggctcaggacaattgaccggtgattttttttgctgagcctgctgcacaacgttagtgtgctctttctgctcatcctgttggcagcactgattttcagggtgatttttattgttttttgctgagcgtgctgcacagcgttgctgtgctcttctgttcatcctgttgtcaggactgattgttttgcagcagagttgtggattatgttaaaagactagaacagctattgtgttatgagctttatatgaagcagagggtcgttaagaggtgttcatttggcaatatgcttgtagcgcagttacgagcattaccatttggaattgtaaatctttttactagagagtagactttatttgccgtggaaaaaaaaaaaaaaaa

SEQ ID NO: 43419 - protein, 504 aa, Zea mays
  misc_feature: Ceres CLONE 1444067
  misc_feature (125)..(299): Pfam Name: DEAD Pfam Description: DEAD/DEAH box helicase
  misc_feature (369)..(453): Pfam Name: Helicase_C Pfam Description: Helicase conserved C-terminal domain
MADKAASPEKKSWADVEEEEEAKAKATAAAEAAAAAAAASSSSSITEPAVEEQAKQIEALSLAPSVDDAAGEEGPPLLDDSDDSQIQAVISGGTVYESATTFEDLKLSPELLKGLHDEMGFSRPSKIQAITLPMILTPPYKDLVAQAHNGSGKTTCFVLGMLSRVDPQRKIPQAICICPTRELAQQNKAVLMRMGKFTGITCACAIPPAQKDYMPISKMAPITDQIVIGTSGTLIKWITHKKLATRDIKILVFDEADHMLAEDGFRSDSERMMRDIQRSAGGCQVLLFSATFNDRVKDFVTKVIRDGNQIFVKKEELTLEKVKQYKVQVPDESAKIEVIRDKIFEFGQKVGQVIIFVRTKQSTKNVHNALTREDYVCSSIQGSLDQSEREKIIQEFKDGYTKVLISTDVLARGFDQAQVNLVINYDMPIKFGTRDEPDYEVYLHRIGRAGRFGRKGAVFNLLCGQTDNVVMKKIEDYFQHSVPEVRNWQREEDFEAALKDAGLL

SEQ ID NO: 43420 - DNA, 759 bp, Zea mays
  misc_feature: Ceres CLONE 1444068-F
  misc_feature: Encodes the peptide sequence at SEQ ID NO. 43421
  misc_feature (610)..(610): n is a, c, t, g, unknown, or other
  misc_feature (615)..(615): n is a, c, t, g, unknown, or other
ggagctccccgcggtggcggccgctctagaactagtggatcccccgggctgcaggaattcgcacgagaccattacctagaacatcctaatcgaaaatcagcgcaacgattacggtaacgccgtcgccgccctacggctcagatcttcgtcgtcatcttctccggcaacgagcacccaaggatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagttccaagcttcatacgcaacagttcttaaggcccatatgcatgctctgaagaaaagggagaggaaagacaagaagaaagctgcagatgctgagaaggcaattgagaccgcaccccagaagcagaagaaagcatctttcaagaaatcttcggggtccaagtcataaggcgctcgcagaaatcagtgtcttctcccttctngtgtnaccgcaccgcagactaattagagtgtcgtgaattttatctggtttttatccgaatgtgtgtctgggagaatcaagcctggtgatacacttttatagagccgtgtcatcgatgctaacattttttgaagcagagtttttgagtga

SEQ ID NO: 43421 - protein, 131 aa, Zea mays
  misc_feature: Ceres CLONE 1444068-F
  misc_feature (4)..(93): Pfam Name: SRP14 Pfam Description: Signal recognition particle 14kD protein
MVVLQPDRFLSELTSMYERSTEKGSVWVTMKRSTLKGKAQLRKMENKGQEVEHRCLVRASNGKKNISTSVSLKEYTKFQASYATVLKAHMHALKKRERKDKKKAADAEKAIETAPQKQKKASFKKSSGSKS

SEQ ID NO: 43422 - DNA, 755 bp, Zea mays
  misc_feature: Ceres CLONE 1444071-F
  misc_feature (516)..(516): n is a, c, t, g, unknown, or other
  misc_feature (562)..(562): n is a, c, t, g, unknown, or other
  misc_feature (581)..(581): n is a, c, t, g, unknown, or other
  misc_feature (626)..(626): n is a, c, t, g, unknown, or other
ggagctccccgcggtggcggccgctctagaactagtggatcccccgggctgcaggaattcgcacgagaccattacctagaacatcctaatcgaaaagattctcgaatctcgatctccctgctctacccgcatcaccccgccgttgccggccccttcctcccgcttcccacctcgccgtcgccacctcttcctcttcctcatcgccggcgcttgcgcgccccttctccaccccgttgaccgccgcacccacggcctcgccgttgcagcactcgtgcgatccggtcacgagtggagcgcacgagctcattcgctgcttccgcctccccctcttccttgccggagcccgcgcctcctctcctcgccggcgccttcgcctgctcctgcgcccccttctccacgtcgcacccacggcctcgtgttgctgccctcgtgagatccggtcgcgagcgcccgacctaggccgctgcctcagtctctcctcgctcggtcgcatcaccaccgccggagacggaccgnagtgctctgcgagactccgcgccatagagctcctcctacggcgggntcttttccgtccggtagcntgggtccctgaaagcagtcatggcgatgaccaccgccgtgacggncctcgccgtcgcagcaaccgctcccattcgctccttcctctcgtccgcccgcgcctctgtcaacctgcccgccgaatcttcgtgacctcgcctccgaactagcctcggaaccctgcccgtctcctaccg

SEQ ID NO: 43423 - DNA, 763 bp, Zea mays
  misc_feature: Ceres CLONE 1444073-F
  misc_feature: Encodes the peptide sequence at SEQ ID NO. 43424
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgacagcaagatctcccccgacgagatcctcttcgagggctgcgactacaaccactggctcatcaccatggacttcccggaccccaagccgtcgcgcgaagagatgatcgagacatacctccagactctcgccaaggtcgtcgggaggtatgacgccaagctggttccccgtttcattcctttttcgcgacgaaatgcgtggcccttgtacagaatgggtttgctgtcgcggtgaattggttcttgtgnagctgaaacgcgatcctggatgtgcggttgcttcatcttgctgtgtcatggcttgccttgtgggctatatggtaccagtcaagtcttcgatctaatagatgctacttatgtgttaactagatgctgtcgtgattgtaatcagtactgaatt

SEQ ID NO: 43424 - protein, 152 aa, Zea mays
  misc_feature: Ceres CLONE 1444073-F
MALALRLRRVLAAASTAAPLLRPSTSVARPCPLVPLASPVAPLPLPPWRFLPGGGAGFRSTAAAAARGGTDYGTDDSKISPDEILFEGCDYNHWLITMDFPDPKPSREEMIETYLQTLAKVVGRYDAKLVPRFIPFSRRNAWPLYRMGLLSR

SEQ ID NO: 43425 - DNA, 759 bp, Zea mays
  misc_feature: Ceres CLONE 1444077-F
  misc_feature: Encodes the peptide sequence at SEQ ID NO. 43426
cccccgggctgcaggatttcgcacgagaccattacctagaacatcctaatcgaaaagtcgtcttggcgcgcgcgctcggcttcccttcctttttccctcgcgcgcggccaacctagaaagcgacggcggagccggacagggaaggggaggcgggccggctggtcaagggcggacgatgtgctgcgccggcgacggggagtgccggccgctcgggtggctcctgggcctgcccttcgcgctgctcgccggcctcgtctccttcgtcggcgccgtcatctggatcatcgggagcggggtttcgttcttgttcgatcttggtttgattaatattcttcttggggcttctcccgttaaagtaaccccaaaaccgggtcgcccaacattcccgtttggccccgcgcatcctggctgccccatccacgtgcatcctgcccctgcctgcctcctgcgtatacggtagctgcctggtaagtcggtcgtgggatcttctccagaggaggccggctcccgatgtccttgacctggggtttacttccaagaatcccctggttagctgtcccccttggtttcctggtggggggggaacctgcgttacccccttgcttctttcctccgaccaggcttgctggaccaggaacttggccaggtttgttctctgtttctcaccctccgtggtatccgttgcgagcttgagccctacctttgcggtttttctctcgcttcagacctttggaggcggggtctcgcccctccctcgcg

SEQ ID NO: 43426 - protein, 94 aa, Zea mays
  misc_feature: Ceres CLONE 1444077-F
MCCAGDGECRPLGWLLGLPFALLAGLVSFVGAVIWIIGSGVSFLFDLGLINILLGASPVKVTPKPGRPTFPFGPAHPGCPIHVHPAPACLLRIR

SEQ ID NO: 43427 - DNA, 723 bp, Zea mays
  misc_feature: Ceres CLONE 1444078-F
  misc_feature: Translation starting site: 249
  misc_feature (366)..(366): n is a, c, t, g, unknown, or other
  misc_feature (367)..(367): n is a, c, t, g, unknown, or other
  misc_feature (525)..(525): n is a, c, t, g, unknown, or other
ccccgaggtggcggccgctctacaactagtggatcccccgggctgcaggaattcgcacgagaccattacctagaacatcctaatcgaaaaaaagttctcaagttgtttctagcaaccggctgtgaggatatcatattggctgttcggttgctcaacattaagcagccactcgtaccagtccttcccacaaggtgctctgagagattctagacctgctgccgctcacatcgttttgattacctgaaaagatgcctttggaaattcaagatagtgaggttgacattgtgattgcagcactccagcccaacctgaccactttctttgaggcatggcgaccatttttctcccgtttccacataattgacnncaaagatccagaacatggcagaggatcttcaaacccctgcacgtttttgatctcaaggtttacaccaactcacatattaatgggttgcttggtgccctcatccataaactttatccgggcactcatgccgattacttttgggaatcttgtctcccccnaaaaagttgttgattttcaattgatgaacatttgcctcccaaccaaaggaacaccgctgggctcaactgtttatgttactcgcaaagacaaatggcccaatctgaaaaacaccagggttaacccttttttttttaaacaaccccgctatagaatccacaccgggaaagggcgctcgtattttgtaccacggattaacc

SEQ ID NO: 43428 - DNA, 761 bp, Zea mays
  misc_feature: Ceres CLONE 1444080-F
  misc_feature: Encodes the peptide sequence at SEQ ID NO. 43429
  misc_feature (511)..(511): n is a, c, t, g, unknown, or other
  misc_feature (512)..(512): n is a, c, t, g, unknown, or other
  misc_feature (521)..(521): n is a, c, t, g, unknown, or other
  misc_feature (659)..(659): n is a, c, t, g, unknown, or other
  misc_feature (664)..(664): n is a, c, t, g, unknown, or other
  misc_feature (726)..(726): n is a, c, t, g, unknown, or other
  misc_feature (761)..(761): n is a, c, t, g, unknown, or other
ggagctccccgcggtggcggccgctctagaactagtggatcccccgggctgcaggaattcgcacgagaccattacctagaacatcctaatcgaaaaaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccnnacactttgnccgtggtcactacaccattggcaaggagattggtgacctgtgccttgatcgcatcaggaagcttgcccgacactgcactggtctccagggcttcctcgtcttcaacgctgttgggtggagaaacggctctgggctggntcccntccctctagagcgcctgtctgttgactacggcaagaaatccaagcttggggtcactgtgtanctttccccccagtttctacttcgggtagtgagccn

SEQ ID NO: 43429 - protein, 183 aa, Zea mays
  misc_feature: Ceres CLONE 1444080-F
  misc_feature (49)..(183): Pfam Name: Tubulin Pfam Description: Tubulin/FtsZ family, GTPase domain
  misc_feature (101)..(101): Xaa is any aa, unknown, or other
  misc_feature (104)..(104): Xaa is any aa, unknown, or other
  misc_feature (150)..(150): Xaa is any aa, unknown, or other
  misc_feature (152)..(152): Xaa is any aa, unknown, or other
  misc_feature (172)..(172): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAAXHFXRGHYTIGKEIGDLCLDRIRKLARHCTGLQGFLVFNAVGWRNGSGLXPXPLERLSVDYGKKSKLGVTVXLSPQFLLRVVS

SEQ ID NO: 43430 - DNA, 710 bp, Zea mays
  misc_feature: Ceres CLONE 1444081-F
  misc_feature: Encodes the peptide sequence at SEQ ID NO. 43431
  misc_feature (321)..(321): n is a, c, t, g, unknown, or other
  misc_feature (541)..(541): n is a, c, t, g, unknown, or other
  misc_feature (614)..(614): n is a, c, t, g, unknown, or other
ctggagctccccgcggtggcggccgctctagaactagtggatcccccgggctgcaggaattcgcacgagaccattacctagaacatcctaatcgaaaaaaacgcgaagcaaacccttttcggcgtccggcgtccccatccccaccccaccaggccaccacggcgggatgaggccggcgtcggacgcgcaccagtcgcggctgctctacgagctctgcgcgctcctgctgaccgtcctccgggcgtcgcctgacgacggggcggtggcgcggccgctgctgccgcgacatgtgacgcccgccggggtggcgtccatgctgcntggggcgtccatggcgctgatgctctgcggctcggtcaccttcatgctcggcttctcctcatgccctgggttgtcgggctcggtttctcttccctctcgtcggcttcatcaccaacctctccgggatctggagggacatcatcctctggcccctcgtcgcgtgctccgcatcggactcacccaaggaggcaccctccccatgcatatgttttccagcctncatccctgtcgacgtgaagcaagtacaaataaggctcccacggagtccatataagcagggagttgtggacccncagactcttgccattgccacctatatttccttctggacacccttctttactgtgacccgcacaagttgcaaggtttaatggtttgaccgggccaga

SEQ ID NO: 43431 - protein, 142 aa, Zea mays
  misc_feature: Ceres CLONE 1444081-F
  misc_feature (52)..(52): Xaa is any aa, unknown, or other
MRPASDAHQSRLLYELCALLLTVLRASPDDGAVARPLLPRHVTPAGVASMLXGASMALMLCGSVTFMLGFSSCPGLSGSVSLPSRRLHHQPLRDLEGHHPLAPRRVLRIGLTQGGTLPMHMFSSLHPCRREASTNKAPTESI

SEQ ID NO: 43432 - DNA, 738 bp, Zea mays
  misc_feature: Ceres CLONE 1444083-F
  misc_feature: Encodes the peptide sequence at SEQ ID NO. 43433
  misc_feature (331)..(331): n is a, c, t, g, unknown, or other
  misc_feature (398)..(398): n is a, c, t, g, unknown, or other
  misc_feature (406)..(406): n is a, c, t, g, unknown, or other
ggagctccccgcggtggcggccgctctagaactagtggatcccccgggctgcaggaattcgcacgagaccattacctagaacatcctaatcgaaaaacattattgtcatttcgtctcgtcctgttcttttaaatactcccaaatatcatctcctcggaaagaggagcgaagagagcgaaatccagagcacacggcgtcgcatttggaacgctcctgctcgtcgcacgtacgaagcccacgcgtccgcgcacgtgccagagccgagcccccgcgccggcgccccgccggagaggatgacgcggcggtgctcgcactgcagcaacacggccancactcgcgtacctgccccgtccgctcccgcggcggcggcacccgcggcggcggggtgaagctgttcngcgtgcgnctcaccacgcgccggcccccggcgtgatgaaaaaaacgccagcctggactgcattgggtcctcctcggggggggtttcggcgggttttccccccggtgaaagaattggtcctgcaaaaaagggaaaaaaggggacccgtttcctgttcaataacccccccccccttctttccaaaaaagggcccccccaaagccaaaaaagcccccttggtataaaaaaaaaaaaaatgttctaaggggccccaaaaatttgaagagaaaaggggggcgaaaaccaaaaatttttttttctcccccccccctcctgtgggcggcgcgcaaaaaatcttttta

SEQ ID NO: 43433 - protein, 31 aa, Zea mays
  misc_feature: Ceres CLONE 1444083-F
  misc_feature (13)..(13): Xaa is any aa, unknown, or other
MTRRCSHCSNTAXTRVPAPSAPAAAAPAAAG

SEQ ID NO: 43434 - DNA, 848 bp, Zea mays
  misc_feature: Ceres CLONE 1444084-F
  misc_feature: Encodes the peptide sequence at SEQ ID NO. 43435
  misc_feature (371)..(371): n is a, c, t, g, unknown, or other
  misc_feature (399)..(399): n is a, c, t, g, unknown, or other
  misc_feature (673)..(673): n is a, c, t, g, unknown, or other
  misc_feature (744)..(744): n is a, c, t, g, unknown, or other
  misc_feature (779)..(779): n is a, c, t, g, unknown, or other
actagtggagctccccgcggtggcggccgctctagaactagtggatcccccgggctgcaggaattcgcacgagaccattacctagaacatcctaatcgaaaagttttgcttccgcagttccgccgtcggcaaggaaggaaaaagagagcagagaaccctagctagagtttggcgagtggtgcggaggcgcggctgctcctgctcgtcgcgacgtcgaatttcagcgccgcccacgcgatccttggtctcttcgcccgtgaggagaggcgcgacaatggctgggaaaggcgggccgaccaacctggagaaggagcagatgtttgggatggcggagaaggagatggagtacagggttgatctgttcatgaggntttcccaacacgtgtggtgagaaatccnttgaaaaaaaggaccccccaccctgagctccaaatggatgagaaacggtcgcattcggtgcgacggggttccacacgaattggcccgggcgacaaattctacgagggtcaaaatgcttgggcaaccctctccctccaatgggtaaaccgagaatcgccctcggtgtccatttttggcagccaaaagtccttcatagcgcccggggccttccccttgtgggaggggaatagtacgaatatctcgggcgagcgctcccctatccaacccacacccnttcgcgcatcccagctctctgcgcgacggcgttggagttgggtctcttaaataaagatctccctgtgggancttagctactttgccccatttcgctggccaacatncgacttctctcacccatccgacgaggagaccttagcccccattcttactctcttgcctcgcactagtgg

SEQ ID NO: 43435 - protein, 38 aa, Zea mays
  misc_feature: Ceres CLONE 1444084-F
  misc_feature (33)..(33): Xaa is any aa, unknown, or other
MAGKGGPTNLEKEQMFGMAEKEMEYRVDLFMRXSQHVW

SEQ ID NO: 43436 - DNA, 760 bp, Zea mays
  misc_feature: Ceres CLONE 1444087-F
  misc_feature: Encodes the peptide sequence at SEQ ID NO. 43437
  misc_feature (521)..(521): n is a, c, t, g, unknown, or other
  misc_feature (541)..(541): n is a, c, t, g, unknown, or other
  misc_feature (636)..(636): n is a, c, t, g, unknown, or other
ggagctccccgcggtggcggccgctctagaactagtggatcccccgggctgcaggaattcgcacgagaccattacctagaacatcctaatcgaaaaactagttgttcgttcccaccgcaagcaaagcattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtaccccattttgggactncatcttctgaggctgttggntcagaatagaattgctgagttccatactgagctgaagcttttacctgtcaaggcacttgagcacccttgcatcaagcatgctgtagagcttgagncatcttcatgggagggtgcctacaccgagtggtaagcggctcggcagctgtgcacatgagacctatgttacttcatggaccttctgcccagacagtaaagatgagatcgtaggtgcacggaaag

SEQ ID NO: 43437 - protein, 160 aa, Zea mays
  misc_feature: Ceres CLONE 1444087-F
  misc_feature (118)..(118): Xaa is any aa, unknown, or other
  misc_feature (150)..(150): Xaa is any aa, unknown, or other
MDPKMTEVTQMFARFKAAYTRNDLDACVTLLSQLKVHLTKFPSLPPSFEQTPKAVEELKLARDIYEHAVVLSVKLEDQDAFERDFCQLKPYYMDTCGIIPPSPEEYPILGLHLLRLLXQNRIAEFHTELKLLPVKALEHPCIKHAVELEXSSWEGAYTEW

SEQ ID NO: 43438 - DNA, 781 bp, Zea mays
  misc_feature: Ceres CLONE 1444088-F
  misc_feature: Encodes the peptide sequence at SEQ ID NO. 43439
  misc_feature (205)..(205): n is a, c, t, g, unknown, or other
  misc_feature (280)..(280): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgncagtgcggcaacggctgcggagggtgcagcaagatgtacccggacatggctgagcaggtgaccaccaccacccangctctcatcatgggtgtcgcaccatccaggggcacgcccgagggcgggtcgaggcggccgccgagctgaaaacgcgggtgcagtgcggcggcactgccatgggacccctggaatgcgggcaggaactaggtgctcaccctgcagcgcgccggaggaccttgctattttaaagtttataaaattaacgcgcccccttggtggtttccaaacaacaacaatttgcggcccgggtgtgctctaatcaaaaaaaaaaaagggtttaggggggnnnttttccccccccgccccccggggggctttctggaaaaaatttttttttttttgggggccccccacaaaagaaaaaaaggggccccgtgttgttgtcccccctccttttaatttttctcccccccccttgtttgggggggggccccccttcttttttttccccccaacgaaaaagggggggttgtgccacaaaaaaaaaaaaaactttttttttccccccccggggggggg

SEQ ID NO: 43439 - protein, 61 aa, Zea mays
  misc_feature: Ceres CLONE 1444088-F
  misc_feature (1)..(56): Pfam Name: Metallothio_2 Pfam Description: Metallothionein
  misc_feature (14)..(14): Xaa is any aa, unknown, or other
  misc_feature (39)..(39): Xaa is any aa, unknown, or other
MSCCGGNCGCGSGXQCGNGCGGCSKMYPDMAEQVTTTTXALIMGVAPSRGTPEGGSRRPPS

SEQ ID NO: 43440 - DNA, 776 bp, Zea mays
  misc_feature: Ceres CLONE 1444092-F
  misc_feature: Encodes the peptide sequence at SEQ ID NO. 43441
  misc_feature (736)..(736): n is a, c, t, g, unknown, or other
  misc_feature (743)..(743): n is a, c, t, g, unknown, or other
ctggagctccccgcggtggcggccgctctagaactagtggatcccccgggctgcaggaattcgcacgagaccattacctagaacatcctaatcgaaaacaagaagtaggagatgatgagctacttccaaaccactacttgcaagcctcaaagcagggtcgttgtgaacaaacctataccaggtcttgggagcacaagtcagcatccgttatattcacatgctctcagattccacaggctgcaacagaaggtgtacccaaggctacttctcgttgctgctagccacaaaaggcttactcctgtatgtgtcttaagtggaaagggaaatgctggcactgctgatgatcctttgatggaatctttgaagaaagctatggctgatgcaaaaaagcccaggtccatacaagacttgctgaaggagcaggtggctaaactcagagaacaagcatccggtggaggcggagggaatgggaaaatcgcgtggagcagtggtggttctggtggcccagatgatgagtccttcaggaagcattggatgaagtagtccaagttatcttagccactgggtgcttcatacttgtgtacatccacataatcagaggggaggaagctttaccgtctttgcagggactacaccagatatctcgtcactggtaagaagactgcccgactgaagcgtcccatgcaaaggtggcacactttctccgaaagcttcatgcaaaaaggaagctcaaaanaagaccnatatgagaaacctacatggttggcacagcctcc

SEQ ID NO: 43441 - protein, 143 aa, Zea mays
  misc_feature: Ceres CLONE 1444092-F
MMSYFQTTTCKPQSRVVVNKPIPGLGSTSQHPLYSHALRFHRLQQKVYPRLLLVAASHKRLTPVCVLSGKGNAGTADDPLMESLKKAMADAKKPRSIQDLLKEQVAKLREQASGGGGGNGKIAWSSGGSGGPDDESFRKHWMK

SEQ ID NO: 43442 - DNA, 694 bp, Zea mays
  misc_feature: Ceres CLONE 1444095-F
  misc_feature (337)..(337): n is a, c, t, g, unknown, or other
  misc_feature (338)..(338): n is a, c, t, g, unknown, or other
  misc_feature (346)..(346): n is a, c, t, g, unknown, or other
acccgcggtggcggccgctctagaactagtggatcccccgggctgcaggaattcgcacgagaccattacctagaacatcctaatcgaaaattttcccccacgtgcgccgccgcgaccttcctcgatcccatctcccaacgcccccgcctcgcctcgggatcccgccgccgctccatctgcctttgctcccccacccgcaggcagcgagcgacagcgacggcgagggatggccagggcaggtcgttggcgaagcagagcaggcgcagcaatcaaacgcggcggcgccacgcgctgtcctccagctcgccggtactcgacccgaaggctccttggacanngacaccgngcgaccgtgcactgatccccaggcggtgggtcatagccgccggcctggggagcctccccccgtcgggcctttggacgactattttggcccccccacgggtttacatgggaccaacccccttctgaaggtacaaaagaaaatgggggcccgggggcctcttaagggggttttcgtttataaccctttccgggttgggggataaaaaaaggggggccccttaaaaaaccctttgggcaaacacttttttggggggcacaaaaaaaccccccccggggggagaaagagggtttttaaaaggggggttaaaaagggggtgtgattgttgttttccccccccccgttgtttgg

SEQ ID NO: 43443 - DNA, 686 bp, Zea mays
  misc_feature: Ceres CLONE 1444097-F
  misc_feature: Encodes the peptide sequence at SEQ ID NO. 43444
  misc_feature (298)..(298): n is a, c, t, g, unknown, or other
  misc_feature (368)..(368): n is a, c, t, g, unknown, or other
  misc_feature (383)..(383): n is a, c, t, g, unknown, or other
  misc_feature (386)..(386): n is a, c, t, g, unknown, or other
  misc_feature (550)..(550): n is a, c, t, g, unknown, or other
  misc_feature (551)..(551): n is a, c, t, g, unknown, or other
  misc_feature (554)..(554): n is a, c, t, g, unknown, or other
ggatcccccgggctgcaggaattcgcacgagaccattacctagaacatcctaatcgaaaaatttttctctcctcactcaacgcggcgatgccccctagatcggatcacgccgccggtagcggcgccgcggcggcggccacccaggcccacttcgactcatcgatccactcttccatgtgctccgcgtgctacccttctccttcctcctgccgccgcgaaccccactgaagctgcctctaacctggcccttccctctcccatgaacgtcttccccctcatcctgctcacctacttttgnggtcttttccggactttttttttaacccacggaagaagggcggcggggacccccccccctcacaataatnaccccccccccccanccnaccccccaccattcttccttgcgcaccccgcgccccccccgggctcagggaaccccctcccggtcccgtcccccccccccggaattgagaattcttaattaaattagaccccccccaccgcgccctcgtgccccccaccccgtcttccaagcccacccctccgnnccnaaccccccccaccgcggacgcagccccacccccctcctcaccacccccagaaacgacaggaatcctaacactaaatcccccacaaacacacagcccccacgcatccccctacccccccctgccccctccccg

SEQ ID NO: 43444 - protein, 74 aa, Zea mays
  misc_feature: Ceres CLONE 1444097-F
  misc_feature (13)..(13): Xaa is any aa, unknown, or other
  misc_feature (37)..(37): Xaa is any aa, unknown, or other
  misc_feature (42)..(42): Xaa is any aa, unknown, or other
  misc_feature (43)..(43): Xaa is any aa, unknown, or other
MNVFPLILLTYFXGLFRTFFLTHGRRAAGTPPPHNNXPPPPXXPPPFFLAHPAPPPGSGNPLPVPSPPPGIENS

SEQ ID NO: 43445 - DNA, 810 bp, Zea mays
  misc_feature: Ceres CLONE 1444100-F
  misc_feature: Encodes the peptide sequence at SEQ ID NO. 43446
  misc_feature (360)..(360): n is a, c, t, g, unknown, or other
  misc_feature (367)..(367): n is a, c, t, g, unknown, or other
  misc_feature (368)..(368): n is a, c, t, g, unknown, or other
  misc_feature (370)..(370): n is a, c, t, g, unknown, or other
  misc_feature (467)..(467): n is a, c, t, g, unknown, or other
  misc_feature (468)..(468): n is a, c, t, g, unknown, or other
ggagctccccgcggtggcggccgctctagaactagtggatcccccgggctgcaggaattcgcacgagaccattacctagaacatcctaatcgaaaaattttctctggctctgccctctccttcctctcctcaaaagtctctgtaaaaaaagtaggtagtgtctcttttcgaccgctgcagaggagcgagaggcagctcccactcgtgccgctgttcctcgcgccatggactccttcagcttcctcaagtacctgcgcggaggcgtggtcgccggcgcccatcgcgcgcccgcggccgccacgaccatacgcgcgtcggcgtgcgagtacggcgacgacgcctcctccttcttcgacctgnaggtagnnanccccggcacgagagcgccgcgtccgactccgaagaccaccgggtttagctcaacttcgctgcggaagacaaaggcgtcccgccccccctggccaccnnttaaaaagttggaatagcctgaacctgagggcgcgcccgccgccgccccgtttgtgccccctcccggcaacctgtgttcccgtgctgcctcctcagcatccgaaaccccaagggctggccccgggcgcgcacaaaaacatccggaaaccatacccttccccgtttgccaatcctggttcctgtggaaaacctcccggggtggtccaacatcgaaccccaaatgggggtgggcctgttttaccgggtcgaaaaatcaaatcttcttgccgcccttttgaaatatcccgcgagccgagcactggctctcgtgttcctgtgtcatctccaacttcgcatcctatg

SEQ ID NO: 43446 - protein, 86 aa, Zea mays
  misc_feature: Ceres CLONE 1444100-F
  misc_feature (46)..(46): Xaa is any aa, unknown, or other
  misc_feature (48)..(48): Xaa is any aa, unknown, or other
  misc_feature (49)..(49): Xaa is any aa, unknown, or other
  misc_feature (82)..(82): Xaa is any aa, unknown, or other
MDSFSFLKYLRGGVVAGAHRAPAAATTIRASACEYGDDASSFFDLXVXXPGTRAPRPTPKTTGFSSTSLRKTKASRPPWPPXKKLE

SEQ ID NO: 43447 - DNA, 734 bp, Zea mays
  misc_feature: Ceres CLONE 1444101-F
  misc_feature: Translation starting site: 143
ggagctccccgcggtggcggccgctctagaactagtggatcccccgggctgcaggaattcgcacgagaccattacctagaacatcctaatcgaaaaagattcggagcttcgggggaaaaaggcaggcacagtatcgtcgaacatgctgccaggtcgccacccggcgcgccgggccgacaccaccgggacggggccgctcctgccggacgccactcgcgcggtggtgtcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgtcgcatctctttcggccgtgccgcggtatactggctcgcgcagatgctcggcgcccgtggtcgcgtcgttgctgctaacgctcgtcctcggcggcacgcgtcccgtgggcttcgggctcgtccgcggcgtccacgagcggcacgcgctcctgctaaaggccgtcatgacgttcgggctcatgaacgccgtgaacgcacccgcgggggatccccggagccggggcggcccggttccaatcccccccctcgccatcggtttcgtcctgggcgcgaaaatcctccccggcgggccgtcc

SEQ ID NO: 43448 - DNA, 752 bp, Zea mays
  misc_feature: Ceres CLONE 1444103-F
  misc_feature: Translation starting site: 246
  misc_feature: Pfam Name: YIF1 Pfam Description: YIF1
  misc_feature (391)..(391): n is a, c, t, g, unknown, or other
  misc_feature (497)..(497): n is a, c, t, g, unknown, or other
  misc_feature (528)..(528): n is a, c, t, g, unknown, or other
  misc_feature (529)..(529): n is a, c, t, g, unknown, or other
  misc_feature (671)..(671): n is a, c, t, g, unknown, or other
  misc_feature (705)..(705): n is a, c, t, g, unknown, or other
tggagctccccgcggtggcggccgctctagaactagtggatcccccgggctgcaggaattcgcacgagaccattacctagaacatcctaatcgaaaagaaattttccgtttgcacctaccgagaggtgacgacgagtgaggagtctgtgtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacatccacaagcaaatccttttggaactgccttgcagggtgctggaccaggattgatccgtactgggctagaaacatatggcggaaggattttagattncagttctgagtttatgcagagcaatataacacaatatttgtccgaccctcagtactactttcaagtcaacagccagtatgtgaggaacaaactgaaggtcatcttngttccctttcttgcacaggggtcactggacnnagaatactgaaccagtaggaggaaggctatccctacaacctccagtccccagatatcatgcaccggacttgtacatccctttgatggcattttgcacctacattgtagctgctgggtatgccttgggtgttcttggaagttnaccccctgagcactgaccctacgttttctaaggnatactttgggtgttttctgcagtcgtctcatcaaagtctgctgtacc

SEQ ID NO: 43449 - DNA, 773 bp, Zea mays
  misc_feature: Ceres CLONE 1444104-F
  misc_feature: Encodes the peptide sequence at SEQ ID NO. 43450
acccgcggtggcggccgctctagaactagtggatcccccgggctgcaggaattcgcacgagaccattacctagaacatcctaatcgaaaacttctctttcccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtccccccttcatactccctagcatgctcggctcgcaccccggattgatcgagctcgcccgtcgccgcgatggattcgggtgcttccccctctcttctacccgggcccacgctgctcccggtccccgccgccgtttttgaccctgcggagggggggcccaggcaacccccccccccccccggggccgccgggtggccctctggggcgctggtcccctgggttttcccggccggggggtccccccgcgaaaacttccttggggccctccggggggaggctaaacaaaaggggatttttcccgggggttggggtccgaaaaatcctccggaaacagtctttcccccttgggggggttaaacccccgccccagattttggggggccccgccctctggagaaaaaaacaaattttccatgggggggggaaatttctctttggccccttttccacggaaaaaattttggggggaaaaatatcccctccccccccccacgaccg

SEQ ID NO: 43450 - protein, 95 aa, Zea mays
  misc_feature: Ceres CLONE 1444104-F
MDSGASPSLLPGPTLLPVPAAVFDPAEGGPRQPPPPPGAAGWPSGALVPWVFPAGGSPRENFLGALRGEAKQKGIFPGGWGPKNPPETVFPPWGG

SEQ ID NO: 43451 - DNA, 751 bp, Zea mays
  misc_feature: Ceres CLONE 1444107-F
  misc_feature: Translation starting site: 142
  misc_feature: SWISSPROT Homolog: EC 2.1.1.143 24-methylenesterol C-methyltransferase
  misc_feature (445)..(445): n is a, c, t, g, unknown, or other
  misc_feature (533)..(533): n is a, c, t, g, unknown, or other
ctccccgcggtggcggccgctctagaactagtggatcccccgggctgcaggaattcgcacgagaccattacctagaacatcctaatcgaaaaaataacgaaaacgtctctcgtctctcgtctctctctctctctttaaaaaatggacagtgtcgcactcttcttcactggagctctcgtagccggcggaatctactggttcctgtgcgtcctgggaccagcggagcgtaaaggcaaacgagcgttggatctatcgggcgggtccatctcggcggagaaagttcaagacaagtacaaacagtactggtcgttcttccgccgtccgaaagagatcgaaaccgccgagaaagtcccggacttcgtggacaccttctacaacctgcgtcaccgacatctacgagtggggatggggacagtccttccacttctctccttccatccgaggncaatcccaccgtgacgccacgcgcctccacgaagagatggccgtagatctgatccaagtgaaaccgggtcaaaagatcctctatgtcngatgccgcgtgggaggtccgatgcccgcgattgcatcccactcgcgagccaacgtgtgggggatcacgatcaacgagtaccagggtgagaaagcgcgtgacccccacaggaaagccggactcgccccgctctgcgagggcctgtgtgggaacttcctcaaaagccctttgaaggaaaaaccttgcgaggggcgtactctatcgaacgacgtgtccccc

SEQ ID NO: 43452 - DNA, 753 bp, Zea mays
  misc_feature: Ceres CLONE 1444110-F
  misc_feature: Translation starting site: 247
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcgaaaaaattctcttgtctcttgcacatcccccgcttccttcttggtcgtttctccccttctgatccgtgctagccagcttgcgttgtggctgcttgtcgccagatctacctatccaccgtaccacagtcgtccacagcgcgcgcttacgatggcggtcgccgccgctcgccttcttcttcgcgtcgtcgtcctcgcgctcctcgcagccgcgcagcaggtcgtcgggaagagcgccgtgctgtctctgcgggagttggatggacgacgacggagtgccgcgacgacggatacccggagcagccgctactacgtcgacgcaatgcttgctgaaacgctaggggagcacaagaaagctggggcagcaacaagcgtgctagagctcaagcgccactccctcactgcccatcctgaagaccccgtcgcccgcgaccgctacctccgccgtctcctcgcagccgacgagtcgcgcgccaactcattccagcccgntcgtacaggacagggcatcagcgtccacgcagtcggcctcggcagaagtcccgctgacctcgggcatccggctccagacgctcaactacgtcaccaccatctctctcggcggcagctccggctcgcccgccgcgaacctcacgtcatcgtggaacggggagcgacc

SEQ ID NO: 43453 - DNA, 759 bp, Zea mays
  misc_feature: Ceres CLONE 1444114-F
  misc_feature: Encodes the peptide sequence at SEQ ID NO. 43454
  misc_feature (585)..(585): n is a, c, t, g, unknown, or other
  misc_feature (641)..(641): n is a, c, t, g, unknown, or other
  misc_feature (675)..(675): n is a, c, t, g, unknown, or other
  misc_feature (702)..(702): n is a, c, t, g, unknown, or other
  misc_feature (719)..(719): n is a, c, t, g, unknown, or other
aagctggagctccccgcggtggcggccgctctagaactagtggatcccccgggctgcaggaattcgcacgagaccattacctagaacatcctaatcgaaaacacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccngagatagccgccgaagacccaagagtggcggctgtggaggctaacgaggaagaagnaagagcagcgcctgctgttgctgccactcctgangtcgcagcgacccgagaagaagcggcngcccctgctcccgaggnccgcgtcgagaagtccgtcgagtgagtccagcccagcgcc

SEQ ID NO: 43454 - protein, 167 aa, Zea mays
  misc_feature: Ceres CLONE 1444114-F
  misc_feature (134)..(134): Xaa is any aa, unknown, or other
  misc_feature (145)..(145): Xaa is any aa, unknown, or other
  misc_feature (160)..(160): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAEDPRVAAVEANEEEXRAAPAVAATPXVAATREEAAAPAPEXRVEKSVE

SEQ ID NO: 43455 - DNA, 758 bp, Zea mays
  misc_feature: Ceres CLONE 1444118-F
  misc_feature: Encodes the peptide sequence at SEQ ID NO. 43456
  misc_feature (539)..(539): n is a, c, t, g, unknown, or other
ggagctccccgcggtggcggccgctctagaactagtggatcccccgggctgcaggaattcgcacgagaccattacctagaacatcctaatcgaaaaattcttccagcaaccgttcgcccaaatccattgccgctcctgcccccaacggcgcatgccttcacctcctcagccatggagctcacgagcatctccctctgtgcaccccctccgcgcgtccctgctccctcgtcaccaggtgcacgcgcgcagcttcctgcgcgccgggatggccctccagccccagctcgcccctgccctcagctatggcgccttgccgccgccgcccctgctttccatggcggcacttcctgcttcctggtggtcggcgccctccccaacctctctgctggtggttgtctccatcccctccatggcgagctcgcccctgcattcctgctcgcccaagatccccttccatgttccagccacctcccatggacgccagcccctcactcatagtcgccccagctcgcccacccccctctctgctggtggccggncacctctgctgcttccatggtgtagcacttacggtatttaagatggagtggaatattcagcacataacacaccaggtgttcggtgaaaagtccagccaaaagtcgtcgtcgtttcagatatatcgagtcgattcgattttggtagctgattcccggaattggtattagtttgatgatggataaataaaaatactggtgtgcgtaaagggtttgttgtaa

SEQ ID NO: 43456 - protein, 134 aa, Zea mays
  misc_feature: Ceres CLONE 1444118-F
MAPCRRRPCFPWRHFLLPGGRRPPQPLCWWLSPSPPWRARPCIPARPRSPSMFQPPPMDASPSLIVAPARPPPSLLVAGHLCCFHGVALTVFKMEWNIQHITHQVFGEKSSQKSSSFQIYRVDSILVADSRNWY

SEQ ID NO: 43457 - DNA, 763 bp, Zea mays
  misc_feature: Ceres CLONE 1444119-F
  misc_feature: Encodes the peptide sequence at SEQ ID NO. 43458
aaagctggagctccccgcggtggcggccgctctagaactagtggatcccccgggctgcaggaattcgcacgagaccattacctagaacatcctaatcgaaaaatctcctcacttcacaccactcccgccattgtcctgcgcctttctgcaccgccacacacaccccgctccaatccaatggcgcctcgccaagccgtcctcgcggtcgtggtcctcgccgcgctgctcccgttcgccctctctcgcgggctgcggcttggccaccaccgcgcccagccgcacccgaggccgcacggccacgcaccgctcggaggtggcgcgtggtcctcggctcacgccaccttctacggcggcggcgatgcgtccggcaccatgggcggggcgtgtgggtacggcaacctctacagccacccccactgcaccaacacggcggcgctgagcacggcgctcttcaacaacggcctcagctgcggcgccctgcttcaagtgcggtgcgacgcggcggggggcggcggccgctcgtgtctgccgggctccgtcgtggtgacgggccacaacttctgcccgcccaacaacgcggctccgtcccgacgacggtctgttgttgcaacccgccgggcgcccactttaaattgtcgcagcccgtgtttcagcggatccccgctctacagggctgggatttgcccccgtctccctaccgcagggtcccggtgaaacaaagaagggcggtattcgggtttaacattaaagggccactccctat

SEQ ID NO: 43458 - protein, 178 aa, Zea mays
  misc_feature: Ceres CLONE 1444119-F
  misc_feature (84)..(155): Pfam Name: DPBB_1 Pfam Description: Rare lipoprotein A (RlpA)-like double-psi beta-barrel
MAPRQAVLAVVVLAALLPFALSRGLRLGHHRAQPHPRPHGHAPLGGGAWSSAHATFYGGGDASGTMGGACGYGNLYSHPHCTNTAALSTALFNNGLSCGALLQVRCDAAGGGGRSCLPGSVVVTGHNFCPPNNAAPSRRRSVVATRRAPTLNCRSPCFSGSPLYRAGICPRLPTAGSR

SEQ ID NO: 43459 - DNA, 753 bp, Zea mays
  misc_feature: Ceres CLONE 1444121-F
  misc_feature: Encodes the peptide sequence at SEQ ID NO. 43460
  misc_feature (531)..(531): n is a, c, t, g, unknown, or other
  misc_feature (601)..(601): n is a, c, t, g, unknown, or other
  misc_feature (602)..(602): n is a, c, t, g, unknown, or other
  misc_feature (753)..(753): n is a, c, t, g, unknown, or other
ctggagctccccgcggtggcggccgctctagaactagtggatcccccgggctgcaggaattcgcacgagaccattacctagaacatcctaatcgaaaaaatacacgccagaaactaatccagatagctagcctttgatttctcacttcaatctgacgaagtgcacacctaggcaacaaactcgaacgcgcgcggtagtggagccgagatgcagggaggggcgacggccaagcagcaggcgcgagacggtgaccgcggcgcggcgaagacgccgacgacggaggggaagggcgacgccgccggcgccaaggctagcgccgacgtggcgaagggcgacgccgccgtcgccaaggctgctggggacgacgtcgtcgtagggaagggcgacgcaggcaacaaggccggcgcccgggccatgcaccacggcctggtcggccgtgggaggcgaaggactcccagaccatcgtcgcgctgcagtcgccggtgaccgtcatgcgccccgtccgcggcgacctcgaggagcacctccccnaagcatgtgagagcgcgcgcgcccgcacttcctctcgtcgctgaagcctgctgggtgctttgtacattgnntactactgatgacgcgtcgtcactgagacgaggacacagatctggcgcgagccctggtgccccggacatctaccacccgacggcaccgcggcgacgacacggccaccacacatgagcgtgttgagcgcacgtcgctttctcgaccgcacan

SEQ ID NO: 43460 - protein, 92 aa, Zea mays
  misc_feature: Ceres CLONE 1444121-F
MQGGATAKQQARDGDRGAAKTPTTEGKGDAAGAKASADVAKGDAAVAKAAGDDVVVGKGDAGNKAGARAMHHGLVGRGRRRTPRPSSRCSRR

SEQ ID NO: 43461 - DNA, 689 bp, Zea mays
  misc_feature: Ceres CLONE 1444126-F
  misc_feature: Encodes the peptide sequence at SEQ ID NO. 43462
  misc_feature (471)..(471): n is a, c, t, g, unknown, or other
  misc_feature (480)..(480): n is a, c, t, g, unknown, or other
  misc_feature (492)..(492): n is a, c, t, g, unknown, or other
aagctggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcgccggccgtngaagcggcngcggtggttacngtggtggccgtgaaggcggcggctacggcggtggcgggcgccgtgatggcggtggcggctacggcggtggcgcggctacggtgccggcggcgctacggtggtggggcggcggctaacgcggtggaaaccgtggcgcggtacgggaactcgacggaactgaagaactgaacggggggcccccccgccaaatatctgtt

SEQ ID NO: 43462 - protein, 135 aa, Zea mays
  misc_feature: Ceres CLONE 1444126-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (91)..(91): Xaa is any aa, unknown, or other
  misc_feature (94)..(94): Xaa is any aa, unknown, or other
  misc_feature (98)..(98): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRAGRXSGXGGYXGGREGGGYGGGGRRDGGGGYGGGAATVPAALRWWGGG

SEQ ID NO: 43463 - DNA, 754 bp, Zea mays
  misc_feature: Ceres CLONE 1444129-F
  misc_feature: Translation starting site: 170
  misc_feature (358)..(358): n is a, c, t, g, unknown, or other
  misc_feature (511)..(511): n is a, c, t, g, unknown, or other
  misc_feature (628)..(628): n is a, c, t, g, unknown, or other
  misc_feature (629)..(629): n is a, c, t, g, unknown, or other
ctccccgcggtggcggccgctctagaactagtggatcccccgggctgcaggaattcgcacgagaccattacctagaacatcctaatcgaaaaaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaangagcttgagttgaagaagagccatatgttgtggagcttgatcagcgagaggatggctcagagattcaggatgccttacttgagatagttggcaggcgtactgtcccctcagtttttgtccatgaaaagccactgggtggttctgacgatactngttgactccctacgaagtggaaaactgctagacttcttaaacatcggagtcaaggacgacctttgagtgacatgctacatcggtcagccctgttcgttggtttcaatccgtaccggnnctctaccactttataattgtttttggctccatggggataacagctacacaggctaaataactgattttatccggaagcaaacagccaaacagtctcttgttttgagtaacaaggaattttttggg

SEQ ID NO: 43464 - DNA, 784 bp, Zea mays
  misc_feature: Ceres CLONE 1444132-F
  misc_feature: Encodes the peptide sequence at SEQ ID NO. 43465
  misc_feature (374)..(374): n is a, c, t, g, unknown, or other
  misc_feature (432)..(432): n is a, c, t, g, unknown, or other
aaagctggagctccccgcggtggcggccgctctagaactagtggatcccccgggctgcaggaattcgcacgagaccattacctagaacatcctaatcgaaaaacgcaacaaagcatcttgagtgttcgacagcaagccatggagaagacatcagaaaacgccatcccgccggcggcatccccgctgatgctgttcgagtcgtgcgccagctcgtacacgcaccgggtgcagctggcgcagcggctcaagggcctggagtacgactacctggtacatgccctgggaaacaggagggacgagctgctgccgccacacccccgtcccaaggaagtgcccgtgctccgtcccggtggcagcgggttgccggatttggnacccatccgtcaggcccgggaaaacgtatggggagaaaccccccccttgttccccccnacacttttccccgaagccccctacggttccggggccacctcctcaaagaaagccttggtccggggatgggttttgttttccgtttaaggggctagggccctcaccctctgggggtagaggcctctaaagccggggagaattttgaaccggaaccacattcgggagggttcccggggtgactctctctttggggaagaaaaagtggaagctacctgttttttatttgggggaacactgtttctttttgtgccctcccgcccccgaggaaggtcccacgccgttgcctccccgctaacaccctatctttttctccgttttctcacactctatgttctctcctatataagacccc

SEQ ID NO: 43465 - protein, 126 aa, Zea mays
  misc_feature: Ceres CLONE 1444132-F
  misc_feature: SWISSPROT Homolog: EC 2.5.1.18 Glutathione transferase
  misc_feature (79)..(79): Xaa is any aa, unknown, or other
MEKTSENAIPPAASPLMLFESCASSYTHRVQLAQRLKGLEYDYLVHALGNRRDELLPPHPRPKEVPVLRPGGSGLPDLXPIRQARENVWGETPPLFPPTLFPEAPYGSGATSSKKALVRGWVLFSV

SEQ ID NO: 43466 - DNA, 764 bp, Zea mays
  misc_feature: Ceres CLONE 1444135-F
  misc_feature: Translation starting site: 313
  misc_feature (532)..(532): n is a, c, t, g, unknown, or other
aaagctggagctccccgcggtggcggccgctctagaactagtggatcccccgggctgcaggaattcgcacgagaccattacctagaacatcctaatcgaaaaaaccaaacctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgtttttttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcgcgcgcaactggacggcgatcgggcgcggcgtcccgggccggtcgggcaagtcgtgccgcctgcggtggtgcaaccagctgtcgccaagggtggcgcgccgcctctttcacgccgacaagaacgcgncatcgcccgcgcccacgcccgccctcggaaacggtgggccgccatcgcgcgcctgctccccgccgcaccgacaacgccgtcaagaaccactggactgctccctcaagcgcaagctcggcgccgccgccgccgcgtccgggttcgcggtttctgctgacgactccgccgccgccgccgagaccgaagcccgcgggggcaagataatgatgatgaccatctcgccgcccaacac

SEQ ID NO: 43467 - DNA, 755 bp, Zea mays
  misc_feature: Ceres CLONE 1444136-F
  misc_feature: Encodes the peptide sequence at SEQ ID NO. 43468
  misc_feature (396)..(396): n is a, c, t, g, unknown, or other
aagctggagctccccgcggtggcggccgctctagaactagtggatcccccgggctgcaggaattcgcacgagaccattacctagaacatcctaatcgaaaactagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctgggacgtcaccaagcgcgcccatcgcgtcaagatncaacagcaggttaatggccgcatcatcagggagccgatccatgtccgcgtggagcatgtgcagccctcccgttgcacgaaggatttcccttgaggaaagccaagaatgaccacctccaggcggaagcccaggcccccgggggaggtgatcccccccaaagggcggcctgggaaacccaaacctgggtttctgggtgagggggcttacttgaaaaaggcccccctttccctttagagggggcaaaaaatctcaggggggtttaaaaaaaaaatttttgtcccttcacgttttaaaaaggggggggaaattttggaaattttttggaatggggggggcccccccaaaaaaaaaaaaaaaat

SEQ ID NO: 43468 - protein, 106 aa, Zea mays
  misc_feature: Ceres CLONE 1444136-F
  misc_feature (2)..(100): Pfam Name: Ribosomal_L21e Pfam Description: Ribosomal protein L21e
  misc_feature (76)..(76): Xaa is any aa, unknown, or other
MPAGHGLRSRTRDLFARPFRKKGYIPLTTYLRTYKIGDYVDVKVNGAVHKGMPHKFYHGRTGSVWDVTKRAHRVKXQQQVNGRIIREPIHVRVEHVQPSRCTKDFP

SEQ ID NO: 43469 - DNA, 785 bp, Zea mays
  misc_feature: Ceres CLONE 1444138-F
  misc_feature: Translation starting site: 273
  misc_feature (482)..(482): n is a, c, t, g, unknown, or other
  misc_feature (785)..(785): n is a, c, t, g, unknown, or other
aagctggagctccccgcggtggcggccgctctagattcgtggatcccccgggctgcaggaatttttacgagaccattacctagaacatcctaatcgaaaaccgtgtcccgtcccgtctacgttttaagctgcgagcgagatctgctttcacagcgtggctgaccagcagatccgtcgttgccggaacccacgctcgccggctgcgaatgcatctgtagcctgctcttcgtccacacggacaattggacgagctagactctgcgtcgccggcgatggggtgctccttctcagggctgaacgcactgtacgacaccgtcggcgggcggggtggtgacgtctgggttaacgactaccccttccgctgtgttctgtttggtttgacaatgccggccctgcgggctcgtcggtttttaacgtccaccacccccacgccgccgtatacgtttccgacggcacggctggttcacaccccggcccctcanggaatccccggaaaaaaggcatcgacccctcccccatctcaactgacgggacctaggccctcaagaaaagtcctgttcacagtgattcgcacttaaactttgttaagcaagaatccgaatgtccttctcagttcacccatccaaatttacttccctcttcttggaacatgcccatccttgctgtccagaggtggttcggggatgggaccctaaaacttttgagggcctacttttttattccccgatcatttaagaaggaaacctttcctggatattacattaaaaccttggctggaaaaagan

SEQ ID NO: 43470 - DNA, 753 bp, Zea mays
  misc_feature: Ceres CLONE 1444139-F
  misc_feature: Translation starting site: 203
  misc_feature (518)..(518): n is a, c, t, g, unknown, or other
  misc_feature (519)..(519): n is a, c, t, g, unknown, or other
ctggagctccccgcggtggcggccgctctagaactagtggatcccccgggctgcaggaattcgcacgagaccattaactagaacatcctaatcgaaaaactccccagtccccatagactccagcctgagctgcaccgtgagcgctcgccgctccgcatcgccgtcccagtcccacaccccgcatccagcctgccccagcgtaatggcgcttcgccaggccgtcctcctggccgtggtcctcgccgcgctgctcccgctcgccctctctcgcgggttgggcttggtgcacgggcatgtgcggccgcacacgcacgggctggggctcggccaccaccacgcccagtcgcacccgcacccgctcgggcacgcaccgctcgtaggtggcgcgtggtcctctgctcacgccaccttctacggcggcggcgacgcgtccggcaccatgggtacgtgagctaaccccattctcgaacatttcgcctttactacccgtagactgcagtccccttccttcctagatnnctgggactgaattctgcatctggacgtgcgttcgtgcaggcggtgcgtgcgggtacggcaccctctacagccaggggtactgcaccaacaccggcgcgctgagcacggcgctcttcaacaacgggctcagctgcggcggctgcttccaggtgcgctgcgacgcggcggggggcgggagccactcgtgcctgccggggtccgtcgtggtgacgggcacaacttctggccgcccaa

SEQ ID NO: 43471 - DNA, 736 bp, Zea mays
  misc_feature: Ceres CLONE 1444140-F
  misc_feature: Translation starting site: 211
  misc_feature: Pfam Name: COX6B Pfam Description: Cytochrome oxidase c subunit VIb
  misc_feature: SWISSPROT Homolog: EC 1.9.3.1 Cytochrome-c oxidase
  misc_feature (494)..(494): n is a, c, t, g, unknown, or other
  misc_feature (632)..(632): n is a, c, t, g, unknown, or other
aagctggagctccccgcggtggcggccgctctagaactagtggatcccccgggctgcaggaattcgcacgagaccattacctagaacatcctaatcgaaaacccttttttattgctccgaaccccgagttgcgagctgtctcctccactctcctccttcactgtcgcagccgctccttgtagaagcttcgaggctgctgctgctgcgcccatggccgcggaaggcaagacgccgtccctcgccgaggagtattcacttccaccacaggaagttccagtggaaaaggcagctgaggagaagccctctagtggtactgagtctgaagctgctccctcaaccaatgatgaaactcctccatctgtagaagacaagaatggaacttctgaagtacaagatgctgctgaaaatccaaaggcagaagaaactaacactgctgcagaggaaacacctgctgtagaggaagcaagtgagactaccgaggaggaaagagctgnagaacctgagatcaagatcgaaacagctccagcagattttcgtttcccaacacaaaccaaacaaggcattgtttcacacgctatgttgaatatcacaggtgtgtggctgcaaaaggtgaggatgcacctgagtgtgantagtcgccaagtactatcgatccctgtgccccagtgaatgggttgatcgctggaacgagcaacgcgaaaaccgcaccttccctggacctctgtaatcctacaat

SEQ ID NO: 43472 - DNA, 832 bp, Zea mays
  misc_feature: Ceres CLONE 1444141-F
  misc_feature: Encodes the peptide sequence at SEQ ID NO. 43473
  misc_feature (382)..(382): n is a, c, t, g, unknown, or other
  misc_feature (383)..(383): n is a, c, t, g, unknown, or other
  misc_feature (386)..(386): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (832)..(832): n is a, c, t, g, unknown, or other
aattctggagctccccgtcagtggcggccgctctagaactagtggatcccccgggctgcaggaattctcacgagaccattacctagaacatcctaatcgaaaaggcggtgcaggtcctcctccatctctgtcgtgggttcaacttcactgtgaatacgctgacgctacgagaagtcatcacggaaggggtctcgaagcaaggtgcaaagactcacctgccgtctctgatgggctttgctggctgggtatccatgctgctcttcctcctggtcgccggtgctgtagcaaatggaccagatcttcaccacttcaggtgtgccatttgggcggagttcgcgtgagccaagttaccgcgtcgaattccatcctgttgatttaaatnnaanccagagaatgggcaaaaatcnnnaccaatggcttaccaccacgcgaaacgttataaatggcttttctcccagtttgaagaaacctaaaccatgaaacccaatgctttccggaaaaagcaactaaaggttataaaagaaagcgaaaggagaatttaccccaacggagccaaaggattcccttggaggttctccaaggaccatgggcttctacagggatcgaaggttggtgggccgtaatgaattcctgttattatttggaaaaatctacggcacggcccaatgtagaccaaacaaataacgttttaccccaaaattatttttcctaagcgcaaatttccgaatgacacacccccgacctggctggtcttatccaaaggaaaaaatttccccttctctgaagagttagtgttcaccgcagcgacccctttcattggtgcagaccattn

SEQ ID NO: 43473 - protein, 37 aa, Zea mays
  misc_feature: Ceres CLONE 1444141-F
MGFAGWVSMLLFLLVAGAVANGPDLHHFRCAIWAEFA

SEQ ID NO: 43474 - DNA, 748 bp, Zea mays
  misc_feature: Ceres CLONE 1444144-F
  misc_feature: Encodes the peptide sequence at SEQ ID NO. 43475
  misc_feature (748)..(748): n is a, c, t, g, unknown, or other
aagctggagctccccgcggtggcggccgctctataactagtggatcccccgggctgcaggatttcgcacgagaccattacctagaacatcctaatcgaaaaaggcccagcatccagttacagtccggagtctggttagtactccgcatgttcgttttttttacgccgacagaaatcaacctgcgccgctgccttctccgttctcgccgtcgcctccgcctccgctgccgccgcgcaggtcagggtcatgtcgatcttcgagtacaacgggagcgccgtggtggcgatggtggggaagaactgcttcgcgatcgccagcgaccgccgcctcggcgtgcagctgcagacgatcgccaccgacttccgaggggtgttcaaggtccacgacaagctctacatcgggctctcggtcctccccaccgacgcccagacgctgtatcagcggctggtgttcaggcacaagttgtaccagctgagggaggagagggacatgaagcccgaaacctttgccagccttgtttcagccctcctctatgagaaaaggtttggaccatacttctgccaaccagttattgctggcctaggagacaacgatgagccgtttatatgtaccatggactgcattggtgccaaggaactaccaaaagattgtgtggtctcaggaactgcttcagagtcactttatggtgcttgtgagtccatgtataagcccaacatggaatccgaaaaacttttcgagacaatctcgn

SEQ ID NO: 43475 - protein, 167 aa, Zea mays
  misc_feature: Ceres CLONE 1444144-F
  misc_feature (5)..(166): Pfam Name: Proteasome Pfam Description: Proteasome A-type and B-type
  misc_feature: SWISSPROT Homolog: EC 3.4.25.1 Proteasome endopeptidase complex
MSIFEYNGSAVVAMVGKNCFAIASDRRLGVQLQTIATDFRGVFKVHDKLYIGLSVLPTDAQTLYQRLVFRHKLYQLREERDMKPETFASLVSALLYEKRFGPYFCQPVIAGLGDNDEPFICTMDCIGAKELPKDCVVSGTASESLYGACESMYKPNMESEKLFETIS

SEQ ID NO: 43476 - DNA, 716 bp, Zea mays
  misc_feature: Ceres CLONE 1444149-F
  misc_feature: Encodes the peptide sequence at SEQ ID NO. 43477
aaagctggagctccccgcggtggcggccgctctatactagtggatcccccgggctgcaggatttcgcacgagaccattacctagaacatcctaatcgaaaaacaccaacaccactttttaccacctgcgcatcttctttccgagcagtacgtacgtagctgaattgctgaaaagagaggcagagatccgatccggaccgcgaagagacgatgactcacccgaggccggatcatgaaccgtcgggcgaggtgtcgctggcgctggcgctgagcacggactcgtccggctccgcaggtgccccggcggcgaagcgggcgcggcggaggggcgccgcggcggccacgtcgggggagggggagtttgtgtgtaggacctgcagccgcgccttcacctcgttccaggcgctcggcggccaccggaccagccacctgcggggccgccacggcctcgagctcggcgtcggcgccagggcgctcagccggcagcagcacaagcatcatcatcaggccggcggcggaggagacagggagccgcaggcgcagcacgagtgccacgtctgcgggctcggcttcgagatggggcacgcgctgggcggccacatgaggcggcaccgcgaggagacgacgacgggcgccgccgatgcctgggtctggcgcgccgacgacgcgctgcagcggggccgcgggggccgcgccgaaccgcccgtcttgctcgag

SEQ ID NO: 43477 - protein, 169 aa, Zea mays
  misc_feature: Ceres CLONE 1444149-F
  misc_feature: The sequence is a functional homolog of SEQ ID NO 1288 in the 10/666,642 US patent application
  misc_feature: The sequence is a functional homolog of SEQ ID NO 622 in the 10/374,780 US patent application
MTHPRPDHEPSGEVSLALALSTDSSGSAGAPAAKRARRRGAAAATSGEGEFVCRTCSRAFTSFQALGGHRTSHLRGRHGLELGVGARALSRQQHKHHHQAGGGGDREPQAQHECHVCGLGFEMGHALGGHMRRHREETTTGAADAWVWRADDALQRGRGGRAEPPVLLE

SEQ ID NO: 43478 - DNA, 757 bp, Zea mays
  misc_feature: Ceres CLONE 1444150-F
  misc_feature: Encodes the peptide sequence at SEQ ID NO. 43479
  misc_feature (659)..(659): n is a, c, t, g, unknown, or other
ggagctccccgcggtggcggccgctctagaactagtggatcccccgggctgcaggaattcgcacgagaccattacctagaacgtcctaatcgaaaaatcgatttccctagctagccgcagatcctacgcgccgtgcgcgcggccgcctccatggcgactctcaaggatctcctaccggcgcccaagacgtcggcgtccaccttctacgaccatagtagcgacccctggttcaaggagcggtacggcggggagtcggcgcaggcggccgcggcagcgaggcccgcggccgccgccaggctcatgcctccgtacgggaagcgagcggggttcgtgccgagacggccggaggactttcgggatggcggcgccttccggagatccacgtcgcgcagtacccgctcggcatgggacgccgcgacgaatagggcgggtccaggatccttgcgctcaccgtcgacgcacacgggagcgtcgccttcgacgccgtcgtcaagcagggggagaaccaggcaagatcgtgtactccaagcataacgacctcgtggcgaagaaagccactgccgattctccggcgatgtccaaccagggagagggaccaaaccccaatcggggaaccccctgaaacggaccaaggcccccttggaaaaggtttgttaagntccccctttttggaagttaaacccagaaagtggcccaccatgaatttggaaccccgtttccccaagttaaaccggcccaaaaatcccgggctttaatt

SEQ ID NO: 43479 - protein, 127 aa, Zea mays
  misc_feature: Ceres CLONE 1444150-F
MATLKDLLPAPKTSASTFYDHSSDPWFKERYGGESAQAAAAARPAAAARLMPPYGKRAGFVPRRPEDFRDGGAFRRSTSRSTRSAWDAATNRAGPGSLRSPSTHTGASPSTPSSSRGRTRQDRVLQA

SEQ ID NO: 43480 - DNA, 758 bp, Zea mays
  misc_feature: Ceres CLONE 1444151-F
  misc_feature: Translation starting site: 349
  misc_feature: Pfam Name: PK Pfam Description: Pyruvate kinase, barrel domain
  misc_feature: SWISSPROT Homolog: EC 2.7.1.40 Pyruvate kinase
  misc_feature (667)..(667): n is a, c, t, g, unknown, or other
ggagctccccgcggtggcggccgctctattaactagtggatcccccgggctgcaggaattcgcacgagaccattacctagaacatcctaatcgaaaaatccagtcctggagcctgcgcggctgcgccttgcatcgcatctccgtcgtcgtcctcgcccacggaatccgtccaattccccacgccgcccgtcgtccttttctataaaattcactccgccaccaaatctcgaatccccatcgcgctgcttttccaccgaccccgacgccgacgccgacgccaccgccgctccctccccagtccccactccccttcccgggccgcggagcagagatccggggcgccgcgcgatggcgaacatcgacatggcgaagatcctggcggacctggaccgcggcgccagcggcggcgacgcgcgggtgcccaagaccaagctcgtatgcacgctcggcccggcctcccgcaccgtgcccatgctcgagaagctgctccgcgccggcatgaacgtcgcgcgcttcaacttctcccacggcacccacgagtaccaccaggagacgctcgacaacctccgccaggcatgcacaacacccgcatcctctgcgtcgtcatgctcgacaccaagggtcctgagatccgtacagggtttttgaaagatggtaaaccgattangctacccagagtcaagaatcactgtcaccactgattatgatatcaagggtgacgaaaatacgattgctttgaattaacagaactgcctgtt

SEQ ID NO: 43481 - DNA, 759 bp, Zea mays
  misc_feature: Ceres CLONE 1444155-F
  misc_feature: Encodes the peptide sequence at SEQ ID NO. 43482
  misc_feature (581)..(581): n is a, c, t, g, unknown, or other
  misc_feature (643)..(643): n is a, c, t, g, unknown, or other
  misc_feature (644)..(644): n is a, c, t, g, unknown, or other
  misc_feature (649)..(649): n is a, c, t, g, unknown, or other
  misc_feature (683)..(683): n is a, c, t, g, unknown, or other
  misc_feature (686)..(686): n is a, c, t, g, unknown, or other
  misc_feature (689)..(689): n is a, c, t, g, unknown, or other
aagctggagctccccgcggtggcggccgctctagaactagtggatcccccgggctgcaggaattcgcacgagaccattacctagaacatcctaatcgaaaaaactccccgtcgcgctttctcctagtgaggctactgggtgaccgccgcctctgccgccctacgccaggttccaggtcttcgtcactccctttcattatcttcgtcgtctcattcgccggcgacgagcacccaccagaaatcatagctgctttgggtatggaggcgctgtttgggagcaataaccatggcggccacaaggccgctgatttggcctcgcttataattacccaggttgccttggaggtgccaaggttacttgggctccttgccatgattctgcataatgaaatctttacatctggtggagaccagaatttgattactaggattctgggcaaaagcgaagatgaaactaatcctgagaaacaagatgatggagagtccgatgatgataatgatgatgaaggagacgatgatgatgctgaaaacgaggaggaagatgatggtggtgatgagggatcagatgaacatgagaatgangaagatgacgatggagatgatgatgatcctgcagccaatggcggaggggggaagcgatgacnnacaanatgattggtggagaggatgaagaggatgatgacnacnacnaccatgatggggacgatggcaatgagggagaggaggagaaatcctgagaggatgatgatgatgatgaatc

SEQ ID NO: 43482 - protein, 127 aa, Zea mays
  misc_feature: Ceres CLONE 1444155-F
  misc_feature (108)..(108): Xaa is any aa, unknown, or other
MEALFGSNNHGGHKAADLASLIITQVALEVPRLLGLLAMILHNEIFTSGGDQNLITRILGKSEDETNPEKQDDGESDDDNDDEGDDDDAENEEEDDGGDEGSDEHENXEDDDGDDDDPAANGGGGKR

SEQ ID NO: 43483 - DNA, 731 bp, Zea mays
  misc_feature: Ceres CLONE 1444157-F
  misc_feature: Encodes the peptide sequence at SEQ ID NO. 43484
aagctggagctccccgcggtggcggccgctctagaactagtggatcccccgggctgcaggaattcgcacgagaccattacctagaacatcctaatcgaaaacacactactttccctcgtgcggccgccgccctacaacaggtgccccaggtcttcgctgcgccattcgccagcgacgagcacccaacaggctcagaaacatcgctgacatccacatgcaccacagtagttcagtagagtagctgttggaacccacacaccggcgatggcaactgctcctgtgacatcctccatggctacgaactccacctgtgtgcggctgcctagcatgcccctgaggcgtgcacccgccatcgtctcctttgcctctcgtcgtacgccatggtcaacccgcatgacctcatgtactggattgtcgcggcactctgatgtggttgccgcgcggggcaccagaagttgatggggtctttgaacacaacgagggactcatgtttggggtggttgtgggcacgttcaacgaggtcgtgacaatttgttactacagggtgccctggaaactttcgagcgatactctgttaaagcagaaaatataacagtgttagtgttcctgaaactttgaagttcctatacgggcacaaagcttgggaatctggaaatttgatgcaattctgtgcatggagctgtgattaaagtgaacaacccacttgatgccgtgcaaactcactgcatcag

SEQ ID NO: 43484 - protein, 64 aa, Zea mays
  misc_feature: Ceres CLONE 1444157-F
MATAPVTSSMATNSTCVRLPSMPLRRAPAIVSFASRRTPWSTRMTSCTGLSRHSDVVAARGTRS

SEQ ID NO: 43485 - DNA, 806 bp, Zea mays
  misc_feature: Ceres CLONE 1444161-F
  misc_feature: Encodes the peptide sequence at SEQ ID NO. 43486
  misc_feature (187)..(187): n is a, c, t, g, unknown, or other
  misc_feature (259)..(259): n is a, c, t, g, unknown, or other
  misc_feature (268)..(268): n is a, c, t, g, unknown, or other
tggagctccccgcggtggcggccgctctagaactagtggatcccccgggctgcaggaattcgcacgagaccattacctagaacatcctaatcgaaaagaagggtcgaactaggcccgtcagagaatcagagctctgaggctgctcacatcaggccaccaccaacccctcacgtcggcggtggcgtcntcggcgaaggcagagatggcgtccgtggccgcggcggaggtcgcggcggcggcgctcccggtcgtgctgtcncgcgcgcancaggcggcggcgccgggcgggcccgccccggggtccgtgcgcgtggtggcggtgaacaaaacaagccgggtgcctgtcatccggggcgtctacgacgcgggccaccgctgcttcggcgaagactacctccagggagctcatcgaacaagccgcctcagcttccctgaggatatggaggtggcactcccattggaaatctgcaaaacaaccaaagccagagcccctactggctggcgtggccaaacccttgattttggttggagagtgtcgtatgaattaaaaaaattgcctaaaccttctttgatcgagttggaaacctgaccttggggaagaaaaccccctttagggttttggcccaagtcaacccctggggggaaaaaaaacccaaattttgggagaaatcccctccgggagcctgggaacttggcaaagcctttcaaaactgaacccgccccgaacccttggggtcccccgggccgataaaaaatttggaatgctttaaatcccccccccaacccctgaaaatttcaaggcgctg

SEQ ID NO: 43486 - protein, 128 aa, Zea mays
  misc_feature: Ceres CLONE 1444161-F
  misc_feature (22)..(22): Xaa is any aa, unknown, or other
MASVAAAEVAAAALPVVLSRAXQAAAPGGPAPGSVRVVAVNKTSRVPVIRGVYDAGHRCFGEDYLQGAHRTSRLSFPEDMEVALPLEICKTTKARAPTGWRGQTLDFGWRVSYELKKLPKPSLIELET

SEQ ID NO: 43487 - DNA, 749 bp, Zea mays
  misc_feature: Ceres CLONE 1444163-F
  misc_feature: Encodes the peptide sequence at SEQ ID NO. 43488
  misc_feature (342)..(342): n is a, c, t, g, unknown, or other
  misc_feature (348)..(348): n is a, c, t, g, unknown, or other
tggagctccccgcggtggcggccgctctagaactagtggatcccccgggctgcaggaattcgcacgagaccattacctagaacatcctaatcgaaaaaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctcccacatccgaccgccatccacaacctaggcgggtctgccacgctgccggacctcgtgggcgcgctgtccctgccaagcgcccagctccccgntcctcnggcgcgtgatgcggctgctggcccgtcggggggtcttcccgtcgtccaagacgtgaagacccccctaaacccttttcctggttgctggtgaaggcgggaaatccgagaccccaccttccaaagtcttttggctgggaccgctcccccccctacgggaggccggttttccctggccaaatggtaaaaaaagaagaagaaagaaccccccccttccctccctttttaaggcgccgaaggggggccccctcccccaaaaaacacacattttttaaaaaaaatttaaaaaggtcctaagaaaaaggttgcccccaaaaaaaactttttttggagaattaaaaaggggggggggcccactatttttggcgcgccctccccctccccctgtgggggcgggggagaaa

SEQ ID NO: 43488 - protein, 100 aa, Zea mays
  misc_feature: Ceres CLONE 1444163-F
  misc_feature: SWISSPROT Homolog: EC 2.1.1.146 (Iso)eugenol O-methyltransferase
  misc_feature (69)..(69): Xaa is any aa, unknown, or other
  misc_feature (71)..(71): Xaa is any aa, unknown, or other
MATAIVPTDAELLQAQADLWRHSLYYLTSMALKCAVELPHPTAIHNLGGSATLPDLVGALSLPSAQLPXPXARDAAAGPSGGLPVVQDVKTPLNPFPGCW

SEQ ID NO: 43489 - DNA, 770 bp, Zea mays
  misc_feature: Ceres CLONE 1444164-F
  misc_feature: Encodes the peptide sequence at SEQ ID NO. 43490
  misc_feature (315)..(315): n is a, c, t, g, unknown, or other
  misc_feature (364)..(364): n is a, c, t, g, unknown, or other
  misc_feature (413)..(413): n is a, c, t, g, unknown, or other
ggagctccccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccnggccataccatgaggtaccacaagggcgcgctcctgtcgggccccatcngcgtcaacttcatctgggacggcgacttctcggcgccgcagcgggccgncaatcacggactccgtgtcctcgctgaacggcgcggcggccccgggcgcggggcaaccggaagccgtccgtgcccacgtggtttcaagacggggcgcaagtactaccccggctccaaggtgccgtttccgggggttgcgcctcggttcccacgccgtcgaacgggaactgttccctcgggaaggccctgaccggaagggaactgctccgggtccgcccgcaggggggcccccagccccgccttcaacctggttgtcccgggaacccaactgggcctaaaggggttctgcgaatcccgggggggaacgaacgggggggcccccggtccccccccgggcggtttcggaactggggggcc

SEQ ID NO: 43490 - protein, 131 aa, Zea mays
  misc_feature: Ceres CLONE 1444164-F
  misc_feature (53)..(53): Xaa is any aa, unknown, or other
  misc_feature (69)..(69): Xaa is any aa, unknown, or other
MACYNTASLAATLLAFALTFQACLAGRRLTALVQEPGHTMRYHKGALLSGPIXVNFIWDGDFSAPQRAXNHGLRVLAERRGGPGRGATGSRPCPRGFKTGRKYYPGSKVPFPGVAPRFPRRRTGTVPSGRP

SEQ ID NO: 43491 - DNA, 756 bp, Zea mays
  misc_feature: Ceres CLONE 1444165-F
  misc_feature: Translation starting site: 126
  misc_feature (436)..(436): n is a, c, t, g, unknown, or other
aaagctggagctccccgcggtggcggccgctctagaactagtggatcccccgggctgcaggaattcgcacgagaccattacctagaacatcctaatcgaaaacacgtgacaggatctgtgccgcgatggcgacgtcgaacaccgcgcggatggagggacggcggcggcaacctgagaacaccatcaagaagtggaacatcatctaccctgtctacctcaactccaagaagacggtcgccgagggccgccgcatcgccgctgccaaggcctgcccgggaccccacctgcatcgagatcgctgactgcttgtcgcacctcaagatcccccacgccatcgagttggataaggcgtaccctcgggatttcttccagggggccagggtcagggtgcaccttaaaaagatgacggctccccccccaatcttggttttaaaangaagaagcagctgatgatccaggtagcaacctagctcccaagcttcagggagggaaaagaagcgggagccaccccccattcccggtggcgttcaaaaaaccaaaaggcggggaaaaaaaaagggctggcccaccctgggtttcttttaatcggggcgcccacccacacccagcttccgtgaaaaaggaaagccttgggcctgtttttcacacaaaaaaaaaaaggtttctcgtccccgccgccccggggggggccccctcccctttcccccctagtgggccttctgcgggctctggggcccgtgttcacacccgctgggg

SEQ ID NO: 43492 - DNA, 793 bp, Zea mays
  misc_feature: Ceres CLONE 1444171-F
  misc_feature: Encodes the peptide sequence at SEQ ID NO. 43493
  misc_feature (301)..(301): n is a, c, t, g, unknown, or other
aagctggagctccccgcggtggcggccgctctagaactagtggatcccccgggctgcaggaattcgcacgagaccattacctagaacatcctaatcgaaaaaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtgggcggagctggagagncgggcgacgaccatcgcgttcacgccgctgcaccagcgggagacggacgagctgtcgggggcggtgcagctgccggactcgtcggccggcggcccggggctccctggaaggtccccctcccctacgccgaacgtcgaacgcgccgtaccagcccccgccgtgaacaaacgggccggtggccctgaaccccccggaagaaaaacccctgggggccaaaattccggtttctgggggaaaatggacggaaaacttcggggcatcccgaggtactgggaaagaaaatcccatttccgctggcccccccctgaaaaaaacggaccgcctttccccggggggggcccgaaaaaacacccttcacccgggcaccaaaaaaaaatacctttgcccacacttttttttttggggaggaaaacaccccaaaaataataaaaagaccccgcggaaaaataaaaaaaaaaacccccctccccccttttttataaagcaaaaaaa

SEQ ID NO: 43493 - protein, 190 aa, Zea mays
  misc_feature: Ceres CLONE 1444171-F
  misc_feature (49)..(49): Xaa is any aa, unknown, or other
MASGGPKPKLAYIILYVRDVEKAASFYDAAFGYTVRRLDQFRKWAELEXRATTIAFTPLHQRETDELSGAVQLPDSSAGGPGLPGRSPSPTPNVERAVPAPAVNKRAGGPEPPGRKTPGGQNSGFWGKMDGKLRGIPRYWERKSHFRWPPPEKNGPPFPGGGPKKHPSPGHQKKIPLPTLFFLGRKTPQK

SEQ ID NO: 43494 - DNA, 775 bp, Zea mays
  misc_feature: Ceres CLONE 1444172-F
  misc_feature: Encodes the peptide sequence at SEQ ID NO. 43495
aaagctggagctccccgcggtggcggccgctctagaactagtggatcccccgggctgcaggaattcgcacgagaccattacctagaacatcctaatcgaaaaatttttgccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgtcccctaccgtccttccttatcgcgcaccgctccatggccgccaagtgggcccagaagacccgtcgtatcccggcgcatcggcggggctgcccactcatcacccccaagattctgagggagatcaagggcgacctggccgggttcaacccccccctcgcgcatttcttcctttcagaaaaaaggcgcttcctgaccttcaccaaaactttgactctgatgggcaggtgaaatcgaaaattttcttaaaaaaaattgtccaaaagggccacaaggttcctgggaaacccattgggaaggccctaaaatacccccccccacaaataaaaacctcttgggtgggggggtccccaaaaaattccaaatagggagggggcctcaaaaagggcctcttgggggaattttttgtttgaaaaaaaaaaacctcgccccccccaaaaaatggatttccctccgcgggggtgatataaaaatattattctcccccgaaaaagggcccatatttttttccatt

SEQ ID NO: 43495 - protein, 64 aa, Zea mays
  misc_feature: Ceres CLONE 1444172-F
MAAKWAQKTRRIPAHRRGCPLITPKILREIKGDLAGFNPPLAHFFLSEKRRFLTFTKTLTLMGR

SEQ ID NO: 43496 - DNA, 774 bp, Zea mays
  misc_feature: Ceres CLONE 1444173-F
  misc_feature: Encodes the peptide sequence at SEQ ID NO. 43497
  misc_feature (642)..(642): n is a, c, t, g, unknown, or other
aaagctggagctccccgcggtggcggccgctctagaactagtggatcccccgggctgcaggaattcgcacgagaccattacctagaacaccctaatcgaaaatctacgatgagaccgatggggctgatgggtatgtctccgtggaggtgtctcctaggttggcaaatgacactcaaggaactgttgaggcggcaaagtggttacacaaagtggtcaaccgccccaatgtctacataaagatccctgctaccgccgaatgtgttccttccatccgggaagttatcgctaatggcattagcgtcaacgtcacgcttattttctctattgcgacatacgaggctgtgattgatgcttaccttgatgggctagaggcttcgggcttgagcgacttatctcgagttaccagtgtcgcatccttctttgtcagccgagtcgacacccttatcgacaaaatgcttgaaaagattggaacacctgaggcacttgcctttgagaggaaggctgccgtcgcacaggccaaactagcaaatcggctctaccagaagaaattctctggccccaaggtgggaagccttggcccaagaaaggtgcccagaaaccagaggttggttgtgggcatccaccgggtgtcaaggaccccancttatcccaaccctctttacatcgacagtctccattggacctgacacggtccacacgaatgcccgaacaaacttttgcagggattcctagacccacggccttttctcaaggaaaatttgattgcaattgggt

SEQ ID NO: 43497 - protein, 77 aa, Zea mays
  misc_feature: Ceres CLONE 1444173-F
  misc_feature: SWISSPROT Homolog: EC 2.2.1.2 Transaldolase
  misc_feature (64)..(64): Xaa is any aa, unknown, or other
MLEKIGTPEALAFERKAAVAQAKLANRLYQKKFSGPKVGSLGPRKVPRNQRLVVGIHRVSRTPXYPNPLYIDSLHWT

SEQ ID NO: 43498 - DNA, 756 bp, Zea mays
  misc_feature: Ceres CLONE 1444175-F
  misc_feature: Encodes the peptide sequence at SEQ ID NO. 43499
  misc_feature (361)..(361): n is a, c, t, g, unknown, or other
  misc_feature (535)..(535): n is a, c, t, g, unknown, or other
  misc_feature (537)..(537): n is a, c, t, g, unknown, or other
  misc_feature (539)..(539): n is a, c, t, g, unknown, or other
tggagctccccgcggtggcggccgctctagaactagtggatcccccgggctgcaggaattcgcacgagaccattacctagaacatcctaatcgaaaaaaatcgacgaattcttcccccctctccgatctcgacgcgcaccgatgcgggcgatgtcgtcggcggttaatggtatgctgcgggcacggctgcgcggggcagcgcgcgttcgcggcggcggcggcgagggggccgggcggtggacgaccccaggtcacgaggagcgccccaaggggtacctcttcaaccggccgccgccgcctccgggggaatctcgcaagtgggaggattgggagctgccctgctacgtgacctccttcctcnacgtcgtcatcctcggcgtcggcctcaacgcgaagcccgaccttacaacccacacgtgggcgcaccagaaggcgctcgagcgcctccagcagcaggagctcgccgctgccgacacccaggccgagtgatccgcgcgtctcaggtcctctcgaactctcggctgcctctgatttngntnccataggatggccacaatgtgcggtcctgaatgttctggacttctggtattgatggaacacgagctgaacactatgctgctgttttttctgttctgttttgaaatttgcccggtgatgatggcgaatgtcctgaatattctgaatattttgaaatgtttgacggttgtattatcatcttatccttccggtggactaccgcttgagcccatttaggat

SEQ ID NO: 43499 - protein, 115 aa, Zea mays
  misc_feature: Ceres CLONE 1444175-F
  misc_feature (74)..(74): Xaa is any aa, unknown, or other
MRAMSSAVNGMLRARLRGAARVRGGGGEGAGRWTTPGHEERPKGYLFNRPPPPPGESRKWEDWELPCYVTSFLXVVILGVGLNAKPDLTTHTWAHQKALERLQQQELAAADTQAE

SEQ ID NO: 43500 - DNA, 748 bp, Zea mays
  misc_feature: Ceres CLONE 1444176-F
  misc_feature: Encodes the peptide sequence at SEQ ID NO. 43501
  misc_feature (233)..(233): n is a, c, t, g, unknown, or other
  misc_feature (235)..(235): n is a, c, t, g, unknown, or other
  misc_feature (238)..(238): n is a, c, t, g, unknown, or other
  misc_feature (349)..(349): n is a, c, t, g, unknown, or other
  misc_feature (385)..(385): n is a, c, t, g, unknown, or other
  misc_feature (386)..(386): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (449)..(449): n is a, c, t, g, unknown, or other
gctcttaactagtggatcccccgggctgcaggaattcgcacgagaccattacctagaacatcctaatcgaaaaattaaagtcccgtccgcggctccgccctcctctgtgtcttccttccacctgaaaacccaacccacacgctcgcgcctccgcgaagaaaaacaccgaggcccatggcgccgagaacgtcacagagagcgatgacatcggcggccgcggggctcgcgcgtgncnccngcccgcactacagaggcgtcaggaagcggccgtggggccggtacgccgcggagatccgcgacccggccaagaagagccgcgtgtggctcggcacgttcgacacgttttaanaacgccgcgcgggcctacgacgccggggtgtgtgannacgtgccccccccannncaaaaacaacttctccttccctgcgcgcctgccgctcccccccccnaaactggccggcgcctgcgggaccgggcaacggaaggagcaccaacaccaccaccaacggtcgactccttcggcggcgaaatggaaggggcgcgcccatgcagggcggtgccgctcccccccgtccttcttgcccccccggggcccgcaccgcttgctctttcagggagcttcccccgcgaacgaacccccgccccccctacttgccggctagcgggcccccaggggcgcactgtcctccgcaagcgggcccgcgccaaccggggccgtgggggctctggcgcgcgctctgaactcttt

SEQ ID NO: 43501 - protein, 57 aa, Zea mays
  misc_feature: Ceres CLONE 1444176-F
  misc_feature (23)..(58): Pfam Name: AP2 Pfam Description: AP2 domain
  misc_feature: The sequence is a functional homolog of SEQ ID NO 1158 in the 10/374,780 US patent application
  misc_feature: The sequence is a functional homolog of SEQ ID NO 1361 in the 10/412,699 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 147 in the 11/479,226 US patent application
  misc_feature: The sequence is a functional homolog of SEQ ID NO 2214 in the 10/374,780 US patent application
  misc_feature: The sequence is a functional homolog of SEQ ID NO 692 in the 10/225,066 US patent application
  misc_feature: The sequence is a functional homolog of SEQ ID NO 2818 in the 10/374,780 US patent application
  misc_feature: The sequence is a functional homolog of SEQ ID NO 688 in the 10/225,066 US patent application
  misc_feature (20)..(20): Xaa is any aa, unknown, or other
  misc_feature (21)..(21): Xaa is any aa, unknown, or other
  misc_feature (22)..(22): Xaa is any aa, unknown, or other
MAPRTSQRAMTSAAAGLARXXXPHYRGVRKRPWGRYAAEIRDPAKKSRVWLGTFDTF

SEQ ID NO: 43502 - DNA, 765 bp, Zea mays
  misc_feature: Ceres CLONE 1444181-F
  misc_feature: Encodes the peptide sequence at SEQ ID NO. 43503
  misc_feature (415)..(415): n is a, c, t, g, unknown, or other
  misc_feature (419)..(419): n is a, c, t, g, unknown, or other
  misc_feature (507)..(507): n is a, c, t, g, unknown, or other
  misc_feature (647)..(647): n is a, c, t, g, unknown, or other
  misc_feature (648)..(648): n is a, c, t, g, unknown, or other
  misc_feature (756)..(756): n is a, c, t, g, unknown, or other
ctggagctccccgcggtggcggccgctctagaactagtggatcccccgggctgcaggaattcgcacgagaccattacctagaacatcctaatcgaaaagctccccttcgttcacctcgcgtacgcgacaaactaggccgaccgccgccgccctacgctcagctgcccacctgccctggtcttcgactcttcgtcgtgcgctttgccggcggcgagcacccatcacaccaggtgctttattgggtccgtccatacggcaggatggcgctaaggggggtctggcagctgcagaagctcgtggtaaactactgcgactggggagggagcagcaggggcatcagggccttcatggaggcacatcttccagcctttaaggaaaagaatccacacttagaggtggtgacagagcttgtccncggncaacatcctaacttgaagggaatttacaaaaaccataacgagcgagtggtatgcgtgagaaatttaccgccagaggaaatactcctgncagccaccaggctaaggaactctctggggcaggaaagtggtgaagctgcggaccagacatgtaacgaaacgccccagtgttcaggggacgtggacgaacgaactgaagatgtgaagcaacaagccaagggtgttcattgnntctttgggggtctgattgcagaaaatgtcagctgtgtcgataacttttggtagagctgccgttaggctttgctgtttgaatagctaaaccgttactcccatttgtccngagtacatt

SEQ ID NO: 43503 - protein, 146 aa, Zea mays
  misc_feature: Ceres CLONE 1444181-F
  misc_feature (18)..(91): Pfam Name: L51_S25_CI-B8 Pfam Description: Mitochondrial ribosomal protein L51 / S25 / CI-B8 domain
  misc_feature (52)..(52): Xaa is any aa, unknown, or other
  misc_feature (83)..(83): Xaa is any aa, unknown, or other
  misc_feature (129)..(129): Xaa is any aa, unknown, or other
  misc_feature (130)..(130): Xaa is any aa, unknown, or other
MALRGVWQLQKLVVNYCDWGGSSRGIRAFMEAHLPAFKEKNPHLEVVTELVXGQHPNLKGIYKNHNERVVCVRNLPPEEILLXATRLRNSLGQESGEAADQTCNETPQCSGDVDERTEDVKQQAKGVHXXFGGLIAENVSCVDNFW

SEQ ID NO: 43504 - DNA, 748 bp, Zea mays
  misc_feature: Ceres CLONE 1444184-F
  misc_feature: Encodes the peptide sequence at SEQ ID NO. 43505
  misc_feature (294)..(294): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (331)..(331): n is a, c, t, g, unknown, or other
  misc_feature (340)..(340): n is a, c, t, g, unknown, or other
  misc_feature (628)..(628): n is a, c, t, g, unknown, or other
  misc_feature (629)..(629): n is a, c, t, g, unknown, or other
ctggagctccccgcggtggcggccgctctagaactagtggatcccccgggctgcaggaattcgcacgagaccattacctagaacatcctaatcgaaaattccagaacgttcggcggcggcgaggcgacacgcccaccaccagtcagccgccccgccacagccatgcgcctccacgccggcgtacgcctcgcgctcctgctcgcccgccgctccctctcctcctctccccgtatcccgcgggtgcacacagggatacggagcgaggcgcccctcccggagctctccttctatccngcgagcagcgcccgcaggtccttccacggnnnacagnctggtggcngcaaggaactactacgatgtgctcgccgtcagcaagagcgccagcaagcggaaataaaaaggcctaataccgcctgcaaaagagctccctccaaaccaataaaggtgatcgcaagcaaaaccaattttcaaaggttcaccgacttttgaacccttaagggggaacaaaaaattctttttttgaacgggtggccccaaaaaaaaaaaaaaaacccttctggagaaggaaaatggtttccaggggggtttttaaaaccctttaagaaattttttgggggccccccccccnnaaaaaaaaaattttttctaaaaaatttttggggagggggcctttaagaaagagagggtgggggcccccccccactcttttttagaaaaatttgggggggaaaaaaaaccctctcccctc

SEQ ID NO: 43505 - protein, 108 aa, Zea mays
  misc_feature: Ceres CLONE 1444184-F
  misc_feature (55)..(55): Xaa is any aa, unknown, or other
  misc_feature (57)..(57): Xaa is any aa, unknown, or other
  misc_feature (60)..(60): Xaa is any aa, unknown, or other
MRLHAGVRLALLLARRSLSSSPRIPRVHTGIRSEAPLPELSFYPASSARRSFHGXQXGGXKELLRCARRQQERQQAEIKRPNTACKRAPSKPIKVIASKTNFQRFTDF

SEQ ID NO: 43506 - DNA, 738 bp, Zea mays
  misc_feature: Ceres CLONE 1444187-F
  misc_feature: Encodes the peptide sequence at SEQ ID NO. 43507
  misc_feature (295)..(295): n is a, c, t, g, unknown, or other
  misc_feature (344)..(344): n is a, c, t, g, unknown, or other
  misc_feature (345)..(345): n is a, c, t, g, unknown, or other
  misc_feature (356)..(356): n is a, c, t, g, unknown, or other
  misc_feature (357)..(357): n is a, c, t, g, unknown, or other
  misc_feature (370)..(370): n is a, c, t, g, unknown, or other
aagctggagctccccgcggtggcggccgctctagaactagtggatcccccgggctgcaggaattcgcacgagaccattacctagaacatcctaatcgaaaacccgtcccgcattcgtatcctctcctcactctcgccgccgccgcttcccctgcgccccgagccaagatgaatgttgaaatctcaagaagatggcaggtgctgtgcgcactggggggaagggtagcatgcgcaggaagaagaaggcagtccacaagactacgaccacagatgataaaaggcttcagagcaccctngaaagaataggagtgaacaccattcctggtattgaagaaggtcacatcnnttaggatgatnngtgtattcagttngtgaatctaaagtgcaagcttcaattggtgctatacatgggtggggcagtgaaactcacagacaaagagctgcaagatctgctcccgtcattatcaacaggttcgccctgacaactaaacaacctgggaggtttgcggacaattcaaaagcaggccctggggcttcagggcaaagctggccccacccttgggcttcccagaaaaaaaaaaaacttccaaaccccccccggagaacatttaagggctccgaaaaaaaaaaagagcctcagttttccccctgccccccctttgaggggttaaaaaaaatcctggaaaaaagggggttgtaccccccccccccttttttggccccccacaaaatttaaaaa

SEQ ID NO: 43507 - protein, 51 aa, Zea mays
  misc_feature: Ceres CLONE 1444187-F
MAGAVRTGGKGSMRRKKKAVHKTTTTDDKRLQSTLERIGVNTIPGIEEGHI

SEQ ID NO: 43508 - DNA, 757 bp, Zea mays
  misc_feature: Ceres CLONE 1444189-F
  misc_feature: Encodes the peptide sequence at SEQ ID NO. 43509
  misc_feature (505)..(505): n is a, c, t, g, unknown, or other
ggagctccccgcggtggcggccgctctagaactagtggatcccccgggctgcaggaattcgcacgagaccattacctagaacatcctaatcgaaaagattttgaatatactcgggttctcggcaaaaccccacaccggcgccgcctcttcctctcggttaagtccagcccactccgccgccgccgaccgcgagaggagttctcttcgccgcctcaaggacgagatggacacatcaagccctgcagcacttgtcaatgcaaagattatgaacatgtttgttgggcaaagagtgcgcacagttgttcaagtccaacacaatgatggtggaatgcttgtcgggcagtcccctgatgggcatcaattgagtatcaaaagcgccatggatgtccctgtatcacactttatggaagtttatggaattgctgaaaacagccagaccatccgcgctgaagtttgcacagattttggtcctgactttgatcccgagacttttaatcaattgtgncacctggcgagtaacaagttcaagcacatgttcctgtagaggtcatcatcaagtggaggaccttcgggccactgaagcttgtttgaaatcgatatgattcacctctaaatggtctttcactcaccccagtactctgttgtcagtattggactccttttagcatgtattaatctaaagcacataagactacgaagggcagcaaaatatatcgtgtagttgaagaacgtatggtcttttctacttttaggcatc

SEQ ID NO: 43509 - protein, 106 aa, Zea mays
  misc_feature: Ceres CLONE 1444189-F
  misc_feature (1)..(105): Pfam Name: Rep_fac-A_3 Pfam Description: Replication factor A protein 3
  misc_feature (94)..(94): Xaa is any aa, unknown, or other
MDTSSPAALVNAKIMNMFVGQRVRTVVQVQHNDGGMLVGQSPDGHQLSIKSAMDVPVSHFMEVYGIAENSQTIRAEVCTDFGPDFDPETFNQLXHLASNKFKHMFL

SEQ ID NO: 43510 - DNA, 793 bp, Zea mays
  misc_feature: Ceres CLONE 1444191-F
  misc_feature: Encodes the peptide sequence at SEQ ID NO. 43511
  misc_feature (64)..(64): n is a, c, t, g, unknown, or other
  misc_feature (308)..(308): n is a, c, t, g, unknown, or other
  misc_feature (309)..(309): n is a, c, t, g, unknown, or other
  misc_feature (315)..(315): n is a, c, t, g, unknown, or other
  misc_feature (428)..(428): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (457)..(457): n is a, c, t, g, unknown, or other
  misc_feature (476)..(476): n is a, c, t, g, unknown, or other
  misc_feature (490)..(490): n is a, c, t, g, unknown, or other
  misc_feature (493)..(493): n is a, c, t, g, unknown, or other
  misc_feature (494)..(494): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (601)..(601): n is a, c, t, g, unknown, or other
  misc_feature (602)..(602): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (667)..(667): n is a, c, t, g, unknown, or other
  misc_feature (668)..(668): n is a, c, t, g, unknown, or other
  misc_feature (678)..(678): n is a, c, t, g, unknown, or other
  misc_feature (679)..(679): n is a, c, t, g, unknown, or other
  misc_feature (723)..(723): n is a, c, t, g, unknown, or other
  misc_feature (746)..(746): n is a, c, t, g, unknown, or other
  misc_feature (759)..(759): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
ggcggccgctctagaactagtggatcccccgggctgcaggaattcgcacgagacccttacctanaacatcctaatcgaaaactaaagaaccctagtcacacgggaacactcagtgcctgcacgcacgagcgaattaccaggcgtttgcgatgggcggagaggccacgaatgccggcggcgggggtatccgcgcgccgatggaccactacctttacgatggcgaaaagaagcacgtcctcgcccggcatccccaccttccctgcccgtcttccgcctcccacgggaatttccccgcccccccccacccnnattttnaatactccccccaaatacctggaaacaaggggtgtgttttgtttgtagcccccccgagcgggggcgggcgggtccctcttttttttattttttcccccctttgtatttccatnccccccccccaccccaaccccaccnnncncgccaccccccaacaaaanaaaaaacaaaaaanccnnccccccaccccaccccnnncnccccaccccactcctccacacgccctnnnnnccccccccccccacgacccaccccgcccgcaccccgnnncgccccactgaacagnntttatgtcaatcaccccccgcacgcaccccccagcacggnnnnnngccgaggtcgcacgccatgnncaccagaagnnatcccactctcgcctggccccctaccccccagcacacgcctggncacgacccaccctcccccacccngccccacccctcnttccggnnnncccgtccacccgcgcccccaccct

SEQ ID NO: 43511 - protein, 148 aa, Zea mays
  misc_feature: Ceres CLONE 1444191-F
  misc_feature (54)..(54): Xaa is any aa, unknown, or other
  misc_feature (56)..(56): Xaa is any aa, unknown, or other
  misc_feature (93)..(93): Xaa is any aa, unknown, or other
  misc_feature (102)..(102): Xaa is any aa, unknown, or other
  misc_feature (103)..(103): Xaa is any aa, unknown, or other
  misc_feature (109)..(109): Xaa is any aa, unknown, or other
  misc_feature (114)..(114): Xaa is any aa, unknown, or other
  misc_feature (115)..(115): Xaa is any aa, unknown, or other
  misc_feature (121)..(121): Xaa is any aa, unknown, or other
  misc_feature (122)..(122): Xaa is any aa, unknown, or other
  misc_feature (132)..(132): Xaa is any aa, unknown, or other
  misc_feature (133)..(133): Xaa is any aa, unknown, or other
  misc_feature (145)..(145): Xaa is any aa, unknown, or other
  misc_feature (146)..(146): Xaa is any aa, unknown, or other
MGGEATNAGGGGIRAPMDHYLYDGEKKHVLARHPHLPCPSSASHGNFPAPPHPXFXYSPQIPGNKGCVLFVAPPSGGGRVPLFFIFSPLCISXPPPHPNPTXXATPQQXKKQKXXPPTPPXXPHPTPPHALXXPPPHDPPRPHPXXPH

SEQ ID NO: 43512 - DNA, 693 bp, Zea mays
  misc_feature: Ceres CLONE 1444199-F
  misc_feature: Encodes the peptide sequence at SEQ ID NO. 43513
tccccgcggtggcggccgctctataactagtggatcccccgggctgcaggaattcgcacgagaccattacctagaacatcctaatcgaaaaagcggttttgccggcggcggcggcgaccggaggatggggatgggaggccggggcgtggtgggagacaggtggtcgcaacgcattctctggatctgcgccctgggcagcgccgtgagcatctactttgtggcggtggagaggcaggcgcagaaccgcgcgcgggcggtagcggagggcctcaagggcctcgacggcgcaggggatgacgtgtgacagagctggacgctgccgttgcagaggggcctcctttgtttaggttattaaaatgagccacttttttttttctgcttcacatgttcacagaacttcgtagcgttgcaataataatgtactaaacatctgtgcccggtctttgtagaaaggaatgttgatcaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccaacagttg

SEQ ID NO: 43513 - protein, 59 aa, Zea mays
  misc_feature: Ceres CLONE 1444199-F
MGMGGRGVVGDRWSQRILWICALGSAVSIYFVAVERQAQNRARAVAEGLKGLDGAGDDV

SEQ ID NO: 43514 - DNA, 664 bp, Zea mays
  misc_feature: Ceres CLONE 1444201-F
  misc_feature: Encodes the peptide sequence at SEQ ID NO. 43515
aagctggagctccccgcggtggcggccgctctagaactagtggatcccccgggctgcaggaattcgcacgagaccattacctagaacatcctaatcgaaaagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgccgaccgtgtcgtctccgtcgtcaagaacttccagaaggttgaaccctcaaaggtgacacctagtgctcattttcagaaggaccttggacttgatagcctggacactgtggagatcgtgatggcgtttgaggaagaattttcctttgagattcctgacaacgatgcagagaagattgactccatcaaaacagcggttgatttcattgcttcgcatcctcaagcaaaataagaggatttctttttttttcccatttccaagggtgttttgcacttttgcatccagaactttatgcgaaacgggactagtttttatccagcttgccgcaataaatgggaagtcattttctttccctttctgaatccccctgtaccaaaacatcgtggtggccttgtaacctcctttggtaccctaatccatactatcattttg

SEQ ID NO: 43515 - protein, 36 aa, Zea mays
  misc_feature: Ceres CLONE 1444201-F
MAFEEEFSFEIPDNDAEKIDSIKTAVDFIASHPQAK

SEQ ID NO: 43516 - DNA, 657 bp, Zea mays
  misc_feature: Ceres CLONE 1444202-F
  misc_feature: Encodes the peptide sequence at SEQ ID NO. 43517
ctggagctccccgcggtggcggccgctctagaactagtggatcccccgggctgcaggaattcgcacgagaccattacctagaacatcctaaccgaaaagaaccatcccgtgaaatatatgatgaagcggagcccgtggtggaggaggacgtggagagggtagatctcgccagatccaaggaggtggggacgagatggtgagctcctcgtcgtcggtggttaacgtgtacccgctcgccaactacacgttcggcaccaaggagcccaagatggagaaggacacctccgtcgccgaccgcctcgcccgcatgaaggtcaactacatgaaagaaggaatgcgtacaagtgttgaagcaatcctattggtgcaagagcacaaccaccctcacatactgctcctgcaaatcggaaatacattctgcaaacttcctggtggacggttgaagcctggagaaaatgaaatcgaaggtttgaaaagaaagctgtgcagcaaacttggtgtgaactcgccttcctttccacctaactggcaggttggagagtgtgttgctgtgtggtggaggccgaattttgagactgtgatgtatccttactgccctccacatatcaccaagcccaaggagtgcaagaaacttttcatcgttcacctatccgaaag

SEQ ID NO: 43517 - protein, 154 aa, Zea mays
  misc_feature: Ceres CLONE 1444202-F
MVSSSSSVVNVYPLANYTFGTKEPKMEKDTSVADRLARMKVNYMKEGMRTSVEAILLVQEHNHPHILLLQIGNTFCKLPGGRLKPGENEIEGLKRKLCSKLGVNSPSFPPNWQVGECVAVWWRPNFETVMYPYCPPHITKPKECKKLFIVHLSE

SEQ ID NO: 43518 - DNA, 713 bp, Zea mays
  misc_feature: Ceres CLONE 1444203-F
  misc_feature: Encodes the peptide sequence at SEQ ID NO. 43519
acccgcggtggcggccgctctagaactagtggatcccccgggctgcaggaattcgcacgagaccattacctagaacatcctaatcgaaaaatcatttcgctttggaaggtcaatcaaggccaaaatcagagatttgcaggtctttcggcgctcaggttctaattgatgacaaccccagatatgctctagagtgtgctaatgacggcatgagggtccttctgttcgattacgaaagctcgtatccttggtgcaaaactggagccgatgaactccatccgctggtgacaaaggttcacaactgggaagaagtcgaggagaaacttctctcttgggtagtacctgatagctgacactcttctatcagcaaatgattccttttgcctggtttctaaaggaacttggtagggtgaaagactgctttgttcctagagcttgattttcaatacagatgtcgatagcctctccaagagtcattctaaaacccactctaaatcatcatccgaagagtcatttgcataaatttgactccaactccaacagtttttctatatcctgggatatttttcattaaactctctattcacaataattagttaggatatggagagccttggggatgttgtcaacgtaagctaggatattcagcttcattaccgcagcctagttgaggcattattcgactgtacttggtcagtctgagctgtaggcgcttc

SEQ ID NO: 43519 - protein, 47 aa, Zea mays
  misc_feature: Ceres CLONE 1444203-F
MRVLLFDYESSYPWCKTGADELHPLVTKVHNWEEVEEKLLSWVVPDS

SEQ ID NO: 43520 - DNA, 668 bp, Zea mays
  misc_feature: Ceres CLONE 1444207-F
  misc_feature: Encodes the peptide sequence at SEQ ID NO. 43521
  misc_feature (455)..(455): n is a, c, t, g, unknown, or other
  misc_feature (577)..(577): n is a, c, t, g, unknown, or other
ggagctccccgcggtggcggccgctctagaactagtggatcccccgggctgcaggaattcgcacgagaccattacctagaacatcctaatcgaaaaaactcgcactcgcacctgcacctcgcactagctagtcttgccaattaagctaggtatagaccagcatggcttctgctctcaagatgacggccatctgcatgctgatcctgaccacgggccagctgatggcaactgccggtgcaaaggcgccgctggtgcaggcggacgccgcgcctacggctcgccgtctgctctcggcggaccatgagcgctcagcctccgggaggacgagcaactgcccctgcaccgccatgactccgtggtgttgcttcggtttgcagaggacggcgacggagaactgcccctgcaccgccaggactccgtggtgttgctccggtttgcagaagacggcgctagangactgccccctgcagcccatttacaccatggtgctgctccggtttgcaaaaaacggcgctggagaactgcccctgcaccccatgactccattctggtgctttgcgcccgcaatgcttccccnaactgaaatcttcatgaaaaaacatgcatgccaatggatgtgccctccaaatgggtgccggagggggctggcaatcattcctgccgggggg

SEQ ID NO: 43521 - protein, 169 aa, Zea mays
  misc_feature: Ceres CLONE 1444207-F
  misc_feature (98)..(98): Xaa is any aa, unknown, or other
  misc_feature (139)..(139): Xaa is any aa, unknown, or other
MASALKMTAICMLILTTGQLMATAGAKAPLVQADAAPTARRLLSADHERSASGRTSNCPCTAMTPWCCFGLQRTATENCPCTARTPWCCSGLQKTALXDCPLQPIYTMVLLRFAKNGAGELPLHPMTPFWCFAPAMLPXTEIFMKKHACQWMCPPNGCRRGLAIIPAGG

SEQ ID NO: 43522 - DNA, 644 bp, Zea mays
  misc_feature: Ceres CLONE 1444225-F
  misc_feature: Encodes the peptide sequence at SEQ ID NO. 43523
ctggagctccccgcggtggcggccgctctagaactagtggatcccccgggctgcaggaattcgcacgagaccattacctagaacatcctaatcgaaaaaccggcacggcgcccatccatccatcggcatcctctagcccagtccaaaggaaccctagccatgagcgccgcctccaagaagctcttccaggccgccaggtccctcgtcctctccgcttctaaccgctccgtcctcgccggcgagggccgcaccgtcgcgctcgccgcgctcaccaactttggcaggaagaccctccccaccgcctacttatcctaccacgagcggggatcccaccatgccgcgtcggggtggggagccatcgccgccgcagtcccaggtgcagtttacatgctccagaaccaggaggctcatgctgcagagatggagcgcaccttcattgacatcacgcctgatggtgtccaaagaggcctgatttctgagattatgagccgatttgagagaaaaggctataagcttgttgccatcaagctgattgttccatgcagagaatccgctgagtagcactaccatgatctcaaggataggcctttctacagtgcgttgagtgattttctcaactctggccctgagcctgcaatggtttg

SEQ ID NO: 43523 - protein, 133 aa, Zea mays
  misc_feature: Ceres CLONE 1444225-F
  misc_feature (89)..(134): Pfam Name: NDK Pfam Description: Nucleoside diphosphate kinase
  misc_feature: SWISSPROT Homolog: EC 2.7.4.6 Nucleoside-diphosphate kinase
MSAASKKLFQAARSLVLSASNRSVLAGEGRTVALAALTNFGRKTLPTAYLSYHERGSHHAASGWGAIAAAVPGAVYMLQNQEAHAAEMERTFIDITPDGVQRGLISEIMSRFERKGYKLVAIKLIVPCRESAE

SEQ ID NO: 43524 - DNA, 620 bp, Zea mays
  misc_feature: Ceres CLONE 1444226-F
  misc_feature: Encodes the peptide sequence at SEQ ID NO. 43525
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (450)..(450): n is a, c, t, g, unknown, or other
  misc_feature (452)..(452): n is a, c, t, g, unknown, or other
  misc_feature (570)..(570): n is a, c, t, g, unknown, or other
  misc_feature (572)..(572): n is a, c, t, g, unknown, or other
  misc_feature (576)..(576): n is a, c, t, g, unknown, or other
  misc_feature (577)..(577): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
aagctggagctccccgcggtggcggccgctctagaactagtggatcccccgggctgcaggaattcgcacgagaccattacctagaacatcctaatcgaaaaccaacgcagaggatcgaaccgaatcctccgcaactcgccgccgccgggaccgaccgacccggtcctatcgatcgaggatgtcgtacgcctacctcttcaagtacatcatcatcggcgacacaggcgtggggaagtcgtacctgctgctgcagttcacggaacagcgctttcagcccgtgcaacgacctccccatcggggtcaaaatttgggggccccgtgggatcccctttaaaaaaaaccccccccccgccccaattttgggaaacggggggccaaaatttttaaattttttataannnnncccccccccaaggggggggggggggggggcgccccctttttttgtgntnaaaaaaaaaccccggggggggggggggggggggggcctttttttccccccccccccccttttttttttaaaaaaaaaaaaaaaaaaaagggggggggcgccgcaaaaaacaaaaacanantacnnannnnnnggggggggggttggttgtgttggaaaaaaaaaacca

SEQ ID NO: 43525 - protein, 51 aa, Zea mays
  misc_feature: Ceres CLONE 1444226-F
MSYAYLFKYIIIGDTGVGKSYLLLQFTEQRFQPVQRPPHRGQNLGAPWDPL

SEQ ID NO: 43526 - DNA, 761 bp, Zea mays
  misc_feature: Ceres CLONE 1444230-F
  misc_feature: Encodes the peptide sequence at SEQ ID NO. 43527
  misc_feature (754)..(754): n is a, c, t, g, unknown, or other
aagctggagctccccgcggtggcggccgctctagaactagtggatcccccgggctgcaggaattcgcacgagaccattacctagaacatcctaatcgaaaaatggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggcgcgggcgcggacgacgaccgtctcgcggcgtcgggccccggcctgggcctggcggagcggttcctgagggccttccggccggcgctgtacggggtgctggtgtccacggcgtgcggcgcggcggaggcggccgcgggcgacgacgactgcagcgtgtgcctggccgggttcgaggcggaggccgtggtgaaccggctcccctgcggccacctcttccaccgcgcctgcctcgagacctggctccggtacgagcgcgccacgtgcccgctctgccgcgcccacgtgcccctccccgccgacgagacgccggtgctccgctacccggagctcgagtgatccgggcctatcgatccgtcgacctcgagggggggcccggtacccaattcgccctatagtgagtcgtattacgcgcgctcactggccgtcgttttacaacgtcgtgactggggaaacccctggcgtacccaacttaatcgccttgcagcacatccccccttcgncagctgg

SEQ ID NO: 43527 - protein, 162 aa, Zea mays
  misc_feature: Ceres CLONE 1444230-F
  misc_feature (101)..(142): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MGISSMPEPRDSLLGYLVYNAVVSIAALAGLVRAALVFLDLQAAQLPGGAGAGADDDRLAASGPGLGLAERFLRAFRPALYGVLVSTACGAAEAAAGDDDCSVCLAGFEAEAVVNRLPCGHLFHRACLETWLRYERATCPLCRAHVPLPADETPVLRYPELE

SEQ ID NO: 43528 - DNA, 671 bp, Zea mays
  misc_feature: Ceres CLONE 1444231-F
  misc_feature: The sequence is a functional homolog of SEQ ID NO 292 in the 11/479,226 US patent application
aagctggagctccccgcggtggcggccgctctagaactagtggatcccccgggctgcaggaattcgcacgagaccattacctagaacatcctaatcgaaaagcgcgctctctatccgccctccagtaactattttctatcaataatatagtttttcaaaaggttgctacatcgtgccgagagatgtagagtgggagggagaaactacgaaaaacctgaactcaagcaaagcaacttctcaaaagacgaagacgatctcatccttaggcttcatgcacttcttggcaatagatggtcattgatagcgggaaggttacctggacgaaccgatactgaaataaggatccattgggaaacttacttaaagaggaaactcatgaaaatgggaatagacccaaccaaccatcgtctctaccatcacgcaaactacatttcaagacaatacctcaattcctctcataagaaacttgaaacagatatcattagtgatcaatcttcttcggtatccgaatcatgtgatatgagaatgttacccgtttcaagtaccaattgctatgatagtgctagtagtagtgctggacatagtcgtttgcctgacctcaacatcagtctcatccccgcggagacggtggtttctcggccagtttgtggccttcaagaatctaacagcaa

SEQ ID NO: 43529 - DNA, 694 bp, Zea mays
  misc_feature: Ceres CLONE 1444234-F
  misc_feature: Encodes the peptide sequence at SEQ ID NO. 43530
  misc_feature (328)..(328): n is a, c, t, g, unknown, or other
  misc_feature (341)..(341): n is a, c, t, g, unknown, or other
  misc_feature (348)..(348): n is a, c, t, g, unknown, or other
  misc_feature (387)..(387): n is a, c, t, g, unknown, or other
  misc_feature (394)..(394): n is a, c, t, g, unknown, or other
  misc_feature (666)..(666): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
gctctagaactagtggatcccccgggctgcaggaattcgcacgagaccattacctagaacatcctaatcgaaaagtcgagcaggagagagcgcgatggggaagatgcggcagctgatctgcctcgtggccgccgtcgccgccgcggccatcctcctgacagcgtcggccaagaagtccggcgacgtcaccgagcttcagatcggcgtcaagtacaagcctgagtcatgtacgctgcaagcacacaaaggagacaaaattaaggttcactatcgtgggacactcactgatggatcagttttcgattctagctatgacagaggtgacccngtttgattcactnctggaantggccaagtgataaaaggttgggacaaggattgctcggnatgtgcnggggtgaaagagggaactaaagatacttgcaaagatgggtatggggaggaagctcccccccaagatttcaggtggagcaatccgatcttcacccggactttatccgcctctacggaaaaacattcgggggggcaaaggcaaaagggaccgggaccctctgaccatggctttgggaagtttcaaacctcggggggatttaccactcccaaactcttagggagggtggtttcccccaccttttgcttaaagtgcaaaaaaggggtctgagctcnacattacggnnnnnnnnnnnnnnnnnnn

SEQ ID NO: 43530 - protein, 79 aa, Zea mays
  misc_feature: Ceres CLONE 1444234-F
  misc_feature: SWISSPROT Homolog: EC 5.2.1.8 Peptidylprolyl isomerase
MGKMRQLICLVAAVAAAAILLTASAKKSGDVTELQIGVKYKPESCTLQAHKGDKIKVHYRGTLTDGSVFDSSYDRGDPV

SEQ ID NO: 43531 - DNA, 772 bp, Zea mays
  misc_feature: Ceres CLONE 1444236-F
  misc_feature (241)..(241): n is a, c, t, g, unknown, or other
  misc_feature (338)..(338): n is a, c, t, g, unknown, or other
  misc_feature (377)..(377): n is a, c, t, g, unknown, or other
  misc_feature (386)..(386): n is a, c, t, g, unknown, or other
  misc_feature (390)..(390): n is a, c, t, g, unknown, or other
  misc_feature (398)..(398): n is a, c, t, g, unknown, or other
  misc_feature (542)..(542): n is a, c, t, g, unknown, or other
  misc_feature (653)..(653): n is a, c, t, g, unknown, or other
  misc_feature (740)..(740): n is a, c, t, g, unknown, or other
gaagatcccccgggctgcaggaattcgcacgagaccattacctaaaacatcctaatcgaaaaaaaataacaaggcagggaaagatctgatctgcggggtgacagagcatgaggagaaagccaagccattgccctcccctcttgaaggattggagcttggttctacatcctcttctcttcccctccgacgctctctctctctatctaataggtttgcttgcttgcctactataaaatctagncatacgagactgacatgggcaacgctcttgggaacattcacaaagagaacttcctgcccaatcaagcggatcaagggagagttggattatttttaancgccgggttaataaattaaaaagaagagtttattaacanccgatcatnaaanagaagggngaggattctccggaaaaataccacgcaaatccccaaccgatttcgcgcccaaagggagggatccgcgcctcgaaattgtggggcctccaaattggtccaccatttcacaggggagacgcgtctcctcaaacacattggcaaaangggggggaaccatggagaacctcttaaaaaacatcccgggtttcggggccctacattcgatatgagaaaaagatagaaactgaccccattaggtcttcagaagactggggnaattgcgatcaaattccctttcaaaaagaaggcgcggcccccccttgtactaaggaccccatttaacctctttcagcacaaaaaagnaagaggttcctcgaattgcctttgagtggcag

SEQ ID NO: 43532 - DNA, 674 bp, Zea mays
  misc_feature: Ceres CLONE 1444238-F
  misc_feature: Encodes the peptide sequence at SEQ ID NO. 43533
  misc_feature (336)..(336): n is a, c, t, g, unknown, or other
  misc_feature (348)..(348): n is a, c, t, g, unknown, or other
  misc_feature (355)..(355): n is a, c, t, g, unknown, or other
  misc_feature (358)..(358): n is a, c, t, g, unknown, or other
  misc_feature (380)..(380): n is a, c, t, g, unknown, or other
  misc_feature (404)..(404): n is a, c, t, g, unknown, or other
  misc_feature (410)..(410): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
tggagctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagcccgcgaaggccccgccccggggctccgcgtcgacgcccgcggncgcgtacccctngcggggnctnccctcgcggccgcgctttcggntactcctctgctaaaatcgcgctngatacntggtttccgcctccaaaatatgattcccctgggctggcccccgtgaaccaaccccggggggccggggggtcccttttggaaggggcccccgggcttgttttttttttagggattcgccccccnnncccgggaaaaaaaagggtcccccggggggggggaaaccccctccacccccctttttttggggggaaaataagacaccccgcgggggttttggggaatcaaaagaaaattttttttttacaaaaaaaaaaaaaaacattt

SEQ ID NO: 43533 - protein, 77 aa, Zea mays
  misc_feature: Ceres CLONE 1444238-F
  misc_feature (45)..(45): Xaa is any aa, unknown, or other
  misc_feature (46)..(46): Xaa is any aa, unknown, or other
  misc_feature (53)..(53): Xaa is any aa, unknown, or other
  misc_feature (61)..(61): Xaa is any aa, unknown, or other
  misc_feature (63)..(63): Xaa is any aa, unknown, or other
MAGLRMKFVAVAAMAAALVASAAAREGPAPGLRVDARGRVPLAGXXLAAALSXTPLLKSRXIXGFRLQNMIPLGWPP

SEQ ID NO: 43534 - DNA, 757 bp, Zea mays
  misc_feature: Ceres CLONE 1444239-F
  misc_feature: Encodes the peptide sequence at SEQ ID NO. 43535
  misc_feature (611)..(611): n is a, c, t, g, unknown, or other
  misc_feature (619)..(619): n is a, c, t, g, unknown, or other
  misc_feature (756)..(756): n is a, c, t, g, unknown, or other
ctccccgcggtggcggccgctctagaactagtggatcccccgggctgcaggaattcgcacgagaccattacctagaacatcctaatcgaaaaatagtactagaaaaatggccatggcagccgccaccgcgaatgccatcttgctcttggctctcttcttcgccggcgctcacgcgaatgtcccatgcatactcccgtatgcaagacggtgggtggcgggagccggttcttcgacgtgcagttctgcctggcggcactcggctccgatggccggagcgtcgaccactgcctcgactaccaggtctactccgccattgccgctgacctcctcgcggccaacctcaccgctacggcggccaagatcaacggcctgctccggaagagcggcggctccgccgacgaggccacgacgcgctgtctccggtcctgtcaagcgttgtacggcgacatggaacggaggcagactggctgcgcggctgccgtccggggcgtcaggaagggtgaggccaccaggtgcttggaggaagtcgcgtcagctgctgaggagtgcgaggacgggttccagaagagcaaggtggcgtcgccggtgatggcggagaacccagcagtggntcagctcngcaagctcgctgtcgcgctgttgcgcacggtgtatgctagatgaataggctttctcgtgcagtatgtaggcagaaaatgggtgtgtactggcagtctggaactgcctttttcagaaataatataataatgacaaccna

SEQ ID NO: 43535 - protein, 159 aa, Zea mays
  misc_feature: Ceres CLONE 1444239-F
  misc_feature (143)..(143): Xaa is any aa, unknown, or other
  misc_feature (146)..(146): Xaa is any aa, unknown, or other
MHTPVCKTVGGGSRFFDVQFCLAALGSDGRSVDHCLDYQVYSAIAADLLAANLTATAAKINGLLRKSGGSADEATTRCLRSCQALYGDMERRQTGCAAAVRGVRKGEATRCLEEVASAAEECEDGFQKSKVASPVMAENPAVXQLXKLAVALLRTVYAR

SEQ ID NO: 43536 - DNA, 768 bp, Zea mays
  misc_feature: Ceres CLONE 1444247-F
  misc_feature: Encodes the peptide sequence at SEQ ID NO. 43537
ctggagctccccgcggtggcggccgctctagaactagtggatcccccgggctgcaggaattcgcacgagaccattacctagaacatcctaatcgaaaattccggcgccgccgcctgatcgctccagcgccctcgccgtcggcagctcggccgccgtactcccgctaccgagctaggaggcatcaccttcgccggtccaaaatgggtaagacacgtggtatgggagctgggcgcaagctcaagacccacagaaggaaccagaggtgggctgacaaagcctacaagaagagtcatctcggcaacgagtggaagaaaccatttgctgggtcatctcacgcaaagggaatcgtccttgagaagatcggcattgaggctaagcagcctaactctgctatccgtaagtgcgctcgtgtccagctggtgaagaacgggaagaagattgctgcctttgtgccaaacgatggttgcttgaactacatcgaggagaacgatgaggtgctgattgctggattcggtcgtaagggccatgctgtaggagatattcccggcgtccgtttcaaggtcgtgaaggtctctggcgtttccctcctcgccctcttcaaggagaagaaagagaagccgagatcttaaaacgatgcaagggttttggagctttgtgcctggtggcgcaccgcacacctgtagcgctcacacaagccatagcagacctcatgttgagatgaaccagcaggtgatttttgcaatagtttttgtgaagacatctgaatcg

SEQ ID NO: 43537 - protein, 142 aa, Zea mays
  misc_feature: Ceres CLONE 1444247-F
  misc_feature (8)..(141): Pfam Name: Ribosomal_S12 Pfam Description: Ribosomal protein S12
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNYIEENDEVLIAGFGRKGHAVGDIPGVRFKVVKVSGVSLLALFKEKKEKPRS

SEQ ID NO: 43538 - DNA, 751 bp, Zea mays
  misc_feature: Ceres CLONE 1444258-F
  misc_feature: Encodes the peptide sequence at SEQ ID NO. 43539
ggagctccccgcggtggcggccgctctataactagtggatcccccgggctgcaggaattcgcacgagaccattacctagaacatcctaatcgaaaactctcgtggccttgtttcctggcggcgacggctggtcgagcggcgccgcccttggctaggtcttcgctgggtccttccccggcgacgagcgtctatctggggtcgactgaactgagcaggcagtaggaagagacactatgttgttcttctcctacttcaaggagctggtggggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcgcacctgcttcatcaggggctcggtggtgcggtacgtgctgctcccgcaggacggcgggacatcgacatcctcacgacgcctcaggagggaggcgcgcggaggctgatcctgatggccaccggctccctccctgctggctgctgcttcctccccgattgtaccaacatgcatgttcgggtgtgggtaaaaaaaatgccccagtttagttcgttggggctggcctgggcataaaattctccggttggaggaggcacccggctccccgggattttttttggccaaaaaaagacaggggcccggcgtggggtggcgtttttttttccccaaaaaaaaaaaaaaagcttc

SEQ ID NO: 43539 - protein, 92 aa, Zea mays
  misc_feature: Ceres CLONE 1444258-F
  misc_feature (5)..(72): Pfam Name: LSM Pfam Description: LSM domain
MLFFSYFKELVGKEVTVELKNDLAIRGTLHSVDQYLNIKLENTRVVDQDKYPHMLSVRTCFIRGSVVRYVLLPQDGGTSTSSRRLRREARGG

SEQ ID NO: 43540 - DNA, 729 bp, Zea mays
  misc_feature: Ceres CLONE 1444265-F
  misc_feature (685)..(685): n is a, c, t, g, unknown, or other
ggagctcaccgcggtggcggccgctctataactagtggatcccccgggctgcaggaattcgcacgagaccattacctagaacatcctaatcgaaaaatcccaaacccaaagcactggagtagctatatcattctagcacacccacacaatcacaatggcacccagtgctgccctcttcatcgccctgagcctcctcctctccgccgtcgccgcccacggctgcggaagcacctattgacaaccgccggtcgtcgagccgacaccacccatcgtcgttccgccgccataccatggaggaggagggcacggccacggacacgccgggcaatgctccatcaacgtgctcaacctgagggtgtgcttcaacgtactcagcggactgctcggcctcaagatcggagaccccccccaccaccaatgctgaccgctgctccaggggttggccgacctcgacgccgccgtatgcctctgcaccgccgtcagggccaacatcctcggactacaactcaacgtgcctgtggacatcagcctcctcctcaaccactgcggcaagaaatgcccgtccggtttcacttgcccagcccattaacagaagtaccgttttgcatgcgcgcccaataagatttgctttacctacttcgttttcatgatgagaggaactgttccactcccacattttaaaagngtaacaccactactacagtatttatttatttttgccaaaaaacc

SEQ ID NO: 43541 - DNA, 831 bp, Zea mays
  misc_feature: Ceres CLONE 1444277-R
  misc_feature: Pfam Name: FMN_dh Pfam Description: FMN-dependent dehydrogenase
  misc_feature: SWISSPROT Homolog: EC 1.1.3.15 (S)-2-hydroxy-acid oxidase
cgattgggtaccgggacccccctcgaggtcgacggtatcgataagcttttttttttttttttttcggcaaaaggaaaaaacctagcacttccgacccaagaggccaaaaaccaatccgaggtaccggccattttcaaaaaaaacagtcttgccggggcacaacacaacggcaaacaaatcgaaccctacttccaaaagcgacggatcatgtccctctcggaaaaaaccccatcccgggggatttctttaaaaaaagcgaaccccctcagcgccatggggatctcaagctcatccctcaaaatttggggggcattcctcacccctgccttgccgtccagggggaggggaaacagaacgggccttccaaaaaacacccctgaggctcccacccccaaggccttgaacccctcagggccacggggaatccccccttcaagaaacaaaggaacacgtgggcccttcgtttttttaaaaacctttttcaggaccttaatgtttcccggaaaaaagcctagctggccccccccggggtgggacccaaaaagcccggcaaccccccattcaataacaattcaagcatctccggctgttaaaaccccttccccaaaaaaaggcacccccggtaatccgtttggacccctttttatttccttcccaaaaaaaaaaggtttccaatctgggctgagggggccaaacacacacaggggcccggaaccccttttttttttggcccactcttggcgagaaaaaatccaagtccttttcaaaagaccatttcacaccccacaattttttttcccaggggcaacccgggaaaaatctctttttcct

SEQ ID NO: 43542 - DNA, 686 bp, Zea mays
  misc_feature: Ceres CLONE 1444278-F
  misc_feature: Encodes the peptide sequence at SEQ ID NO. 43543
aagctggagctccccgcggtggcggccgctctagaactagtggatcccccgggctgcaggaattcgcacgagaccattacctagaacatcctaatcaaaaagagccttttgaactctctcccaaagaaaaatgagcattcaaaatactgcgactatctgaagcacaacgtagccttcggttatggcccacgggcggtagcagctagcagactagtagtaggcttcggcttgtcggcgcacccaaaaggccaaaaccacccaaaaaccccagcgcacccaacccaagagcgaaaatggatccgcaccagttcgccccctcccagcagtcggcgctgaccatggaatcggcggagagcacggccgccgccgccgcgcgggcgtccaacggcgctgcccgagctgtcgtcgaggacgacgacgaggacgacgacgtccccgaggtggccgcctgcatatcgacgatgctcgaccgcgggggtagcgtggagagccaccgcctcttcctggcgcgccgcaccgcgctggagatgctccgcgaccgcgggtacgccgttccggaggaagagctcgcccgcaccctcccggagttccgcgcctggtgggaatacaggccggagctcgaacgcctcaccttctccactaccctcacctccgacccgtccagcaagggtgaaagttgtgttctg

SEQ ID NO: 43543 - protein, 131 aa, Zea mays
  misc_feature: Ceres CLONE 1444278-F
  misc_feature (57)..(131): Pfam Name: RNA_pol_Rpb5_N Pfam Description: RNA polymerase Rpb5, N-terminal domain
MDPHQFAPSQQSALTMESAESTAAAAARASNGAARAVVEDDDEDDDVPEVAACISTMLDRGGSVESHRLFLARRTALEMLRDRGYAVPEEELARTLPEFRAWWEYRPELERLTFSTTLTSDPSSKGESCVL

SEQ ID NO: 43544 - DNA, 696 bp, Zea mays
  misc_feature: Ceres CLONE 1444283-F
  misc_feature: Encodes the peptide sequence at SEQ ID NO. 43545
  misc_feature (241)..(241): n is a, c, t, g, unknown, or other
  misc_feature (243)..(243): n is a, c, t, g, unknown, or other
  misc_feature (244)..(244): n is a, c, t, g, unknown, or other
  misc_feature (260)..(260): n is a, c, t, g, unknown, or other
ggagctccccgcggtggcggccgctctagaactagtggatcccccgggctgcaggaattcgcacgagaccattacctagaacatcctaatcgaaaacctccggagtaatccacagcagcggtgggagcaacagggacggtggagacatggaggagccgctaccgaagcccgccccctcggcagccgcggaggaggtggcggagcggttcaggtcgctcgtcgaccccgatgaaatgttgcncnntccatcagggcagacngcagcacctcataatggggcgattgcaagatagcaatgcagttctcacacattttaatgagtattccgaacgatgctttgtagaagtgtctgggtgattttttgctagtaaaaactcgccctttcctcaaggtcctatggaaagggcttgatcctccggacccaattattttccacaaaagcctaagagaggatgaaaagctaaggtttagccagccttcccttaacccaggaacccttttccccctaaaaggggggggccaattgggtccacaaaaaaccgaagggggcccccaaaaaaccccaaaaccctttgggaaaagggccctctttttaaaaaaaaaaaagggggggccccaacaaaacaacaaaaaattcccccccccaatttttatggggggggaaaacccccctgtgttggttttttacaacaaaaa

SEQ ID NO: 43545 - protein, 48 aa, Zea mays
  misc_feature: Ceres CLONE 1444283-F
  misc_feature (32)..(32): Xaa is any aa, unknown, or other
  misc_feature (33)..(33): Xaa is any aa, unknown, or other
MEEPLPKPAPSAAAEEVAERFRSLVDPDEMLXXPSGQTAAPHNGAIAR

SEQ ID NO: 43546 - DNA, 775 bp, Zea mays
  misc_feature: Ceres CLONE 1444285-F
  misc_feature: Encodes the peptide sequence at SEQ ID NO. 43547
  misc_feature (295)..(295): n is a, c, t, g, unknown, or other
  misc_feature (311)..(311): n is a, c, t, g, unknown, or other
  misc_feature (315)..(315): n is a, c, t, g, unknown, or other
  misc_feature (316)..(316): n is a, c, t, g, unknown, or other
tggagctccccgcggtggcggccgctctagaactagtggatcccccgggctgcaggaattcgcacgagaccattacctagaacatcctaatcgaaaaagctattcttctcttctcctggacaactcaagctcaaaacccaaaatcgaccttgtcgacccggatccgagctaggcacccgcacgaccacctgcctcctgccggtcaccgggacctagcatcgccgggcggcggcgggggaggggaaggtaggcgatgaggaaacgtgagcgggagaatccgtgcgggatctgcggncactacccacagtacnaagnnaggggagtatgcggggtggtgcgcccacgcttggaaccgtcggaaggggaggcccccccgtccaggcacaaatccccttccccccaaaaggggtcaagggatttcctttttctgggaagttaaaaaaaggctttcggttccaagggccctaggggcccccaaaatcccccaacacccttaaaaagggggccggagtggccaaactgggggaaaaaaatttttctaaattcaacgtttttacggggggacgcgctttttgtttttttggggcacaacccccttctctaagagggggggaaaaaaaaaaacccgggttttttttttttttggggggggaaaaaaaaccgggcgcgcgttttttgccccccccccctaaaaaaaaaaaggggggggggaccttcttcccttttttttgtgggggagaaaaaaacaaaacatttttttttattattatttttt

SEQ ID NO: 43547 - protein, 61 aa, Zea mays
  misc_feature: Ceres CLONE 1444285-F
  misc_feature (20)..(20): Xaa is any aa, unknown, or other
  misc_feature (21)..(21): Xaa is any aa, unknown, or other
MRKRERENPCGICGHYPQYXXRGVCGVVRPRLEPSEGEAPPSRHKSPSPQKGSRDFLFLGS

SEQ ID NO: 43548 - DNA, 751 bp, Zea mays
  misc_feature: Ceres CLONE 1444291-F
  misc_feature: Translation starting site: 160
  misc_feature: Pfam Name: NDK Pfam Description: Nucleoside diphosphate kinase
  misc_feature: SWISSPROT Homolog: EC 2.7.4.6 Nucleoside-diphosphate kinase
  misc_feature (280)..(280): n is a, c, t, g, unknown, or other
  misc_feature (335)..(335): n is a, c, t, g, unknown, or other
  misc_feature (338)..(338): n is a, c, t, g, unknown, or other
  misc_feature (368)..(368): n is a, c, t, g, unknown, or other
  misc_feature (383)..(383): n is a, c, t, g, unknown, or other
  misc_feature (657)..(657): n is a, c, t, g, unknown, or other
ggagctccccgcggtggcggccgctctataactagtggatcccccgggctgcaggaattcgcacgagaccatacctagaacatcctaatcgaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtgnagaggtcgtttgctgaagagcactacgccgatctcgcctccagccctttcttcanggnctcgtggatacatcatctctggccttgtgntggccatggtctggnaaggcaagaacgtcctcccaactggccccaaaatccatggggccccaaccccctggttttggaaccgcggcccttcccgggggattttgcgggcaaatttgggggaatggtttctggggaatgccccctttgaagggctaaaaagaaatttccgtgtgttcccccaggggccttttttgtggaaaaaccccccccccccgttttttaaaaaaaaaagggggggtttttttcccccccttgggggaaaaaagagggggccccccttgggtttttngggttttaaaaaaaaaaaagtgtgtggggggcctttttttgggggggctttttttttttaaaaaaaaaaaaaaaatttcttccccccgcggggg

SEQ ID NO: 43549 - DNA, 647 bp, Zea mays
  misc_feature: Ceres CLONE 1444301-F
  misc_feature: Encodes the peptide sequence at SEQ ID NO. 43550
  misc_feature (373)..(373): n is a, c, t, g, unknown, or other
  misc_feature (374)..(374): n is a, c, t, g, unknown, or other
  misc_feature (613)..(613): n is a, c, t, g, unknown, or other
tggagctccccgcggtggcggccgctctagaactagtggatcccccgggctgcaggaattcgcacgagaccattacctagaacatcctaatcgaaaagtcttcgttccgtctctccccacagggaaccgccgcccgtcgcctccagatacgtgcctccggcggaaaatcggtatcgagctcgctttgttcgaatcttctgtatagccagcaaggaggcctctccatctcctccgggaaggctgtgcagcaatggagaagtataaacagcaagactcagttagcaccctggagagataccccatttgctctccgtggtgctcttggtagtcagtgttcatacctggagagcagggtgggctcttcctttccccnncctctagcagcttctgcgaccaaagatgtcttctactactggaaatcgactcctgcactcgagttgccccctgtcatctcctggtagcaaaaccgcccgttggccccccacctttcctcttgaaaaaagccccaagtttagggcgggatttttcaaaacccccccaacgaaaaattcccggggccccccctggggagaatatccccccccaaaaattttcctcccccccccttcccccncccaaaaaaaaaaaaaaaggtggggtgggagaaa

SEQ ID NO: 43550 - protein, 82 aa, Zea mays
  misc_feature: Ceres CLONE 1444301-F
  misc_feature (72)..(72): Xaa is any aa, unknown, or other
MSSTTGNRLLHSSCPLSSPGSKTARWPPTFPLEKSPKFRAGFFKTPPTKNSRGPPWGEYPPPKIFLPPPSPXQKKKKRWGGR

SEQ ID NO: 43551 - DNA, 729 bp, Zea mays
  misc_feature: Ceres CLONE 1444307-F
  misc_feature: Translation starting site: 228
  misc_feature (633)..(633): n is a, c, t, g, unknown, or other
  misc_feature (687)..(687): n is a, c, t, g, unknown, or other
ctggagctccccgcggtggcggccgctctagaactagtggatcccccgggctgcaggaattcgcacgagaccattacctagaacatcctaatcgaaaaaaaaaccctccatccattctacacgcgccgccgcactcctgtacacgccccgccgccaccgcctccaccaccacagcgcgcaggaatccctcgttctctgagggtttcaggcgtcgtatgtaagagaagatggcgctctcagtatccatggagggcatcgaggcgcgggcgcgggatctcggggtggacctctccgctgtcgatctggactccatcaccctcccggccggcgaggacttcggcatcgtcagtgatgacgaggaggtacttcgtggtgaggatcttccagaacttgaaatgggtttgtccaacattattgtcgtggacaatctgccagttgttcctccagaaaagtttgagaagcttgagaatgtcatacgcaagatctacagccaaattggagcgataaaagaaaatggtctatggatgcctgtaaacccagagacaaagagacatacggttactgtttcattgagtatagtacccctcaagaagctgagctggctaaggaaaaaaccatggggtacaactcgancagtctcacatctttgcaagtcatttgctcgatgatttcgagagtacatgaaangtcctgacacatggacccctgctgaaaataagccatacacgg

SEQ ID NO: 43552 - DNA, 789 bp, Zea mays
  misc_feature: Ceres CLONE 1444312-F
  misc_feature: Encodes the peptide sequence at SEQ ID NO. 43553
ggagctccccgcggtggcggccgctctatcactagtggatcccccgggctgcaggaattcgcacgagaccattacctagaacatcctaatcgaaaagtccccgatcgacgcgcacaacacagcgcccacacaaacacacagacagtctcacgcgacgacacacacgcaaggcggacggacatggatatgagaggagggcacaacatgggcggcatggcaccgccgccgtcccctcacggcggcatgcggaagcgctacgtccacatgaccttcttctggagcaagaacttcgagatcctctttcacgggtgggccggcgcgcgccggcgcatgtacccgctggcgctcgtcgcagtcatcaaggttcccgctcctgctccagtttctggggttccggcgcctgaaccccatccttttctgccggggccgggccggggccccggaaaccggggggggggggggccccccgcgggttaaccccccggcccgggggggggggcgaaaccggcccagggggggccccaatggttctcaaggggggggagggccccctttttttaatccccggggcccccccgcgggtttttctgggtttttagggggccctttttcttgaaaaacaatggcccccggggggaaaaccccccccaagaaaagaggacccccccccgggggttggtgaaacccccccctcttaaccgcgcggggggggccaaaaaaaaaatggggggggttgatttcaaaaaaaggggttctattttcttaggcggggtggctataaaatatttg

SEQ ID NO: 43553 - protein, 98 aa, Zea mays
  misc_feature: Ceres CLONE 1444312-F
MDMRGGHNMGGMAPPPSPHGGMRKRYVHMTFFWSKNFEILFHGWAGARRRMYPLALVAVIKVPAPAPVSGVPAPEPHPFLPGPGRGPGNRGGGGPPAG

SEQ ID NO: 43554 - DNA, 707 bp, Zea mays
  misc_feature: Ceres CLONE 1444326-F
  misc_feature: Encodes the peptide sequence at SEQ ID NO. 43555
ggagctccccgcggtggcggccgctctagaactagtggatcccccgggctgcaggaattcgcacgagaccattacctagaacatcctaatcgaaaaatcacaaactcgagagcagagagcacctgccaaggtacagcaatcgccactgcactagttctgccgtcttgcgtttctctgtgcgatctcgaccgcggcgtcgaccatgagctacccgccaccgggcaccgcgtacccgccgccggggcaggaggcctacccgcctccagtctacggcgctccgccgcctgtcgccgccagctaccagcagcagcaggccccgccgccggaaccggaggacagcggcgacggcttctggaaaggatgttgtgctgcgatttgctgctgctgtctgctcgacacgtgctgctgatcacaagagttcgtaccgccaacaccaggatatcctacgatgatcgatctacatctactaggagctgctcatatacagtttgtttctatcgtacgtagtatttgtgctgttcggatcgagatttgtatgacggtgttcggtgtagatcactgcatcgaattgtactattacctccgttcggaaataagtggcgctgttttagtttataaattgtactcctattactagttaattttgcatcttggttttggcctctactgtatcattgatattgttatctgctgttttcctgcaaaaa

SEQ ID NO: 43555 - protein, 68 aa, Zea mays
  misc_feature: Ceres CLONE 1444326-F
MSYPPPGTAYPPPGQEAYPPPVYGAPPPVAASYQQQQAPPPEPEDSGDGFWKGCCAAICCCCLLDTCC

SEQ ID NO: 43556 - DNA, 676 bp, Zea mays
  misc_feature: Ceres CLONE 1444327-F
  misc_feature: Encodes the peptide sequence at SEQ ID NO. 43557
ctggagctccccgcggtggcggccgctctagaactagtggatcccccgggctgcaggaattcgcacgagaccattacctagaacatcctaatcgaaaaagacccgggcgggccccggcaattcacgcacctcgcgcgcacacagacacagtcacacaggcacacagcgcaatcaccgtctcgcctcgcagtcgtactcgcagtctcgcacacacccgtcccgccgtccgcatcctcttccggtgtcgccatcccctccgtcgcccgccgcgtccggccgcggcaacccgacctgtgtcaatctccatgactacctcaaggcgtcttgctgataggaagatatcacgatttgagaagaatatcacaaagaggggcgctgttcctgagacagccaagaaggcaaacgattatcctgttgggcctattcttcttgggttctttgtcttcgtggttgttggatcatctctcttgcagatcatcaagacagcatcaaacgctggtctattctgaggagaatcggttgacacatgcagtttgtcactagaaactatacaagtgtagggcgtggctcaatgtcgcctttttaatgttgtaccgtggagaggttttaagttatgtatggaatggaagtgcctattttaaagcacccggtctgaacaggaaagaatgttggaatg

SEQ ID NO: 43557 - protein, 67 aa, Zea mays
  misc_feature: Ceres CLONE 1444327-F
  misc_feature (1)..(63): Pfam Name: RAMP4 Pfam Description: Ribosome associated membrane protein RAMP4
MTTSRRLADRKISRFEKNITKRGAVPETAKKANDYPVGPILLGFFVFVVVGSSLLQIIKTASNAGLF

SEQ ID NO: 43558 - DNA, 740 bp, Zea mays
  misc_feature: Ceres CLONE 1444335-F
  misc_feature: Encodes the peptide sequence at SEQ ID NO. 43559
  misc_feature (377)..(377): n is a, c, t, g, unknown, or other
  misc_feature (408)..(408): n is a, c, t, g, unknown, or other
acccgcggtggcggccgctctagaactagtggatcccccgggctgcaggaattcgcacgagaccattacctagaacatcctaatcgaaaaacagttcatccctctcgacgcgccgccgccgtctcgccgctgcccacccagattgacggctccaattggcgcccatggcggaagaaaccaacataaaaaaggaggaagaggagttcagcaccggtcctctctcggtgctcatgatgagcgtcaagaataatacccaggttcttatcaactgccggaacaacaagaagttgcttggtcgcgtgcgagccttcgatcggcactgcaacatggttcttgagaaacgtcgtgagatgtggaccgaggtacccgagaccggntaaggggcagagaaggctctccccggtgacnagggacagttcataagcaggatgttcctccggcggggattcggtcatcatcgtcctccaggacccgaaatgagtaccctgtacccctaaaaaagtcgtttgccaaccaaaccttgggccattgggtggaaggggtatgccaaatgccccaaacctggaagggtgaatcccggcaaaaattcctttgggggtttgaggggggggtaatccttttagggggggggcttggggggggattttctttttggaaaaaaatagaaaggggtgtttttttttgtttccccacacccccccgggttgaaaaaaaaaaaaaaaattttttttttttcgccc

SEQ ID NO: 43559 - protein, 71 aa, Zea mays
  misc_feature: Ceres CLONE 1444335-F
MAEETNIKKEEEEFSTGPLSVLMMSVKNNTQVLINCRNNKKLLGRVRAFDRHCNMVLEKRREMWTEVPETG

SEQ ID NO: 43560 - DNA, 921 bp, Zea mays
  misc_feature: Ceres CLONE 1444337-F
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (899)..(899): n is a, c, t, g, unknown, or other
  misc_feature (921)..(921): n is a, c, t, g, unknown, or other
gggggcacccccacaatctcccccccnnnnnnnnnnngaagaaaannntggagactggagctccaccgcggtggcggccgctctagaactagtggatcccccgggctgcaggaattcgcacgagaccattacctagaacatcctaatcgaaaagattgcggaatttgcttcaccacaccttcatcagagagccgagacgacacgctcgggacccagcaaggcaagaagaacacgagagagatagcaggcaccaggcaggggatcatcctccgtccatggagaaaccaaagggagcggcggggcccccacgccggcgggggcccacccctggaatgacggggctgtcttcccgggaaatggggcacaaataacctcgagccctgccgcacacccctccgggggtttcctcccgggtgtggaggggagtggtttagcccccccaccaacggggggggggggcggcgactctcccctctccattttaacctacccccccccccccaaaggtgcccccgagtagccctgtgcctccgtttgcaccccgaggtcagacgtgtaggcctcccccccgaaagcacgggggtgttgggggtcagggctcagcgcgcccctactgtaagaccccaaaggcgcacgcggaggtctcagtggagctaggacatgctgcgctatttgatcgacgatcttatgagcactcatgccctgacggggccggcggcacgctcgctcatggtgccgcccaccgcccacggcacggggacatccctgatgtaggttgtgggtggcgacgttgtgggctcgcgctcgacccgtgggcccgcgagaacacaagaaaaggaactggccctcctctctgggtggggccctccgcttcaggcgagctgcaacctatcctaganaccccctctcgccggtagagtn

SEQ ID NO: 43561 - DNA, 674 bp, Zea mays
  misc_feature: Ceres CLONE 1444338-F
  misc_feature: Translation starting site: 101
  misc_feature (406)..(406): n is a, c, t, g, unknown, or other
  misc_feature (596)..(596): n is a, c, t, g, unknown, or other
  misc_feature (633)..(633): n is a, c, t, g, unknown, or other
  misc_feature (638)..(638): n is a, c, t, g, unknown, or other
ggagctccccgcggtggcggccgctctagaactagtggatcccccgggctgcaggaattcgcacgagaccattacctagaacatcctaatcgaaaaacagatgagcagagtaaccaacctctgtgaccttccatgcaggccacagcgcgacgcagctgtcggaggaatattggcctgcggcggcggcggcggccgctagctcctcgcagcaccgcgccgcctcggccggcgcggacgacgacgagctcccgtccccgccgtcggctggtggagtcagcagcagcagcaccagcgccagcaaccgggcggcggcgcggaggcggtaccgcggagtgcggcagcggccgtgggggaagtgggcggcggagatccgggacccgcacaaggcggcgcgcgtgtggctggncaccttcgattcggccgaagccgccgcgcgggcctacgacggcgccgcgctcaggttccgcggcagccgcgccaagctcaacttccccgagtccgccacgctcgcttccgcgccgcgcgggcctacgacggcgacggcccagcagcggcagcatccgagtctgggctcagccgcgcggcctgcccggccngaggcgctgctggagtcgcaggcgctccccgctgccngaacngacccctactctgagtacgccagggtcctgcaaagc

SEQ ID NO: 43562 - DNA, 843 bp, Zea mays
  misc_feature: Ceres CLONE 1444350-F
  misc_feature (40)..(40): n is a, c, t, g, unknown, or other
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (413)..(413): n is a, c, t, g, unknown, or other
ttctaatcaccccaccggggtagagggtagaggggcagannaannnnnnnnnnnnaaaaactggagctccccgcggtggcggccgctctattactagtggatcccccgggctgcaggaattcgcacgagaccattacctagaacatcctaatcgaaatagttcctctacggctctaccgagcaaccgccggcgtcgaccctgccgtccaggcccgtcctgccgcggtgccgcctgggtccctgccccagccacccggccgccacccgccgccgccagcgaggagcgagtattagcgaccctggtccctgccgcccttgcgttcgtggctccctgcccagtgcccctgcgtcagcgtcactggcactctccgagggggaagggggtcttaaatcttaaggccatccacgggggntaaataccttcgactgcaacggacctggaaggaagggcggaaatccttctcctcttgggggaaaaaagagggccccccccctcgtgcaaacggcgagaacgtgggagggtctctcgtggggagggagcagagccaggacccgttttaaaatgtgcgggcggcggggttcttggcgccttagtggggggggggacccgccagtgcccggggcccaccttaagggtgcaggggagtgcgttggggggttgggggcgagagcgcggatccacggtattgcgcagtaggaagagcgtcaccaaataggggattatgcgctctccttctggtagaagattattccgtgtttggtgggcgtttttaggtgttcaaattcctagaactttatccaacgtgcttgggggtgacataaagagcagggcgtgatgtacag

SEQ ID NO: 43563 - DNA, 816 bp, Zea mays
  misc_feature: Ceres CLONE 1444353-F
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
gggtggaagcttcaatcacccttggggggggggncnnngggnnncgcatcncttgaaaaatggagctccccgcggtggcggccgctctataatagtggatcccccgggctgcaggaattcgcacgagaccattacctggaacatcctaatcgaaaaaccatttcgctagctccatagcacttgttccagctagctaggagagagagctttgtttaggcggcggcaagatgaacaggaagccaggagactgggactgcagggggtgccagcacctcaacttcagccgtcgggatgcatgccagcgctgcagtgaaccacctggagttggtgatcgcgaccggcggtggtggtcacttgggtgggggtggggagttcctcattcgggaggtgggattttggggatgaatacaaaacccccccctcgggagactcgtactgggggctgctgcagacaaaaaaactttcgagcaggggggggggaacaccccccccaagagggtcccggcccacgagggaaggaaggcctggccggggggcgctcgcgactccgagaacatctgtcccgggctgaagtctgggttgtccgcccgggactccccggcaggggcggctccggggccgtccgcggctcctgaaaaggctaccacgtggcggggaaatgcgcagggagtaactgaggactcgggctcacctggttccccggatatacagtagaccacacccgacattcgccggagaagaaggggtaggccaataggctcgtcaccggggcgcaaggtgagtgcccccgggggaggctcggccgctcgggcccat

SEQ ID NO: 43564 - DNA, 868 bp, Zea mays
  misc_feature: Ceres CLONE 1444358-F
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tggtcccccaaccccttctctcccctcccccccnnnnnnnnnnntttttnnnnnaacagctggagctccccgcggtggcggccgctctagaactagtggatcccccgggctgcaggaattcgcacgagaccattacctagaacatcctaatcgaaaaaccgtccccgtctcaccgcactgccttgccccctactctgcctcgcttagcttagccgccgctgctacgcactctcgccgtccttgttcccgcgtcgactctcctcacgatggcttcccccgttgggagggctgcccatgggcgttggcggccgtgcttgttccccgcgccgttctggggtatggagatgtccccgctgagtagcggaccgctgcccggatcccccccctttcgggccccgggtgtgggagggccgtggacctcaaacctttgcccctctttccccccccccccccagggggggggggggggggggagggaactaggcgcggcggctgccaaacatcctcccccccccgctcgggggagaccctgggccgccgtggtgctatagtgaggctgctcccgcgccggggggcctcccccccctggcacggaactctgccccctctgtatcctcccgtgcatctggcccggtccggccccggcctatgcacctagtgatagtatacccatgccccgggtgctggttgccctcgcgggaccgcgtcgcccggggcgccacataacgagccgcgcaatccgcgcacccccctctctcccttattcctcatccattccccagcccctcgcgaccggaccccccttaaaactctgtggtttttaccccacacaccccacgcttccactaccttcccttccctctgcgtt

SEQ ID NO: 43565 - DNA, 880 bp, Zea mays
  misc_feature: Ceres CLONE 1444362-F
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (748)..(748): n is a, c, t, g, unknown, or other
tgggacaccccacccgggtcaactagccaaagcaccccgctgtggtagacaannnaaaaagctggagctccccgcggtggcggccgctctatttctagtggatcccccgggctgcaggaattcgcacgagaccattacctagaactcctaatcgaaaaactcgcgtctctttcctattcgcgccgccgccgctgctgcaagcgccagctcgccgtcgtccgaatagtacactctgacgccgccatggggcgaatgcgcagccgcgggaagggtatctcgtcgtcggggttgccgtagaagaggacgcctccgtcctggctgaagaccgccggcggggacgtggaggagatcgatcgcaaacgccagcccaccaagggacagatgccggtcgcatatttggcggtcctgcatctgttaacaaaaaccagaatgaccccaccggcaagaaatgtccaccggacagcagagagattcgggggaggggggagaggggcccccccccccccgcgccccgcggaaaggtggggggaggggacctgcgcggcgctccggccgcccacaggataggcactgtgtgcctccactgggcggacacccgagcgtgtgtaggcgggtgaacggcggggccggcgagtagccgcccgcccccgatttcctggtgttctattgcccatgaggctagggatagatagggtaatggagcggcggtcgtttatgtaaatcaaatctagcgtagttccacccttcntgaatataacgtgtgcatagcaggccgggagaaggagagtggacagggacgggtgcgagcgggcggagggcgagagcgtgcggtaccacccccccccgcctaggcggtctcccgaccgggctaccatgccag

SEQ ID NO: 43566 - DNA, 728 bp, Zea mays
  misc_feature: Ceres CLONE 1444365-F
  misc_feature: Encodes the peptide sequence at SEQ ID NO. 43567
gctctttcctagtggatcccccgggctgcaggaattcgcacgagaccattacctagaacatcctaatcgaaaacacgattgcagagccagagcgagacgcgactgcttttctgcttcatccacattggtagctagctagcttacacgttcacgcatcgctttccggtccgtctccggtggtttagctcagcagagcggggaaggaagaagatgacctccgtgagcgcgaggcccgttggcgtggggtactgcttcggcggggcgaggtgccagccacggtcgcgggtgcgggtttcggccgcggcctctgcagtggccgcgcccgcgcccgctatggcaacaacgatgtacgagctgctcgccgtcaaggagacggcagtttttccaccacaccaacgcagcctaaccggcgcgcctaggcgggggtgggaccccgtaccccttgtccgcggcggcgcccgaaccgctttcatgggcggaaagggtaggccctaagaaagtggctggccccgaccccgtagcgccaggcgccggcctaccaacttcccaacttccgacgggcggctccccaccttccgggctaaccaccggggttacctgcgccggtcatcccccgcgcccgggtgtttcggccctactgtggcaggcgccccccctgtacccgggctgacaactgggccgcccgcggtgggggaaggggccctgggtccaccccccggacggggtag

SEQ ID NO: 43567 - protein, 94 aa, Zea mays
  misc_feature: Ceres CLONE 1444365-F
MTSVSARPVGVGYCFGGARCQPRSRVRVSAAASAVAAPAPAMATTMYELLAVKETAVFPPHQRSLTGAPRRGWDPVPLVRGGARTAFMGGKGRP

SEQ ID NO: 43568 - DNA, 775 bp, Zea mays
  misc_feature: Ceres CLONE 1444370-F
  misc_feature: Encodes the peptide sequence at SEQ ID NO. 43569
  misc_feature (169)..(169): n is a, c, t, g, unknown, or other
  misc_feature (488)..(488): n is a, c, t, g, unknown, or other
aagaatgctccgacgccgggaaaacaagggggtgtgcggggaggtccccccctacaagctggggctccccgcggtggcggccgctctataactagtggatcccccgggctgcaggaattcgcacgagaccattacctagaacatcctaatcgaaaagtgccacactgcnctccccgttcgcctcttctcctccctcctggcggggccttaataaagagcagcagcgcaagaggttggtagagcgagcgataagaaggcatatggcgggggagagcttcctgttctcctcggagtccgtgaacgaggggcacccacactatctgtgcgaccaggggtcggacgctgtgctggatgcctgcctggcgcaggaccccgacggcaagggggcctgggagacctgcacgctgatgatattggtgaaggggttcggaaaaaacactactggggtgaccgtggactactataggttttccccccccccccccccnccagaccggaatcacctccgacttactttggcggctcgacggcacacctgtgcaaggggctgcgcaaaccggcgaataactcgttcccacggactcgacgcagggcgggcactgggcgcctctcctacacaggtcccgagcaaatctggcgccttgcgaccccaggtcaactagtgtgctgcgtcggccccgtactctagcacctccgacccttgcagaccgctggacactccgagcgcagtcacttaccacgcattctttccgggcggcctcttccgtctaaattg

SEQ ID NO: 43569 - protein, 133 aa, Zea mays
  misc_feature: Ceres CLONE 1444370-F
  misc_feature (4)..(93): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAGESFLFSSESVNEGHPHYLCDQGSDAVLDACLAQDPDGKGAWETCTLMILVKGFGKNTTGVTVDYYRFSPPPPPPDRNHLRLTLAARRHTCARGCANRRITRSHGLDAGRALGASPTQVPSKSGALRPQVN

SEQ ID NO: 43570 - DNA, 693 bp, Zea mays
  misc_feature: Ceres CLONE 1444373-F
  misc_feature: Encodes the peptide sequence at SEQ ID NO. 43571
  misc_feature (358)..(358): n is a, c, t, g, unknown, or other
ctggagctccccgcggtggcggccgctctagaactagtggatcccccgggctgcaggaattcgcacgagaccattacctagaacatcctaatcgaaaaacactctgcccagctaagctaagctccctccgtccatcggcatggcgactaccactactaccatcctcctcctcctcctcgtcgcagccacagccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggncagactccgccctcgtacgtcgtccgcgcggggctcggcactccgggtcagcagctgctcctcgcgctcgaaacagcgccgacgccactggtcccactgcgcgccgtggaaaacttgcccggcgggaggcgttttatccgggcaggtcctcctcgaacgctcctcccggtggccccaaagggtgcccgctcttaaggggcacccggccccggaaattagagacccttggcccccttcggggggggcctttcccaaggggttggggaaacccttttccaggggtcctggggaaaaaacccctccccggggaaaaaaacccctcccggggttatttc

SEQ ID NO: 43571 - protein, 137 aa, Zea mays
  misc_feature: Ceres CLONE 1444373-F
MATTTTTILLLLLVAATAVSAADLSVYHNVHPPSPSPLESIIALARADDARLLFLSSKAASSGGVTSAPVASGQTPPSYVVRAGLGTPGQQLLLALETAPTPLVPLRAVENLPGGRRFIRAGPPRTLLPVAPKGARS

SEQ ID NO: 43572 - DNA, 772 bp, Zea mays
  misc_feature: Ceres CLONE 1444386-F
  misc_feature: Encodes the peptide sequence at SEQ ID NO. 43573
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
agaggccctcaaaaaaggatttatatgaatttccncnncnncaacnnnnnnncaaagtggagctccccgcggtggcggccgctctattctagtggatcccccgggctgcaggaattcgcacgagaccattacctagaacatcctaatcgaaaaacacaaaacgttcctttagccatgcacccttaaccgctcattcccaaaaaattgctaggccgtaggcgtttcgaccggcgtggaggccgaccagcagttaccgtggaacgtctctaacatcagggacaaggccatggagccaatggcgattgtgacggtgaccggaggtgtgctgggcccggtcttcgtgttcctgtcgcgcatccagcctgtggtcgacttcttccgccgcctcagcgactgcatccgccaacctcagagtagacctgccagaccgctcagggcgccatggtatacacacgcctcggtagaagaccccaacacattcgcttttcttttccactccaatggatctggcaacgaattccgattcctccctcggctttcgattccgcctccgacttcccaccagcgaccatactagagaaaacggactgggtcccgcaggcgcccgtctggatcttaaatttattatccaatgtcttagagcatattcaccgttcggccccaagggagaatggggttaactaaacgtacccatttggcggaggggcctgcaaatggtaaaacccaatcttgcaaggcgagctaaaaaaagagaggatatctaaacgcgtct

SEQ ID NO: 43573 - protein, 96 aa, Zea mays
  misc_feature: Ceres CLONE 1444386-F
MEPMAIVTVTGGVLGPVFVFLSRIQPVVDFFRRLSDCIRQPQSRPARPLRAPWYTHASVEDPNTFAFLFHSNGSGNEFRFLPRLSIPPPTSHQRPY

SEQ ID NO: 43574 - DNA, 750 bp, Zea mays
  misc_feature: Ceres CLONE 1444391-F
  misc_feature: Encodes the peptide sequence at SEQ ID NO. 43575
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gtatgcccggcggtcttggccggggnnngcgggtctctnnnnnnnnnnnnnnaaaagctggggctccccgcggtggcggccgctctagaactagtggatcccccgggctgcaggaattcgcacgagaccattacctagaacatcccaatcgaaaaagagttcgagtattctcgtctcatctgtggaagaggagagaagactgaagagaagggaagacatggccgtgacggcggaagcggcggcagagatggtgttggagcggcgggcgtacgcgcgggtggggctcctcggcaaccccagcgacgtgtacggcggcagggccctgtccttcgccatcgccgacttttccgccacggtccacctccggcccttcgcccgagctgctcatccagccgcatccgcaccacgacctcgttgccttcccctctctccctcaactcgtgaggcggtttgcaaagggaagggaattatggacccccccccggctgggggatgggtattctgtaaaggttttccacacactattgggggttcaaaataaacctgcggtgttaaaaagctgaaaaaatttcacccctgtatcgtgccgaatccttaaatattccccccgggcaggcccgggggctgggcctggggttccgaaaccgcgaatttggggtttgggggctgggctctaaaaccctgggcctggctggtgggctttccgagaagagaggccacaaaactccgcgaactaagaaagggtgggaa

SEQ ID NO: 43575 - protein, 107 aa, Zea mays
  misc_feature: Ceres CLONE 1444391-F
MAVTAEAAAEMVLERRAYARVGLLGNPSDVYGGRALSFAIADFSATVHLRPFARAAHPAASAPRPRCLPLSPSTREAVCKGKGIMDPPPAGGWVFCKGFPHTIGGSK

SEQ ID NO: 43576 - DNA, 873 bp, Zea mays
  misc_feature: Ceres CLONE 1444393-F
  misc_feature: Encodes the peptide sequence at SEQ ID NO. 43577
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (50)..(50): n is a, c, t, g, unknown, or other
  misc_feature (418)..(418): n is a, c, t, g, unknown, or other
  misc_feature (497)..(497): n is a, c, t, g, unknown, or other
ttaagacccaacacgaaaaggcgggagagcccacaannntattaacnccnccccaaactggagctccccgcggtggcggccgctctagaactagtggatcccccgggctgcaggaattcgcacgagaccattacctagaacatcctaatcgaaaactctgtttgtggcgtgcggaaggagtcggagccagggaaccgaaaactcagggtctcgaatttcctaagagcggaggcgatggctgggaagggaggaaaaggattgctcgccgcgaaaactacggcggccaactccgcggagaaggacaaggggaagaaggcccccatctcacggtgctcccgcgcgggcctccagtttcctgttggacaaatccaccgtcagctgaagcaaaggactcaggcaaatggccgaagttgagtgnaaatgaaaccaacctacccccgccccccatgccagggagaactttgagtggccgaaggttttccccccccccccccccnacacgcttagatagggattctggaggggtgaaacgcgtttcttcgcccttggaccaacgtataaggttggggccgatattccgcggtataaccagaggggagcattgtggaaaaccccccacgattcaaagggagcaacacttccggcaaggctcggggagggtcttgtcacccccagaggaagaatcaccgcgaggatgcccgtggtgaaactgcgcgagggccagccccgcaagggggggtgtgaagacccctcgggcgaatggccgccctttggtctggctttttagaatatggcccgcaattttgattgatctggctcgacgccgggccgcatttccttggtcccagggggggaaagggtcaccaggtccag

SEQ ID NO: 43577 - protein, 59 aa, Zea mays
  misc_feature: Ceres CLONE 1444393-F
MAGKGGKGLLAAKTTAANSAEKDKGKKAPISRCSRAGLQFPVGQIHRQLKQRTQANGRS

SEQ ID NO: 43578 - DNA, 828 bp, Zea mays
  misc_feature: Ceres CLONE 1444403-F
  misc_feature: Translation starting site: 157
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (252)..(252): n is a, c, t, g, unknown, or other
  misc_feature (294)..(294): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (336)..(336): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (437)..(437): n is a, c, t, g, unknown, or other
  misc_feature (439)..(439): n is a, c, t, g, unknown, or other
  misc_feature (441)..(441): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (499)..(499): n is a, c, t, g, unknown, or other
  misc_feature (646)..(646): n is a, c, t, g, unknown, or other
  misc_feature (756)..(756): n is a, c, t, g, unknown, or other
nnnaacccnnnnngaaatctggactccccgcggtggcggccgctctagaactagtggatctcccgggctgcaggaattctcacgagaccatacctagaacatcctaatcgaaaatcttccacggccgcgcctgcgacacccatccgccgccacgccatggccaagtacaacgtggtgcagaagagcaagcgccagtgcaatcaggaccgcaggcgcgccgcgcatggggagcccgggaccggcaagctcaancagcggaccgcgcccgttctcctgtccggcaagcggaataanaatctctttttccccccaaagcgggaagaaaaaaannnctgntattttttattggccgggggaacacctggggggannnnnattttttttttcccccccccccgggggaaaagaaaagaggannnnnnnnnnnnnnnnnnncncncntttttgtgaatacaaaaaaaaaaaaaaaccnnnncggggggggggggggggcggggcncctccaactccccccacttagaaaaacacctcttcctcggcaaacaggattccccttgggcggagggtcggcgcaacctgctcctccacgcccccacccaacatggtaggtgactagtcgtacgcttggaggagccaagtccccccnacacaccgtacgcaaaagtctgcactgcctccgctccgctgcgcccagtgactgcttgcccccccttgcgaggagtagttctttctgcgcacggcagccttcccctcacnacccgcctcagccccccgcgctctctcgtgccggcgctaccaccgacgcagcccctctctcacactgcaata

SEQ ID NO: 43579 - DNA, 751 bp, Zea mays
  misc_feature: Ceres CLONE 1444404-F
  misc_feature: Encodes the peptide sequence at SEQ ID NO. 43580
  misc_feature (671)..(671): n is a, c, t, g, unknown, or other
ggagctccccgcggtggcggccgctctagaactagtggatcccccgggctgcaggaattcgcacgagaccattacctagaacatcctaatcgaaaaactcgccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctttttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgacttacctcattgagcagaacaaggctcagcttgttgtcatcgctcatgacgtggatccgattgaactggttgtgtggcttccagccctgtgtangaagatggaggtcccttactgcatttgtaaaggaaggctcgtcttggatcgatttgtcacagaaagatgcatcagtcttg

SEQ ID NO: 43580 - protein, 193 aa, Zea mays
  misc_feature: Ceres CLONE 1444404-F
  misc_feature (113)..(192): Pfam Name: Ribosomal_L7Ae Pfam Description: Ribosomal protein L7Ae/L30e/S12e/Gadd45 family
  misc_feature (167)..(167): Xaa is any aa, unknown, or other
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQNKAQLVVIAHDVDPIELVVWLPALCXKMEVPYCICKGRLVLDRFVTERCISL

SEQ ID NO: 43581 - DNA, 808 bp, Zea mays
  misc_feature: Ceres CLONE 1444408-F
  misc_feature: Encodes the peptide sequence at SEQ ID NO. 43582
  misc_feature (480)..(480): n is a, c, t, g, unknown, or other
  misc_feature (749)..(749): n is a, c, t, g, unknown, or other
agagctggagctccccgcggtggcggccgctctagaactagtggatcccccgggctgcaggaattcgcacgagaccattacctagaacatcctaatcgaaaaattcctgtccggcggaaccgctgaaggaagggagccgaacgagcaagcaagccaccaaggaaggttgctagggccagagtggatggggttcatgctgcgggtgaggctcgcctccttcttcgtcggcgcggctgccgccgccgcgggcgggggctacttcctctacaaggactacaagctcgccaacgactctatggccctcaaggtgaaatgtctccaagactcaactgatactcgctacgaagcccttggaaagggactttttgctttggaagggcagcggaggaggtgagctgcaccggatgtgcaccccctcctcccatcagtctgttcccctacaagactttggatttacgggctgtttccgcttccccccantagcccttcctcctttgaaagcaaggaccctgcccaacaacacaaaaaattttaggatggtttcttttgttcctgcaacaggccccaagggccgacaattccccccccacctttctctggccgctaaaccccattggattttccgaaactttgggtatactccagcttactgagaattggcccaagtgggtgtgcaatcccgagaaccctcgtttggggcccacaggaaagatacaagtatcgttatcgtcgatctctccccacctctnagcggggggcccccgtacccccccatctcccccgaaaccgggtccctatctaccccgcc

SEQ ID NO: 43582 - protein, 69 aa, Zea mays
  misc_feature: Ceres CLONE 1444408-F
MGFMLRVRLASFFVGAAAAAAGGGYFLYKDYKLANDSMALKVKCLQDSTDTRYEALGKGLFALEGQRRR

SEQ ID NO: 43583 - DNA, 655 bp, Zea mays
  misc_feature: Ceres CLONE 1444411-F
  misc_feature (238)..(238): n is a, c, t, g, unknown, or other
  misc_feature (292)..(292): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (478)..(478): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (501)..(501): n is a, c, t, g, unknown, or other
  misc_feature (505)..(505): n is a, c, t, g, unknown, or other
  misc_feature (533)..(533): n is a, c, t, g, unknown, or other
  misc_feature (535)..(535): n is a, c, t, g, unknown, or other
  misc_feature (558)..(558): n is a, c, t, g, unknown, or other
  misc_feature (574)..(574): n is a, c, t, g, unknown, or other
  misc_feature (622)..(622): n is a, c, t, g, unknown, or other
ctggagctccccgcggtggcggccgctctagaactagtggatcccccgggctgcaggaattcgcacgagaccattacctagaacatcctaatcgaaaagtagttattaccagcatcggtggtgcgccatccaacaagcatcagagctcggtgtcacaaaacctgaccgatggcggcccggtgctccacagctgcctccgtggtcagaacaggatcgcgagacctctccccctcccttnttccttcacagccgcggcgctcccctcggcgcgtctgaggcccggttaaggggnaagccccgtggggtcccccccggtgggaaaggggtacaaccttggcaggggctctcccccggccccttttttgggggcccaagtggggggttttttcccccggcgccccgtttttttttttttttcccccaaaaataccccccgtgggcccccccaacaaaaaaacggnnnntttttttttttttntttggaggaaggggagnnnaaanaatnaattaaaacattattttttataattttntngaacaaccgaaatttttaacatngtcggccaaacgactngtcggctcctggctccaaagtccacacacccttcttatatccacgcgntccccaccacccctttttttcgaggccggccgg

SEQ ID NO: 43584 - DNA, 572 bp, Zea mays
  misc_feature: Ceres CLONE 1444412-F
  misc_feature (400)..(400): n is a, c, t, g, unknown, or other
  misc_feature (504)..(504): n is a, c, t, g, unknown, or other
aagctggagctccccgcggtggcggccgctctagaactagtggatcccccgggctgcaggaattcgcacgagaccattacctagaacatcctaatcgaaaaagcagctcatcacctgaaggagagcagcccggaggagggggagcaagcagcagccgtccgtggaagaagatgtcgtacctgcttgcgcatctgcactcggggtgggcggtgggaccaggccattcctttcccccagggaggggagcgcccctcgttaatttttttccggttttttggcccatttgctgggggacaaaaaacccctttttttggccaaatttggggtttaaaagggtgttggggggcccccttttttttttttagcccctctttgggaagagtttttttggggggggccnaccccccccccccctggtgtggtgagagacaccccaaaagaggagggcccccccctttttttttttccccaccccccccccccttggtgtggggaggagggggnttttaaaaccccccccctctcttttagggggggggggggggggggggtttttttttttttttccggcg

SEQ ID NO: 43585 - DNA, 729 bp, Zea mays
  misc_feature: Ceres CLONE 1444419-F
aagctggagctccccgcggtggcggccgctctataatagtggatcccccgggctgcaggaattcgcacgagaccattacctagaacatcctaatcgaaaacatcaatggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggacagtccccgacgccctgacctcggacgagatcgaccagctgctccaagcgaacagagagcccggggactacagcggctgggctggcgcggaagcggaatgaaaaatcctgtacagtctcggcaaggacggggacggtctcctccgcaaggacgtcgcgaggagcgtctacgacgggacactgttccaccggctcgcgcccagatggaaatctcccgacagcgacatggagagaagctgataagcgtggtccgggagaactgaaccggggtctggacatgctgtcaagccacatggactgggggtgggaaccggtgtgaactcactttcggggcagattattaacaaaaagggtgggaacgtggggagttgaaacagaatcgcccgaggagggccccccgaacccgaaccaaccacaatgttttccgttgccgggcggggcggtcttttctgtt

SEQ ID NO: 43586 - DNA, 717 bp, Zea mays
  misc_feature: Ceres CLONE 1444420-F
  misc_feature: Encodes the peptide sequence at SEQ ID NO. 43587
  misc_feature (492)..(492): n is a, c, t, g, unknown, or other
  misc_feature (493)..(493): n is a, c, t, g, unknown, or other
  misc_feature (518)..(518): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (542)..(542): n is a, c, t, g, unknown, or other
  misc_feature (565)..(565): n is a, c, t, g, unknown, or other
  misc_feature (568)..(568): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctagaacatcctaatcgaaaagacacacctcccgagccacgtccgccgcgcgccccccctgcaccggtgcgccctgctgcccgattcgtcggggggcgcgggaatggagctggagctggaggcggcggcccggcgcttccacctctggttccgcgggctgcgctcgctgcgccgggacctggcgtcggcccggtggtcggacgacccgacggcccagctccccgcgcaggtgggccgcttcgtggcccacctggagtcgtactgcgccgcgcgcgccgggctggacccggtgtggacgctgtcggcgccgtgggccacccccgcggagcgcggcgccgcgtactggctcgccgggtggcgccccaccacgctggtcccactgctgtaccacgagtccgggcgccgcctcgnnaggcgcagctgcccgacctcctctntnnngctggcgtccggggaactgncgactcaccccccgcagctgggncgncaggcacaccagancgcccacgtgcccaggagacgcctggcaggaagattgcctcgtgcagagggccacggcgtcttctgctgccgcgccccggacggttcggggacttcactgggcggctctgcgcaggcaggcgggctgacagggca

SEQ ID NO: 43587 - protein, 177 aa, Zea mays
  misc_feature: Ceres CLONE 1444420-F
  misc_feature (103)..(103): Xaa is any aa, unknown, or other
  misc_feature (112)..(112): Xaa is any aa, unknown, or other
  misc_feature (113)..(113): Xaa is any aa, unknown, or other
  misc_feature (120)..(120): Xaa is any aa, unknown, or other
  misc_feature (133)..(133): Xaa is any aa, unknown, or other
MELELEAAARRFHLWFRGLRSLRRDLASARWSDDPTAQLPAQVGRFVAHLESYCAARAGLDPVWTLSAPWATPAERGAAYWLAGWRPTTLVPLLYHESGRRLXRRSCPTSSXXLASGELXTHPPQLGRQAHQXAHVPRRRLAGRLPRAEGHGVFCCRAPDGSGTSLGGSAQAGGLTG

SEQ ID NO: 43588 - DNA, 827 bp, Zea mays
  misc_feature: Ceres CLONE 1444425-F
  misc_feature: Encodes the peptide sequence at SEQ ID NO. 43589
  misc_feature (368)..(368): n is a, c, t, g, unknown, or other
  misc_feature (393)..(393): n is a, c, t, g, unknown, or other
  misc_feature (435)..(435): n is a, c, t, g, unknown, or other
  misc_feature (776)..(776): n is a, c, t, g, unknown, or other
  misc_feature (777)..(777): n is a, c, t, g, unknown, or other
aaagctggagctccccgcggtggcggccgctctataactagtggatcccccgggctgcaggaattcgcacgagaccattacctagaacatcctaatcgaaaaattctgcccctcctccttctcagtcggcagccaccatgccaccgcacgcaaccaaggatcccgtcgccgcgcctgcagcagccacggcggcggcgctgtcgcgggccctggcggcggcgcgccctttcctgcgcggggaggaggcggaggtggacccggcgctgcctggcctcgccgccgtgctgcgcggcgcgggcgccggcgagtgctggcacaagcacggcacgttcctggcgcacctgctggacgtgcaccggaatcctcgnctgtggggcgcgcccgacgccgtgncgcgctgcggcctctaccacccccccctactcaactcctacngtaaacctggccatctttcagccctgaacccgggcgcgccccacttccttgccctggtccggggaacccccgaaaaggcctttgtcccccttttttggggtgtccccaagagagaaattttgccacaaagaaattgtgtttttccctatattccaaagaaaaactccccaaaaaaaatatacccacttcaaaaaaaaatttctccgggaaccccccgggggcgggggttttaaaaaaaacacacacgcgggggggggcaaaaaaaaaccccccttcccccgcggggagggattttctgtgtaaaatatatttggggggggggggggttgtgtttttttttnngaaattaacaaaaaaatcctctcttgtggaaagaacaacaacattccgcc

SEQ ID NO: 43589 - protein, 176 aa, Zea mays
  misc_feature: Ceres CLONE 1444425-F
  misc_feature (86)..(86): Xaa is any aa, unknown, or other
  misc_feature (100)..(100): Xaa is any aa, unknown, or other
MPPHATKDPVAAPAAATAAALSRALAAARPFLRGEEAEVDPALPGLAAVLRGAGAGECWHKHGTFLAHLLDVHRNPRLWGAPDAVXRCGLYHPPLLNSYXKPGHLSALNPGAPHFLALVRGTPEKAFVPLFWGVPKREILPQRNCVFPYIPKKNSPKKIYPLQKKISPGTPRGRGF

SEQ ID NO: 43590 - DNA, 736 bp, Zea mays
  misc_feature: Ceres CLONE 1444430-F
  misc_feature: Encodes the peptide sequence at SEQ ID NO. 43591
  misc_feature (649)..(649): n is a, c, t, g, unknown, or other
  misc_feature (658)..(658): n is a, c, t, g, unknown, or other
tggagctccccgcggtggcggccgctctagaactagtggatcccccgggctgcaggaattcgtacgagaccattacctagaacatcctaatcgaaaaaccgcttgcacgccaacgcgaacgccggccgccatggcctcctctgagtctcccaataccgcgcctgcggccgcggccgtcgcttcccaaccggcccgcgatttcctcgcccacctcgaggcctatctcgcccgccgcgacggcgtcgacaagctcctcaagatttcccgctacgccacgcgcctcgcgctcgccgccgggcccccgctgccccccggcgcctccgcccgcctcaagtccttcgagtccagcgtcggcctcagccgcaaggctttccgtctcggcaagttcgtgcagtccctcaacgccctcctcgcccacccgcaccctcccccgtccctcgcgctactcgcctacggcggtgagggcgtctactacttcttcgagcagttcgtctggatcgccaaggccgggctcctgcctgcgcaccttcttccgcgccctcagcgtctcagcgcctgggctgagctgctgggctacgtcggttccattttaattaagctgggagaagtgggctagatcgaatcttcgataaagaaagcgctcgtgaangactgtgantaagagagcgagggcgtgaagactatgcagggtaaactgctgctgaaagcgatgtcagtggtgcaggaacgtggcgat

SEQ ID NO: 43591 - protein, 161 aa, Zea mays
  misc_feature: Ceres CLONE 1444430-F
  misc_feature (25)..(161): Pfam Name: PEX11 Pfam Description: Peroxisomal biogenesis factor 11 (PEX11)
MASSESPNTAPAAAAVASQPARDFLAHLEAYLARRDGVDKLLKISRYATRLALAAGPPLPPGASARLKSFESSVGLSRKAFRLGKFVQSLNALLAHPHPPPSLALLAYGGEGVYYFFEQFVWIAKAGLLPAHLLPRPQRLSAWAELLGYVGSILIKLGEVG

SEQ ID NO: 43592 - DNA, 780 bp, Zea mays
  misc_feature: Ceres CLONE 1444431-F
  misc_feature: Translation starting site: 149
  misc_feature (386)..(386): n is a, c, t, g, unknown, or other
  misc_feature (394)..(394): n is a, c, t, g, unknown, or other
ctggagctccccgcggtggcggccgctctagaactagtggatcccccgggctgcaggaattcgcacgagaccattacctagaacatcctaatcgaaaaattcttctccctgcctctctttctcactcatcgctcgtggagttgcagccatggctgctccggtcgccgcatactccccggcgctgcgggtccaagtgaaagcagccatggatgcagcgtcgtcgttccgagtattggcatctctcagtttccccgggcaaagagcaagctttccatcgattcggatgcagaagcgctctcaagtgtcctgttcgctggcaaaacaagaaacagttgagaaggtcagcgagatcgtgaaagatcagttagctctactcgaagacaccngagtacangagagacaaagtttgtaaacattggagccgactcactggacacggtgaaaatcgtgatggggcttggaagaactttccaattagcgtgaacaaatccaggctccagatttccaaacgtggaaaaacttgttggttcaataaaaatttattcggaaaaaggacctttaaaccttttcccgaaaagggaaacaagggggggtttaaattaaaaacacaacgccccttttggggtttttttccaaaaaaaaaatcccccgttttttttttctccctctcttctttaaaaaaaaaaaaaaaaggccccccccccccctttggggggggggaaaattaaaaaaaaaaacccgccccagaaagagaaaggccccccttctttataaaaaaaa

SEQ ID NO: 43593 - DNA, 709 bp, Zea mays
  misc_feature: Ceres CLONE 1444438-F
  misc_feature: Encodes the peptide sequence at SEQ ID NO. 43594
ggagctccccgcggtggcggccgctctagaactagtggatcccccgggctgcaggaattcgcacgagaccattacctagaacatcctaatcgaaaacttcgatacgtcgtttacgtattcagtttttcacacaacggcggcgatgtcgtcggcctcctcctccgccgccgccgccaacgccggtgaaggaagcgggggtgcggaggagggcgtggagatcacttacgtgagctatggcggggagcagcatctgccgctggtgatgtcgctggtggacgaggagctcagcgagccctattccatcttcacctaccgctacttcgtctacctctggccgcagctcaccttcctggcgttcgatgccagggatggcaagtgcgtggggacagtcgtgtgcaagatggcgcagcataggggtgcattcaggggctacatcgccatgctcgtcgtcctcaagccctaccgagggaggggaatagcaactgagctagttactagatcaattcgggcaatgatggaatctggctgtgaagaggtgacactttgagcagaagtactaataagggtgcccttgctctgtatgggcgccttgggtttatcccagcagagagattgtaccgatactatctaaatggggtagacgcatttcgggtggaactactggtttccgcgccctggatatgacccccaaatatttggggataatggg

SEQ ID NO: 43594 - protein, 134 aa, Zea mays
  misc_feature: Ceres CLONE 1444438-F
  misc_feature (71)..(133): Pfam Name: Acetyltransf_1 Pfam Description: Acetyltransferase (GNAT) family
  misc_feature: SWISSPROT Homolog: EC 2.3.1.88 Peptide alpha-N-acetyltransferase
MSSASSSAAAANAGEGSGGAEEGVEITYVSYGGEQHLPLVMSLVDEELSEPYSIFTYRYFVYLWPQLTFLAFDARDGKCVGTVVCKMAQHRGAFRGYIAMLVVLKPYRGRGIATELVTRSIRAMMESGCEEVTL

SEQ ID NO: 43595 - DNA, 752 bp, Zea mays
  misc_feature: Ceres CLONE 1444443-F
  misc_feature: Encodes the peptide sequence at SEQ ID NO. 43596
  misc_feature (394)..(394): n is a, c, t, g, unknown, or other
  misc_feature (722)..(722): n is a, c, t, g, unknown, or other
aagctggagctccccgcggtggcggccgctctagaactagtggatcccccgggctgcaggaattcgcacgagaccattacctagaacatcctaatcgaaaacagtttggcgatcgccgatcgggaccttccctcagccacaggccgacagcccacgccgtcgaacggccggggatccggtacctccgctccgcccccgactccctctcgccggacggctgcagatccggtcaggccgatccgtctcggacccggtggtagcagtggaggaatcctctgccggtccatcgatcgggagagatgcggcagcagcggggcggggtcggggccgggaggagggaggatgacccggggctcctcattagagccgcccacaggggggggcggggggttcncctccccaaatttccaaaccttcttcgtcctgttctttctccatcgccttctttctcttcaaggagctcaggtcccagccctcatacattcagctatttgtcaagaagcctgatctaaataacccccgggccttagggagaacaaaactacctatgtgtaataagttggagcccactacccgggccttttcttaaggtggggtgccaacacctctttgagccctggttttaggagccatgttttataatagttagaggattccctttcgggacaagaaaaaccttaggccgccacttcagcaacgcaccaaaacaaaccctctccccncccgccccgccccaggggggcgcccccccg

SEQ ID NO: 43596 - protein, 70 aa, Zea mays
  misc_feature: Ceres CLONE 1444443-F
  misc_feature (32)..(32): Xaa is any aa, unknown, or other
MRQQRGGVGAGRREDDPGLLIRAAHRGGRGVXLPKFPNLLRPVLSPSPSFSSRSSGPSPHTFSYLSRSLI

SEQ ID NO: 43597 - DNA, 738 bp, Zea mays
  misc_feature: Ceres CLONE 1444446-F
  misc_feature: Encodes the peptide sequence at SEQ ID NO. 43598
  misc_feature (205)..(205): n is a, c, t, g, unknown, or other
  misc_feature (209)..(209): n is a, c, t, g, unknown, or other
  misc_feature (272)..(272): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaattatatttctgggatggcttcaatcaagaaagtgtctcaaacagccaagagtctaggtgcagctggctttgttgttgctgtagaagatagtacccagggacaangttngatcctgtgcctgtcatatttcctgggatctcatcacagatgtcagcaaacaaaggatctatngactactacacttctctacaacagaaactggcttgacgggttacagggttcaaggaacattcggtatggccaagggttgggcccaaacctgttcaatccccctcccaggggctttttctctttcccaggccttgaggaaaaggttttacctttaaaaggggagggttttaacaccaaaaatttgtcccgcgaaattccgggnnnnnnnnnnnnnnnnnnnttnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 43598 - protein, 120 aa, Zea mays
  misc_feature: Ceres CLONE 1444446-F
  misc_feature (31)..(31): Xaa is any aa, unknown, or other
  misc_feature (32)..(32): Xaa is any aa, unknown, or other
  misc_feature (53)..(53): Xaa is any aa, unknown, or other
MASIKKVSQTAKSLGAAGFVVAVEDSTQGQXXILCLSYFLGSHHRCQQTKDLXTTTLLYNRNWLDGLQGSRNIRYGQGLGPNLFNPPPRGFFSFPGLEEKVLPLKGEGFNTKNLSREIPG

SEQ ID NO: 43599 - DNA, 681 bp, Zea mays
  misc_feature: Ceres CLONE 1444448-F
  misc_feature (238)..(238): n is a, c, t, g, unknown, or other
aagctggagctccccgcggtggcggccgctctagaactagtggatcccccgggctgcaggaattcgcacgagaccattacctagaacatcctaatcgaaaaatttgtcgcgccccacagctccccacagctcacacaggcacacagctcctcttggcggcgcctctgacttctcctttttcgtcgcccttctcctttttcgtcgccttcgatcggcggccgcctccttccctcacttnccgtcccttcacgagcccgccgctgcactatgaagggaccccggcttcttctccgacatcggaagaaggcccagggatttcctcagtaaggactacccttacaacgagaaaggtggaccatttccaccgcccagggccctttggagatgggcctaaatttccccattttgtaaaaaaaaggagggccttttttcccctctggggggcgtgtccgttttaaaaaaaccaaaaaaacccccctgttgtgggtttaaaggggggccccccacaaaaaaatatttctttttttattggccccccccctaaaaaaccccccttttttaagaaaaaaaattgttctttttttgggggagggcccgcccacaaataagagaggggggggggggggcccctctccctaagaaaaaaactttttttccttgggtggggggagggccaacccc

SEQ ID NO: 43600 - DNA, 773 bp, Zea mays
  misc_feature: Ceres CLONE 1444451-F
  misc_feature: Encodes the peptide sequence at SEQ ID NO. 43601
  misc_feature (11)..(11): n is a, c, t, g, unknown, or other
  misc_feature (373)..(373): n is a, c, t, g, unknown, or other
  misc_feature (374)..(374): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (391)..(391): n is a, c, t, g, unknown, or other
cgccgctctanttctcctccatcccccgggctgcaggaattctcacgagaccattacctagaacatcctaatcgaaaagtctacgatgccgttgcgcacctcttctctctcgccgccccgagacccccacgcttccctctccgcccccgaactgtggcgcctccccccgccgccgcagcgatgccactcgcggcagagcccgacgacgctcatgaggaaagggagaatcagcagctgctaattacgacgaagggagggcccgggcttgacggactggtggtggggagctactgccacgatgtgctaatccggggcgggcgcatagtgggggagatttttttttttccccccctcccggggaaacgaaagggtnnanncnnnttnnnccccncccccccccggcaaggaaaacaaccccattagtcgttgtggcgcgggggggtcacaaccttcatttacgccccgcccgccggcgttcccgcggaaaatcgccctctgctctggtactaccccaacccacctccttccaccgcctagtcctcgaaacacgccccgcctcggaggacaggcctccaatcgggaagatccccgacccgcgcaccccccgagaaacagattatcaccggaccaaatttcccccccgtgccggtcgccgaactcccccctcttccaacttaccctcggagcgtcttctcgagcatccttccctcacaccatccacccctccgatcgcgcggtcccccgtcatagccatatctgagactcggtctttg

SEQ ID NO: 43601 - protein, 80 aa, Zea mays
  misc_feature: Ceres CLONE 1444451-F
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (68)..(68): Xaa is any aa, unknown, or other
  misc_feature (69)..(69): Xaa is any aa, unknown, or other
  misc_feature (71)..(71): Xaa is any aa, unknown, or other
MPLAAEPDDAHEERENQQLLITTKGGPGLDGLVVGSYCHDVLIRGGRIVGEIFFFPPLPGKRKGXXXXXPXPPRQGKQPH

SEQ ID NO: 43602 - DNA, 693 bp, Zea mays
  misc_feature: Ceres CLONE 1444453-F
  misc_feature: Encodes the peptide sequence at SEQ ID NO. 43603
  misc_feature (676)..(676): n is a, c, t, g, unknown, or other
acccgcggtggcggccgctctagaactagtggatcccccgggctgcaggaattcgcacgagaccattacctagaacatcctaatcgaaaaacattctgttctcgtttctcttcctctctctcaactcaactactcaaagcggtagattaaccggctctagcgtagcgagtgttgctacatctctcttggccatgggggcatgcgcgacgaagccgggtgacctcaaggtcaagggcgaggcgcctctggtcgcggaggacgccgcggcgccactggcggctgcagatgagaaggcgaaggccgccgaggtccccgtggccgccgccgccgaggtcgaccaggccgatgtcagccgccggaggtccctcagcgacctgctcaaacgggacgccgagggcactgacggggaggaggaggccgaccaggaggcggagaaggtcgtggctggggagccagcgagtgctgccgctgccgctgccggggaaacgatggggtcaccgcaagcaacagtgcaggcctcggtcgcaaccgagcaggacgacacggccgaagaactcaaggatggtcttccgagtggtggcgacgcgcatgcggcggaagaagagaagcggatggatcctgaatcaatccatgctgctgttgctgctgatgccccaggttctgaggaaagcaaggntgctgctgttgctgctg

SEQ ID NO: 43603 - protein, 167 aa, Zea mays
  misc_feature: Ceres CLONE 1444453-F
  misc_feature (162)..(162): Xaa is any aa, unknown, or other
MGACATKPGDLKVKGEAPLVAEDAAAPLAAADEKAKAAEVPVAAAAEVDQADVSRRRSLSDLLKRDAEGTDGEEEADQEAEKVVAGEPASAAAAAAGETMGSPQATVQASVATEQDDTAEELKDGLPSGGDAHAAEEEKRMDPESIHAAVAADAPGSEESKXAAVAA

SEQ ID NO: 43604 - DNA, 704 bp, Zea mays
  misc_feature: Ceres CLONE 1444455-F
  misc_feature: Translation starting site: 151
ggagctccccgcggtggcggccgctcttcactagtggatcccccgggctgcaggaattcgcacgagaccattacctagaacatcctaatcgaaaaaccctagccgccacacctaacgacccacacgagcaccaagccgaggggaggggcgatggcgagaggtgtggtgtcgacgaagggcggcacggccgcgggcaagaagaaggggtcggtagccttcacgatcgactgcaccaagcccgtggaggacaagatcatggagatcgcctcgctcgagaagttcctgcaggagcgcatcaaggtcgccggcggcaaggccggcaacctcggcgactccgtcaccatctcccgcgagaagaccaaggtcaccgtaacctgcgacgggcccttctccagaggtatctgaagtacttgaccaagaagtactttgagaagcacaaggtgcgagatgggctccgtgtgattgcagccaacagggaccacagcgtctatgagctgccgtacttcaacatttgctgaaacggaggcgaggaagaagataaactgcattgcaccttgctgaaaccagggcgaagaaaaaaattaaatctgcttgcacctatttcctcgtttttgactccttggatttaaactttggcccccgaattttggaaaagccccccgggttagcctcgggaaattttggaggggttttttttttaaaaa

SEQ ID NO: 43605 - DNA, 709 bp, Zea mays
  misc_feature: Ceres CLONE 1444456-F
  misc_feature: Encodes the peptide sequence at SEQ ID NO. 43606
  misc_feature (476)..(476): n is a, c, t, g, unknown, or other
  misc_feature (490)..(490): n is a, c, t, g, unknown, or other
  misc_feature (521)..(521): n is a, c, t, g, unknown, or other
  misc_feature (535)..(535): n is a, c, t, g, unknown, or other
  misc_feature (542)..(542): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
tggagctccccgcggtggcggccgctctagaactagtggatcccccgggctgcaggaattcgcacgagaccattacctagaacatcctaatcgaaaagcacccaggccgcggccgcatcctctccccatcggcagtcttcccccaagacgtctaaaccccaatccctaaatccccgacgcagaccacacgacgcgcacctccgttcacgaggcggaagcatgagtcgccacccgatcactaagtgggcacagaggtccgacagggtgttcttgacgatagagctgcccgacgcccaggatgtgaagctgaacttgaagcctgaaggccatttcaacttctcagctaagggctcagatgacttgcgctatgagtttgacattgagctgtttgatgctgtgaatgggtgagaaagcaagcagctattgcccaaggaccatatgctacctgataaagaaagctaagagcgggtggtggnccaagctgctgaanccagaaggcaaaccacctgttggtcttgaanggtgattggggacnaatggcnggaccaggatgatgaacaaccctggatttaatgatcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 43606 - protein, 62 aa, Zea mays
  misc_feature: Ceres CLONE 1444456-F
  misc_feature: SWISSPROT Homolog: EC 5.3.99.3 Prostaglandin-E synthase
MSRHPITKWAQRSDRVFLTIELPDAQDVKLNLKPEGHFNFSAKGSDDLRYEFDIELFDAVNG

SEQ ID NO: 43607 - DNA, 718 bp, Zea mays
  misc_feature: Ceres CLONE 1444460-F
  misc_feature: Encodes the peptide sequence at SEQ ID NO. 43608
  misc_feature (371)..(371): n is a, c, t, g, unknown, or other
  misc_feature (372)..(372): n is a, c, t, g, unknown, or other
  misc_feature (413)..(413): n is a, c, t, g, unknown, or other
  misc_feature (466)..(466): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaaacgtcttcatcacacacggtcgcggcgcgaagcaatggcgaccacggcgccgctgctctcgccccagcgcgcttgccctacccatctccggcgccgcctctcgcccctacatctcgtattccccctcgacgcgtcagcgaggcggctgcgccttcgccgggcgccgccaccttgttcggccaagttcggcaagttcgacgcctccgacgccccggcggaggccgaggaggcggtgggcgcgacggatggtgggctggcgcagcccgtgnnagaggacgacagttgctttgcatcggatttggagggcgcgnatcggcagtcaggggaaggcgagcgcagatttcgtaaactccggaggcatgcnagctatcgcagaactgctgatccctcagntgggaattcctcaacgagggaaggacacaggctgaactctggccttttcaaagatttttcctggaacccttgtccaagaaacaggacaaaaagtccctgcacttcccctgaacctggacaacctgcccttccaaggcttcagggaaaaagccccattccagtggccccttttggggcccgaacccctttggccccaaaaaaagggccccattttgaattcccc

SEQ ID NO: 43608 - protein, 194 aa, Zea mays
  misc_feature: Ceres CLONE 1444460-F
  misc_feature (79)..(79): Xaa is any aa, unknown, or other
  misc_feature (93)..(93): Xaa is any aa, unknown, or other
  misc_feature (120)..(120): Xaa is any aa, unknown, or other
MATTAPLLSPQRACPTHLRRRLSPLHLVFPLDASARRLRLRRAPPPCSAKFGKFDASDAPAEAEEAVGATDGGLAQPVXEDDSCFASDLEGAXRQSGEGERRFRKLRRHASYRRTADPSXGNSSTREGHRLNSGLFKDFSWNPCPRNRTKSPCTSPEPGQPALPRLQGKSPIPVAPFGARTPLAPKKGPHFEFP

SEQ ID NO: 43609 - DNA, 744 bp, Zea mays
  misc_feature: Ceres CLONE 1444462-F
  misc_feature: Encodes the peptide sequence at SEQ ID NO. 43610
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaacacacacacacaaacagaaaactgagtcagagaggtgcagatcaatgcggcggtggtggtgcgccgccggcggcctcgcccgctgcgtcctctcgtcctccacctccgccatagcatcccatgcccgcccgctgccggcacccctgatgcccaaatctccctcctttaccgtccctttctccttgtcctgtcgcaggcaccactctctccagggattcttccacctggtcatcgcttcttccttccgccctccgtccgccatcatcagcaagtgcggcactacgccaagaaggagaggtcgcgcgctccgctcacgccccactaaatcaaagtcaagaatacaagatgaaggccccctccttcccatgaagtcaagattcaaacccatgaagacggacgggtccgccagggtggaggggccggcaagcgcccaatggcacaccctccagtctaggagcccaacgaacctcggagccctgctttggtgcatttgcttacgcaaggtataagaagcttcaccttctgtggtagcaatcataagaccctagcggagttggcatgggaaactagttaactgaactgaccgccacgnctgcatctcagtgtaacgcgggagctctcctggaccaatacttgctttt

SEQ ID NO: 43610 - protein, 154 aa, Zea mays
  misc_feature: Ceres CLONE 1444462-F
MRRWWCAAGGLARCVLSSSTSAIASHARPLPAPLMPKSPSFTVPFSLSCRRHHSLQGFFHLVIASSFRPPSAIISKCGTTPRRRGRALRSRPTKSKSRIQDEGPLLPMKSRFKPMKTDGSARVEGPASAQWHTLQSRSPTNLGALLWCICLRKV

SEQ ID NO: 43611 - DNA, 744 bp, Zea mays
  misc_feature: Ceres CLONE 1444465-F
  misc_feature: Encodes the peptide sequence at SEQ ID NO. 43612
aaagctggagctccccgcggtggcggccgctctagaactagtggatcccccgggctgcaggaattcgcacgagaccattacctagaacatactaatcgaaaacccgtgttcttcgaccggcggcggtggtgcgaagcgaggcggtaagggagacgagatgagggggacaaagcggccgctcggcgtggtgacgtcgtgggtgcggcggcagccgcccaaggtgaaggccttccttgccgttgtcaccggcatggccgcgctcgtcttcatccgcttcatcgtccacgaccacgacaacctcttcgtcgctgccgaggctgcgcacgcgctcggcataggcgtcctcatctacaagctaaccaaggagaagacctgcgccggtttgtttccgtccgcttccttgacacacgttcccgatctgtcgagatcgccgtgccggcgcgatagggtttaggattttataggatttggtcccccaattcagcgtttcagaagacgatttccctagcatgatttgcaatttttattttgcaaagaattggtagtttactgctgtgtacatctagattctagaagcggaaggttataatgtttattcgatgtatctatagttaccccttatgttttcttgtgaggcattacggtttggggttcttatacgggcccagtgctaaagtatatttcggagctgcaagacgtgtttggttacagtatcctttgatttgactggatgaaatctatata

SEQ ID NO: 43612 - protein, 98 aa, Zea mays
  misc_feature: Ceres CLONE 1444465-F
MRGTKRPLGVVTSWVRRQPPKVKAFLAVVTGMAALVFIRFIVHDHDNLFVAAEAAHALGIGVLIYKLTKEKTCAGLFPSASLTHVPDLSRSPCRRDRV

SEQ ID NO: 43613 - DNA, 714 bp, Zea mays
  misc_feature: Ceres CLONE 1444466-F
  misc_feature: Encodes the peptide sequence at SEQ ID NO. 43614
  misc_feature (397)..(397): n is a, c, t, g, unknown, or other
  misc_feature (401)..(401): n is a, c, t, g, unknown, or other
  misc_feature (432)..(432): n is a, c, t, g, unknown, or other
aagctggagctccccgcggtggcggccgctctagaactagtggatcccccgggctgcaggaattcgcacgagaccattacctagaacatcctaatcgaaaactcgctagatatttcggccagccgtggcaccacattctccagcggcaaggcaagtacaagcggcggaaccgtgcgtcatccacaccctcggcaggccgttgtgcgagccgatctacccgatggacgatctggcggcgctggcgcgcggcgaggggtggacggaggagcggcacgcgacgttcctcgaccgcctggagctctccttcgtccagcaggtgctcggcggcaccgacgtgcgccaggcgtcccgtaggctcggccgccggccggcgccgcgggaagaaggtctggcgcgnccanttcctgtcttttctcccccccccgctcctgntcgactgaccactacccgacagcgccgttgagtccaaccggtcgggcccggccgcagctcggcgacgcgaggaaaacgacgcgcgccgccagcccgtcaacccaactgcaggttggtgaaagtgaaccctgtcccacgcgcttgcctttggaattgcaaggtggaaatgtacgcgtccagacacatcgtttccgtgcaaaatatactttggacgggcaaatgggtattgataaccgacttccaaaacacctttttgaacaaaaaacgttttcaaagtggcct

SEQ ID NO: 43614 - protein, 80 aa, Zea mays
  misc_feature: Ceres CLONE 1444466-F
  misc_feature (61)..(61): Xaa is any aa, unknown, or other
  misc_feature (71)..(71): Xaa is any aa, unknown, or other
MDDLAALARGEGWTEERHATFLDRLELSFVQQVLGGTDVRQASRRLGRRPAPREEGLARPXPVFSPPPAPXRLTTTRQRR

SEQ ID NO: 43615 - DNA, 795 bp, Zea mays
  misc_feature: Ceres CLONE 1444471-F
  misc_feature: Translation starting site: 187
  misc_feature: SWISSPROT Homolog: EC 2.7.7.27 Glucose-1-phosphate adenylyltransferase
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (393)..(393): n is a, c, t, g, unknown, or other
  misc_feature (440)..(440): n is a, c, t, g, unknown, or other
  misc_feature (482)..(482): n is a, c, t, g, unknown, or other
  misc_feature (502)..(502): n is a, c, t, g, unknown, or other
  misc_feature (503)..(503): n is a, c, t, g, unknown, or other
  misc_feature (695)..(695): n is a, c, t, g, unknown, or other
aagctggagctccccgcggtggcggccgctctagaactagtggatcccccgggctgcaggaattcgcacgagaccattacctagaacatcctaatcgaaaaactccgcagtgtcagtcactgcccccccatcacgccgcccgccctttctcggccgttgccgcgagctcgcttcgacccaccgccgatggcgacggcgatgggcgcgatggccgccacctgcatggcctcgatcccggccgccgctacgttccccggtgatctcggcgtcggacgacgccgagcggttgtaccagggtggcgcgccggtgggagacggctgcgtgcgacgccgcctgcccggaaggccgttcctgttctcgccgaaggnnncgttcgactcgcggagctcgcnaacgtgccttgatccggaccgcagcacgagtggtcttggggatcatncttgggagggggtgctgggaacaagggctgttccccctgacnaaaaaaaaaggcgaaacccnncagtggccttggggcccccactacggggccaaaaaattccctgggcacaacggggctcaaaaggaaccggtccccaaatatattgggtacacaggtttaatttttgttttcttaacccgcccccctctgggggggctttggaaaaaaatcttgggcggacaaaaaagagggggtttttttgggggcttttgncccccaaagggcggagaaaaccccggggttttgtggggggaagaaaaaccccggccaataatttgtgttgttttgagggaaaatttaattggtgtctctc

SEQ ID NO: 43616 - DNA, 773 bp, Zea mays
  misc_feature: Ceres CLONE 1444474-F
  misc_feature: Encodes the peptide sequence at SEQ ID NO. 43617
  misc_feature (382)..(382): n is a, c, t, g, unknown, or other
  misc_feature (384)..(384): n is a, c, t, g, unknown, or other
aagctggagctccccgcggtggcggccgctctagaactagtggatcccccgggctgcaggaattcgcacgagaccattacctagaacatcctaatcgaaaagagcagggcaggggttgcgtctcagttcctggttgtgttgttgtaagctcccaggtttcttctcttcgcgtgagctagctagactagagtgggatcgcgaggaagaaggatgtcgtgctgcggaggaaactgcgagtgcggcagcggatgcaagtgcggcagcgggtgcggagggtgcaagatgtacccggacatggctgagcaggtgaccaccaccaccaccatcatgggtgttgcaccatccaagggcgggttcgaggcggccgccggagctgaaaacngngggtgcaagtgcggcgccgccagctgcacctgccacccctgcacctgtaagtgaggatgaccgggtgcagcatgcacgccgtgaccaatggagaagtagatcggaaggacacccttcagtatctctagctaaatcaagctcttagagtatgttgtagcaacgttgtctgtgtttccccccatgcgtagctaggtagctagtgggtggaaaacgaataatggcccggttccttcttcctcctgcggcccctgccattgtttgcttctggggggccggccgggttgattgccccccaccaagcactggcccgcgtgttttttaaagggccccgagcccgttagcatctaaaccccgcttttgttaccccttagaggttccgacccactctc

SEQ ID NO: 43617 - protein, 75 aa, Zea mays
  misc_feature: Ceres CLONE 1444474-F
  misc_feature (1)..(74): Pfam Name: Metallothio_2 Pfam Description: Metallothionein
  misc_feature (58)..(58): Xaa is any aa, unknown, or other
MSCCGGNCECGSGCKCGSGCGGCKMYPDMAEQVTTTTTIMGVAPSKGGFEAAAGAENXGCKCGAASCTCHPCTCK

SEQ ID NO: 43618 - DNA, 713 bp, Zea mays
  misc_feature: Ceres CLONE 1444478-F
  misc_feature: Encodes the peptide sequence at SEQ ID NO. 43619
ggagctccccgcggtggcggccgctctagaactagtggatcccccgggctgcaggaattcgcacgagaccattacctagaacatcctaatcgaaaaaggcaggcagcgagtgcaaacaaccgcgagagcgatcagcgatgggctccttcttctcgaccttagtgacgccccctccgcccgccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcatcaaggtcgacgtcgacgagctcgcggaggtcgcaaccacatggaaggtagaggcgatgccaacgttcgtgctggtcaaggatggtaaagaggtaggccgtgtgattggggctaaaaaggacgagcttgagaggaagatcaggatgttcggcacgtcatcttcctcgtcctaacttagcagtgcatacactcccaccttattactgggttctcgactccagtggttctcctgggaccggggttgctgaaatggtttccctcctctgaatactgaaaaattcaaaaaaagaagtttttggaaaaactgatggtagacgttgtctggggtcattaaaaagtttctg

SEQ ID NO: 43619 - protein, 134 aa, Zea mays
  misc_feature: Ceres CLONE 1444478-F
  misc_feature (23)..(125): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGSFFSTLVTPPPPAADDPNCAVVAAHSKATYDEQWAAHKSSSKLMVIDFSASWCGPCRFIEPAFKELASRFTDAIFIKVDVDELAEVATTWKVEAMPTFVLVKDGKEVGRVIGAKKDELERKIRMFGTSSSSS

SEQ ID NO: 43620 - DNA, 714 bp, Zea mays
  misc_feature: Ceres CLONE 1444484-F
  misc_feature: Encodes the peptide sequence at SEQ ID NO. 43621
aagctggagctccccgcggtggcggccgctctagaactagtggatcccccgggctgcaggaattcgcacgagaccattacctagaacatcctaatcgaaaaataaaccctcgccagcttatcccccttcctccctcacccgatctctcctcgacggctaacccggattgccgtctcaggctcgggatccgagcgctcgcggcgatggacggcggcggcggcgctggcggcgcggagggggagctcacggcgcaggagacagcgctctacgacctccagatccgcgtctggggcgttgatgcccagaagagactaagtaaggcgcacgtgcttgtgtgtggcatgaacggaaccaccatcgagttctgcaagaatattgttctagctggagttggaagtttatccttgatggatgataatgtagtcacagaggaggatctgaatgcaaatttcctaattcctcctgatgagagcatatatggtggtagatctcgagcccaagtttgctgcgagtctttgatagatttcaatcctatggttcgagtttctggtgaaaagggtgatccatcattaattgatggagattccttgacaattttgacatggttgtacttagcgtgcatctcttaaacaaagttgttgaattatgaaactgtcgaaggagaagcaacccttggcttttaaactaagattggcagggatcctggggggaaaa

SEQ ID NO: 43621 - protein, 141 aa, Zea mays
  misc_feature: Ceres CLONE 1444484-F
MDGGGGAGGAEGELTAQETALYDLQIRVWGVDAQKRLSKAHVLVCGMNGTTIEFCKNIVLAGVGSLSLMDDNVVTEEDLNANFLIPPDESIYGGRSRAQVCCESLIDFNPMVRVSGEKGDPSLIDGDSLTILTWLYLACIS

SEQ ID NO: 43622 - DNA, 704 bp, Zea mays
  misc_feature: Ceres CLONE 1444490-F
  misc_feature: Encodes the peptide sequence at SEQ ID NO. 43623
ccccgcggtggcggccgctctagaactagtggatcccccgggctgcaggaattcgcacgagaccattacctagaacatcctaatcgaaaaaattccaaaacctagactagaggttggcggcgatgacaggttgacagctccagccggcagacagccaggcagccagccacgagcccacgacgaccctccgccggacttgacgacgggtgactgactgcatggcatctgcaagtagcagtgggtgcgcaagcactggagcatcccttgttgctgcgaacaccctgactgtggctgtgcaagaaacaactccagttaatggagatggagaaggagaagatggagaaagaacaactgatattggagtgaaagagtctgatacaaagaaaaggaaaccaaaaagacaaacctctggggtttgggactactttatcaagtccactgtgacagagaagggagataaaggcgagaccgaggaacaaatttgggcaaaatgcaagaagtgcaagttcaaaactcgtggtgaagcctaagatgatgcttaaatcttggttttcgacattttggcgctagctggtagctgctacacttaatccttaatgtagtaatgacaatgtagttctagtttggagaggcatgtactattgtgacattttggcgctagctggtaggtggtagctgctacgacattttggctgctagctggt

SEQ ID NO: 43623 - protein, 103 aa, Zea mays
  misc_feature: Ceres CLONE 1444490-F
MASASSSGCASTGASLVAANTLTVAVQETTPVNGDGEGEDGERTTDIGVKESDTKKRKPKRQTSGVWDYFIKSTVTEKGDKGETEEQIWAKCKKCKFKTRGEA

SEQ ID NO: 43624 - DNA, 713 bp, Zea mays
  misc_feature: Ceres CLONE 1444494-F
  misc_feature: Encodes the peptide sequence at SEQ ID NO. 43625
  misc_feature (537)..(537): n is a, c, t, g, unknown, or other
  misc_feature (538)..(538): n is a, c, t, g, unknown, or other
  misc_feature (572)..(572): n is a, c, t, g, unknown, or other
  misc_feature (636)..(636): n is a, c, t, g, unknown, or other
  misc_feature (648)..(648): n is a, c, t, g, unknown, or other
tggagctccccgcggtggcggccgctctagaactagtggatcccccgggctgcaggaattcgcacgagaccattacctagaacatcctaatcgaaaaagaaccttgcgagttccgactccctcactcatctccgtccgtccgccgcaccgtcgccgagcgccgctccgcgccggagacgtcctgtttttttgccgcctacgagcgctgtccctcttttctttccgcggctctgccccaacttctgcatccgaatctcccacgaagttgtcacggcgatggcagcgaccggcggcgtttcaactgacgatatcccgatcctgcaggcagagaacctcaccagcaacgtcaagtccgtccactacagtcgaacattcttgtcgatcattggtggagttgttgctggaatctggggattcacaggcttgacgggatttgtcttctactttctgataatgatggttgcatctatcgggctcttagcaaagtcaaagttttcagtgcagacatacttcgatagttggaccaggatttcattnngaggagttttgggtggcctatgtcattcgtgctngtctggacatttgcttatgacattggtcatatcttctgatggacgtagaaagagctaccctccnaggaaatatggnatttcatctgatgtcgaacattccccatgggctctttgtcactcagttttttatttgggtagtgt

SEQ ID NO: 43625 - protein, 145 aa, Zea mays
  misc_feature: Ceres CLONE 1444494-F
  misc_feature (1)..(98): Pfam Name: DUF786 Pfam Description: Protein of unknown function (DUF786)
  misc_feature (87)..(87): Xaa is any aa, unknown, or other
  misc_feature (88)..(88): Xaa is any aa, unknown, or other
  misc_feature (99)..(99): Xaa is any aa, unknown, or other
MAATGGVSTDDIPILQAENLTSNVKSVHYSRTFLSIIGGVVAGIWGFTGLTGFVFYFLIMMVASIGLLAKSKFSVQTYFDSWTRISXXGVLGGLCHSCXSGHLLMTLVISSDGRRKSYPPRKYGISSDVEHSPWALCHSVFYLGS

SEQ ID NO: 43626 - DNA, 700 bp, Zea mays
  misc_feature: Ceres CLONE 1444501-F
  misc_feature: Encodes the peptide sequence at SEQ ID NO. 43627
ctggagctccccgcggtggcggccgctctagaactagtggatcccccgggctgcaggaattcgcacgagaccattacctagaacatcctaatcgaaaaagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctccttccatcatctctactgaacagggagaagagctcaggaagcagataggcgctgtggcgtacatagaatgcagctcaaagacacagaggaacgtaaaggctgtgttcgacactggcattaaagtagt

SEQ ID NO: 43627 - protein, 183 aa, Zea mays
  misc_feature: Ceres CLONE 1444501-F
  misc_feature (15)..(182): Pfam Name: Ras Pfam Description: Ras family
  misc_feature (15)..(128): Pfam Name: Miro Pfam Description: Miro-like protein
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAPSIISTEQGEELRKQIGAVAYIECSSKTQRNVKAVFDTGIKV

SEQ ID NO: 43628 - DNA, 781 bp, Zea mays
  misc_feature: Ceres CLONE 1444504-F
  misc_feature (242)..(242): n is a, c, t, g, unknown, or other
  misc_feature (266)..(266): n is a, c, t, g, unknown, or other
  misc_feature (267)..(267): n is a, c, t, g, unknown, or other
  misc_feature (303)..(303): n is a, c, t, g, unknown, or other
  misc_feature (314)..(314): n is a, c, t, g, unknown, or other
  misc_feature (324)..(324): n is a, c, t, g, unknown, or other
  misc_feature (325)..(325): n is a, c, t, g, unknown, or other
  misc_feature (379)..(379): n is a, c, t, g, unknown, or other
  misc_feature (381)..(381): n is a, c, t, g, unknown, or other
  misc_feature (442)..(442): n is a, c, t, g, unknown, or other
ctccccgcggtggcggccgctctagaactagtggatcccccgggctgcaggaattcgcacgagaccattacctagaacatcctaatcgaaaagttcaatcagagcgcggagcattcaagaatcactccctccaccatcaggagggaccacagcggccgaagcgatggggcggccgaggcccaagagaggagaacggcggatcgacgccgccattgaccacctctcctagtacggcttcgccnagccctcaatccgcaagattatcnnacacctcttgcagctgtacgggaaaagatgggtggnttgtccctggnaggagcgtcnnacccggggtgggcttgacaaactcctggaggaaccggcccaggatgatcaaaancnaaaagccttgggttgcaaaaaagccttcccccccccaaaaggggtttggaagtcccccttngggctggcaggggccccaaggggttctaaccccgccttggattggaggttttcccaaaagttccccccccttggagaggggacgcgccctggcctcccccaaaggacccttctggggggggcccccctttttttaggggtttttaagaaaaccccggggggggcccgcccccccagaaaaaaaaatttttttttttgatagagggcgcttttttttttccccaaagagagaaacacccccgggggggaggaactttctttttaaaaaagggcgccccccaggagggggggggtgataaaaaaaaccccaccctttttgggggggggggcgccctccccc

SEQ ID NO: 43629 - DNA, 742 bp, Zea mays
  misc_feature: Ceres CLONE 1444506-F
  misc_feature: Translation starting site: 93
  misc_feature (321)..(321): n is a, c, t, g, unknown, or other
  misc_feature (347)..(347): n is a, c, t, g, unknown, or other
  misc_feature (348)..(348): n is a, c, t, g, unknown, or other
ccccgcggtggcggccgctctagaactagtggatcccccgggctgcaggaattcgcacgagaccattacctagaacatcctaatcgaaaaagatgcgcaaacatcgaatcgtctcgctagtggctgccctactcgtgctgcttgccctcgccgccgtttcctccacgcgcagcgcacaaaaggagtccgcggctgacaacgccgggatgttggcaggcggcatcaaggacgtgccggcgaacgagaacgacctccagctccaggagctcgcgcgcttcgcccgtcatgagcacaaccaaaaggcccatgctctttctgggntcgagaagcttgtgaaaggccagacnncaagtggttgctggcacgatgtactatctcactattgaagtgaaggatggccaattcaataatcttctaggacctaaggctgggaaaaacccctggaaaactttcagccacctgccgaatttcaccctgttaaaaaggggctaaccccaaagttggggccaccccccggtcccccagaatttggccccccccgggaaatttgcccctgaacccaaaaattttttaaaaaaaggctttttttaaaaaaaaaaaaaagcccccccccctatttttaaaaaagggcgcctaaaaaaaaatttaaaggggccggcggggaaaaaaaataataaaaaaaaaatttctttttggggcccaaaaagaaaaaacccccccccgcgggaaatataaaaaaaaa

SEQ ID NO: 43630 - DNA, 766 bp, Zea mays
  misc_feature: Ceres CLONE 1444507-F
  misc_feature (284)..(284): n is a, c, t, g, unknown, or other
  misc_feature (285)..(285): n is a, c, t, g, unknown, or other
ggagctccccgcggtggcggccgctctagaactagtggatcccccgggctgcaggaattcgcacgagaccattacctagaacatcctaatcgaaaaatatttcttccgcattgacggtggggcccgacgccggccacaccgccacagagagaaacgttaggacagactgactggttgagaattgagaaccaacagacgagagaggaagactggaagagagagagagagcgcgcgcttccaggtttttagctgcaggggagggcgatagttctgttctactgganngagagcaaagagcaggatgggggtccggatctttcttcagggtgcctgccaaggactttcgatgtccttgccggggccatccaatcccctggcttaccctccaaaggcctcggggaaaggaaaaaaacacaaaattcttgtgaaagaatcccagggggtccctttcggggggggggaccccctttcccctttgtttgggaaaacttttgcccccaatttcgggggggcttcctctttgggcaaaaaaaaaaaggggcttttaaggggggggggggtctcccgggggacaaggggggggcttatttttccaccatatttggggccccccattttttttacccccccccaaaaaaaaaaagggggggtgtttctccccaaaaaaacccggggaaaaatttaagggggccccccccccccccaaaaatatttttaaaaaagggggggcccccctttttgtacccccccctcccccccccccccc

SEQ ID NO: 43631 - DNA, 769 bp, Zea mays
  misc_feature: Ceres CLONE 1444508-F
  misc_feature: Translation starting site: 160
  misc_feature: SWISSPROT Homolog: EC 5.2.1.8 Peptidylprolyl isomerase
  misc_feature (274)..(274): n is a, c, t, g, unknown, or other
  misc_feature (383)..(383): n is a, c, t, g, unknown, or other
  misc_feature (410)..(410): n is a, c, t, g, unknown, or other
  misc_feature (422)..(422): n is a, c, t, g, unknown, or other
tggagctccccgcggtggcggccgctctagaactagtggatcccccgggctgcaggaattcgcacgagaccattacctagaacatcctaatcgaaaaactggtgaagtcgaagtctcgaaggttccagcgagcgactgtgtcgagcaggagagagcgcgatggggaagatgcggcagctgatctgcctcgtggccgccgtcgccgccgcggccatcctcctgacagcgtcggccaagaagtccggcgacgtcactgagcttcagatcggcgtcnagtactagcctgagtcatgtacgctgcaagcacacaagggagacaaaatttaggtttcactatcgtgggacactgactgatggatcagttttcgattctagctatgacngaggtgacccgtttgaattccaccttngaaaatgccaantgaataagggtgggacccaaggttgctccgtatgcgccggggggaaaggagaaattaaaaatcctggaaaatggggtttgtggaggggaggtcctccccaaaaattcccggggaaaaacttttatttccccgggagttttttccccccaagggagaaaattccccggggtaaaggaaaaaggagaaagcctcccctaaaacgtgtggaaaaccccccccccccgaggagggaaaccccccccctttttttttgagggagggggggggtttccccccccccccattttttctcgaaaaaagaaaaaaaaaaagggggtggtggcgggggggttaaaaataacaacccc

SEQ ID NO: 43632 - DNA, 724 bp, Zea mays
  misc_feature: Ceres CLONE 1444509-F
  misc_feature: Encodes the peptide sequence at SEQ ID NO. 43633
  misc_feature (379)..(379): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (390)..(390): n is a, c, t, g, unknown, or other
  misc_feature (451)..(451): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (459)..(459): n is a, c, t, g, unknown, or other
  misc_feature (461)..(461): n is a, c, t, g, unknown, or other
  misc_feature (473)..(473): n is a, c, t, g, unknown, or other
  misc_feature (474)..(474): n is a, c, t, g, unknown, or other
gtggcggccgctctagaactagtggatcccccgggctgcaggaattcgcacgagaccattacctagaacatcctaatcgaaaactcgctccagaagctttcctcccctagatctccctcccgtgcccggtcgcgctgccgacccgggcatggggaccaaggggaagctcggggagctagtgtgggagcaccgggtgcaggcggcctccacggtggtttttctgggcgcggccgccgtctcaatttcccccggttgggcccaggtttggcccccgggtagggatttttttgggcccttttttttttccggggccccttccttgggtgggggcccccgttttttttttctccccccccgggggaagaaggggagactccancacctnnnccnaaaccccccccccgttgtggttgggggtgtggcccccccccaaattattgggggggggggngnnncccncnccccccgtttgnntccttttgtctttttttttgttacaaacataccccccccccccccctttttttccgccgcgcgcttttcctttaatatcattctttccctttctgtttcccccctttttcttttgatttactttcccctccccgccataattttctttgccctcattccgccctaccgtttcgatttcgtcgactcgctactcttctgattttgttctcccccacgtttcttcttcccccctttccgtcctaattcttcg

SEQ ID NO: 43633 - protein, 174 aa, Zea mays
  misc_feature: Ceres CLONE 1444509-F
  misc_feature (77)..(77): Xaa is any aa, unknown, or other
  misc_feature (80)..(80): Xaa is any aa, unknown, or other
  misc_feature (81)..(81): Xaa is any aa, unknown, or other
  misc_feature (102)..(102): Xaa is any aa, unknown, or other
  misc_feature (103)..(103): Xaa is any aa, unknown, or other
  misc_feature (104)..(104): Xaa is any aa, unknown, or other
  misc_feature (105)..(105): Xaa is any aa, unknown, or other
  misc_feature (109)..(109): Xaa is any aa, unknown, or other
MGTKGKLGELVWEHRVQAASTVVFLGAAAVSISPGWAQVWPPGRDFFGPFFFSGAPSLGGGPRFFFLPPRGKKGRLXHLXXNPPPVVVGGVAPPQIIGGGGXXXXPRLXPFVFFFVTNIPPPPPFFSAARFSFNIILSLSVSPLFLLIYFPLPAIIFFALIPPYRFDFVDSLLF

SEQ ID NO: 43634 - DNA, 768 bp, Zea mays
  misc_feature: Ceres CLONE 1444514-F
  misc_feature: Encodes the peptide sequence at SEQ ID NO. 43635
  misc_feature (39)..(39): n is a, c, t, g, unknown, or other
aacggattacctctttttttggggtgagaagaggaaaangacggggggggaaccttaatagtggtactccccgcggtggcggccgctctataactagtggatcccccgggctgcaggaattcgcacgagaccattacctagaacatcctaatcgaaaaacatcaccagaggggttccgcccctctctccagtgtctctttctctctccatcgcatggctctcgcgtgcgccactcacgcgcgcgacttctgcgtcgctggcccggcgagatctttcctctcccagacctaacaggccaaggtcggcgtggagaagttcttgaacgcgcgtcgggaaaggggtggaagcacgcgccgagaaggtggaggaagctgtgggcggaggagatgcagaggctcctcaaggaacgcacgccgcggctcaagaagctgtgggtcccctgcaggcacatggaagtgatttggagtgttgcgcacaagtgcggtctgggtgtctggaaacctcatgcagaacccaggaaagtggaatcaaagtggatttgtacgttgacagctagactacgtgttggaggtgaagcatgtattgggacaccggtgaagagtcgccgctgtgtaaatgtaggagggcgcgaaagtcgttcgtgtctcttgccctttggggcattccttaatatgagataccaattggcggcaaccttttcttacatacaaaaaattttcccaaccttacctcaattgaggattacagccgcagccggcgatgcaggtg

SEQ ID NO: 43635 - protein, 127 aa, Zea mays
  misc_feature: Ceres CLONE 1444514-F
MQRLLKERTPRLKKLWVPCRHMEVIWSVAHKCGLGVWKPHAEPRKVESKWICTLTARLRVGGEACIGTPVKSRRCVNVGGRESRSCLLPFGAFLNMRYQLAATFSYIQKIFPTLPQLRITAAAGDAG

SEQ ID NO: 43636 - DNA, 739 bp, Zea mays
  misc_feature: Ceres CLONE 1444516-F
  misc_feature: Translation starting site: 276
  misc_feature: SWISSPROT Homolog: EC 3.6.3.14 H(+)-transporting two-sector ATPase
  misc_feature (379)..(379): n is a, c, t, g, unknown, or other
cagagctggagctccccgcggtggcggccgctctagaactagtggatcccccgggctgcaggaattcgcacgagaccattacctagaacatcctaatcgaaaacagagtccgcgtccgcgtcggccagatcaaacgaatcggcacgacgcatcggcatcgcctccgacgatcttgagacaaacaaaacccaccgctgcggcaactccgcctcccgccgacccggggatcgcctgacaacaggcagcgaaaaggggcgcagggtttgcccgccaagatggaggacgtggacgtctcgcggcagctgaagcagatgacggacttcatccgccaggaggccgtcgagaaggccgccgagatcgaggccgccgccgccgaggnagtccaaatagaaaagttgcagctggtggaagctcaccaaagaagatcaggcaggaatatgacaggaaaagagagcaagttggcatcaagagaaaattgattactcgatgccgctcaatgcttcccggaattaaatcccttccagcccaggatgaattggtaaccaaattgttgggagtccccagccaaaaaactcctgggcctaaataaagaaccccccccctttacaaaaagccccctaagaaaccttttgttcccaaatttgctcccccccgaaaaaaccccagtgggtcttctcccaaagggggagggggaactccccctctcggggaatattttttgggaccccccaggaaaaag

SEQ ID NO: 43637 - DNA, 717 bp, Zea mays
  misc_feature: Ceres CLONE 1444520-F
  misc_feature: Encodes the peptide sequence at SEQ ID NO. 43638
cagagctggagctccccgcggtggcggccgctctagaactagtggatcccccgggctgcaggaattcgcacgagaccattacctagaacatcctaatcgaaaacgaaaaatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcgggttcgttgcccgtgtgggtgggcgctatggcggcgatggatgcctcggcagataagaacgccgtcttccgcaagcttcgcgccaaatcggacaacaagatgtgcttcgattgcaacgccaagaacccgacgtgggcgtccgtcacctacggcgtcttcctctgcatcgactgctcggcggcgcaccgcagcctcggcgtccacgtctccttcgtcaggtcaacaaatttggattcatggactccagaacaactgaaaatgatggtctatggcggaaataaccgtgcgcaagctttctttaagcagcatggttggacagatggtggaaaaattgaagcaaagtatacttcaagagctgctgacttgtaccgacagttgcttgctaaagacgttgctaaaagctctacagaagatggaaacaatagttggccatcttccccagttgcagcatcccag

SEQ ID NO: 43638 - protein, 143 aa, Zea mays
  misc_feature: Ceres CLONE 1444520-F
  misc_feature (11)..(127): Pfam Name: ArfGap Pfam Description: Putative GTPase activating protein for Arf
MAAMDASADKNAVFRKLRAKSDNKMCFDCNAKNPTWASVTYGVFLCIDCSAAHRSLGVHVSFVRSTNLDSWTPEQLKMMVYGGNNRAQAFFKQHGWTDGGKIEAKYTSRAADLYRQLLAKDVAKSSTEDGNNSWPSSPVAASQ

SEQ ID NO: 43639 - DNA, 702 bp, Zea mays
  misc_feature: Ceres CLONE 1444522-F
  misc_feature: Encodes the peptide sequence at SEQ ID NO. 43640
  misc_feature (374)..(374): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaaatgctctggtagtctggtactgtacagtcgcagcggcgaaaggggaatcgcgcgaaatggagctctcaccggcggggaggtggactgacctccccgaggacatcgccctagacgtcgcctcccgcctccaggaggctgatgtgtgcgcgctcggcggctgttcgcgcacctggcgcagagcctgcgacgccgactgcatctgggagcgcctctttcgctgccgctggccagctgccgtggcggaggcgtcggcgtcgtcgtcccgtatccanggctggaaagctctctacatcagccaacacagaagaatggctgctgcaatatctaatgtggttgaatttgtgggaggcagcttaaataatgggtcacttgaatccgaatactatctgaaagctattgctgatttggccatgatacttgatataggatttctcgatgtccagtttttcttgttttcaggaaccatagtgcgataataaactaattggactgcactactcgatcgcatctttgcatgtgctgccagctgaagtcagtaaagcactcccagcttaccgggtatcaaaaagcgtngtttgtgtgaacctgctcagcttggta

SEQ ID NO: 43640 - protein, 139 aa, Zea mays
  misc_feature: Ceres CLONE 1444522-F
  misc_feature (7)..(54): Pfam Name: F-box Pfam Description: F-box domain
  misc_feature (72)..(72): Xaa is any aa, unknown, or other
MELSPAGRWTDLPEDIALDVASRLQEADVCALGGCSRTWRRACDADCIWERLFRCRWPAAVAEASASSSRIXGWKALYISQHRRMAAAISNVVEFVGGSLNNGSLESEYYLKAIADLAMILDIGFLDVQFFLFSGTIVR

SEQ ID NO: 43641 - DNA, 695 bp, Zea mays
  misc_feature: Ceres CLONE 1444527-F
  misc_feature: Translation starting site: 152
ctccccgcggtggcggccgctctagaactagtggatcccccgggctgcaggaattcgcacgagaccattacctagaacatcctaatcgaaaaaacagtgcaaactagaagaaacccccgtcatcagcgacctctccccaacggcgccgacgatggcgcaacagcagacgcagctaaccactggctcgggcatcctggatgccgtcccgctcttcgtcgtcatcctcctcgcggcccacgtcctggccctcgtgttctggatgtacaagctggcttccgagaagcaaccaccccggaggaagacacagtgacggcgccgatctacgccatcggcgatccttcgctagcctctttatcgcaggaggcactcgcgttggggtcgctcatcgacgacaagaagaaacttggtgactgccagttcgacctctagaaacagtcctacatggccgcatgtgccgctatgtatgacaagctccggcgcagctgccgcttggacgcggtgcagagcggctgctctgcgctgtccatcgtcaagcaggggggcctcatggtcgtcgccaacgtcgacgactcatcgggttgttctggacaccgcatcgacgacaacgtcatcacgtcgtccagctcatcgttcacctgaagctcaacctgtcacgtaagtcgctactgtctggccatgaattcttgtgcgttgag

SEQ ID NO: 43642 - DNA, 947 bp, Zea mays
  misc_feature: Ceres CLONE 1444528-F
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (443)..(443): n is a, c, t, g, unknown, or other
  misc_feature (500)..(500): n is a, c, t, g, unknown, or other
  misc_feature (947)..(947): n is a, c, t, g, unknown, or other
aaggacgcccaaaaacnnaanaaaaaannnnnnnnnnnnngnnnnaacagagctggactccccgcggtggcggccgctctattctagtggatcccccgggctgcaggaattcccacgagaccattacctagaacatcctaatcgaaaaaacccgactactactgcagcgagaggaaatataaaaaggaaaggaaaggacaaaggacctgcggcgaggtctatggcgtctacggcagggtacctggcgcgacgggcgacgcataacgaacgggtgcgcctgctataccgcacggtcgttcacggaaaaggtggacggggaaaatcacaccccccctctatctacacaaatacaaataatctctttgttaacatatctacggcccaacccacccacaaaattacccgccggtctagggcggtaggttgcgtttgatggggtttanaaaacacaactcctaataattagttgggtaagaaaaacccccccccgacgcctaaanaaatataagtgtgtggatgggggtataacgccctcctccatatcccatctcccccacccatacacccatttaacgataccttagctgcccggggtcgattaaatcttcctatccgggcggaggatgatattgtaaagaaaatggcctctcgaaaaatcgcgcacgagaatagctccgcgcgcacgcaaatccatatatctgtcccatcccttcgatattggtgcgatataacgcgcctgagaagtccgcgatggattctaacgtgtagcttactctcgggcacacgccgcggattcgtatgacctacctccttacacgttcatgcagttgagttaaatagtgtgtgcgcgcaatcggtcgcgaatgttgaggcgttctgcccagcgcacgttaacatccgactaggcctatattaccgcgatagaaggttgcagtgacggattcggn

SEQ ID NO: 43643 - DNA, 722 bp, Zea mays
  misc_feature: Ceres CLONE 1444540-F
  misc_feature: Encodes the peptide sequence at SEQ ID NO. 43644
  misc_feature (471)..(471): n is a, c, t, g, unknown, or other
  misc_feature (629)..(629): n is a, c, t, g, unknown, or other
  misc_feature (636)..(636): n is a, c, t, g, unknown, or other
  misc_feature (719)..(719): n is a, c, t, g, unknown, or other
aaaagctggagctccccgcggtggcggccgctctagaactagtggatcccccgggctgcaggaattcgcacgagaccattacctagaacatcctaatcgaaaacgagcagtatcagtttggaactttcgaggtgaactggtcacgtcatttgaagatcacctgttgtggcaccccgactgcaacacaaacaacatatacatcacaagcgatcaagatcttattatctcgtactgcaaggctgactcaactgattcaacttcagaagaaaatgctggctctataaacataagcagcatactgtccgggaaatgcctggcaaaaataaacactggaaactccaatgcttgcaaggaaagaaagaaggcgtggaacttccggaacacagtctcggaggcccttgaggacatcacggctctgtactacgacgaggatcgcgacgagatctacactggcaaccggcacggccttgntccatgtgtggtcgagctgaaagctgaaactggcgggcggctttcaaccgtagcacggtgatctggtcttcaccctgtgcgcgtattaacagctactagtgcctcactggcacggggggggggtggggggggcacacaaaagaaggaacccccccagnccactcnccaagggtgaaaagattttcttatttatcctcagcatgcccaagaacaactgttcattcattctgaaaatcaaagcccccccncct

SEQ ID NO: 43644 - protein, 176 aa, Zea mays
  misc_feature: Ceres CLONE 1444540-F
  misc_feature (157)..(157): Xaa is any aa, unknown, or other
KAGAPRGGGRSRTSGSPGLQEFARDHYLEHPNRKRAVSVWNFRGELVTSFEDHLLWHPDCNTNNIYITSDQDLIISYCKADSTDSTSEENAGSINISSILSGKCLAKINTGNSNACKERKKAWNFRNTVSEALEDITALYYDEDRDEIYTGNRHGLXPCVVELKAETGGRLSTVAR

SEQ ID NO: 43645 - DNA, 740 bp, Zea mays
  misc_feature: Ceres CLONE 1444544-F
  misc_feature: Encodes the peptide sequence at SEQ ID NO. 43646
  misc_feature (382)..(382): n is a, c, t, g, unknown, or other
  misc_feature (383)..(383): n is a, c, t, g, unknown, or other
  misc_feature (385)..(385): n is a, c, t, g, unknown, or other
caagctggagctccccgcggtggcggccgctctagaactagtggatcccccgggctgcaggaattcgcacgagaccattacctagaacatcctaatcgaaaactcagccccctccggcaactcatgagagagcgcggctcctacccggcggcggggcaacccccacgatccaaccgagcagaggtgccatgggtgctcccgaagcgcccgcatgctacgtcagaatcgcgcggcagtcaaacgccttccgccttatgacacacatgccacggcaagaaggtgaaggccttggcaaaaacaagcaaggcataaagggtcatgttagggtgaaaaataataaggacacactaggtgttggtgtaaaaatccctcatataaaaannanatacgataccactcaaattaataaaatataagcggacatgtccccccgaagtcagctaatcgttgttttaaaacaagacccacccccaagaaactgattcacctgtacatcacacccaaaaaatacaaatcatcctaatattgggttatttcaaggtcccctactcttttggaagatcccccacccgaaagacccgttaaaaaggtgaaccgcttatccaacaacaaatctttcagggacccccccctctctaacatgacggatacttcattaagggtatcccacactctgaaacctacctttttccaataaaccctaatccctcccccttatcagaaattcatttgcccagttg

SEQ ID NO: 43646 - protein, 75 aa, Zea mays
  misc_feature: Ceres CLONE 1444544-F
  misc_feature (15)..(59): Pfam Name: G-patch Pfam Description: G-patch domain
  misc_feature (65)..(65): Xaa is any aa, unknown, or other
  misc_feature (66)..(66): Xaa is any aa, unknown, or other
MGAPEAPACYVRIARQSNAFRLMTHMPRQEGEGLGKNKQGIKGHVRVKNNKDTLGVGVKIPHIKXXYDTTQINKI

SEQ ID NO: 43647 - DNA, 703 bp, Zea mays
  misc_feature: Ceres CLONE 1444545-F
  misc_feature: Encodes the peptide sequence at SEQ ID NO. 43648
  misc_feature (673)..(673): n is a, c, t, g, unknown, or other
cagagctggagctccccgcggtggcggccgctctagaactagtggatcccccgggctgcaggaattcgcacgagaccattacctagaacatcctaatcgaaaaaaggtgtaactaccgcctactgcagctcaggttgtttctcatagtcttctcttctgccgtccatccggcctgcgcgctcgctctcctgctctcctgcgccaactgggcgaccgccgacgccgacgccaacgccgacgacctacgccaggtgctgggatttttgtcggttccttccgtccttcggcagctttcgtcgcgtccttcgccggcgacgagcactcaccaggtccgctcctgaagaagactgggatattttgcatacacagaggatcatctgtgtagaggacattcagttttctccagttctccacttcctggatagcaatggcaaatgagtttcctgatgaagttcttaagtctgttttcccattgctggatggtaaagatctagtattctgcatgcttgtatgccgtcaatggcatgaaatcgcaaaggatgattacttctggaaatgcatttgctcacggaagtggccgtccatttgcaaacagcccccttctggcgcaaactacaaaaagctttacttaaccttctctaagccacgggagatgcagaacctccctgtgccnaggcttacattcgaggatattgttttctat

SEQ ID NO: 43648 - protein, 92 aa, Zea mays
  misc_feature: Ceres CLONE 1444545-F
  misc_feature (3)..(47): Pfam Name: F-box Pfam Description: F-box domain
MANEFPDEVLKSVFPLLDGKDLVFCMLVCRQWHEIAKDDYFWKCICSRKWPSICKQPPSGANYKKLYLTFSKPREMQNLPVPRLTFEDIVFY

SEQ ID NO: 43649 - DNA, 691 bp, Zea mays
  misc_feature: Ceres CLONE 1444573-F
  misc_feature: Encodes the peptide sequence at SEQ ID NO. 43650
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcgaaaaaagaagtccttttccctttcttctgaagtcgtcctcttcttcccgtcggttctgcgtgccgcacctgccatgagaggagacttcgccgcggatctcgccatgatctcgccggagaggagctcgtcacagatgctgcggtcggcggcggcgggggcgccgttcctggccatctccgtcacggatcccgtcagatgggtaccggcgtgcagtcctacatctcctaccgcgtcgtcaccttgaccagcctccctgaatttgagggaccagatgaaattgttattcggcgctgttgtgattttgaatggttgcgtgatccgcttgctgatacgtacttaggcctttttataccccctcttccggagaagaatgctgttgataaattccggtttagcatggagttcattgaattgcggcgtcgagctctggatttattctgtgacacgatagcttcccaccctgaactctggcgcagtgatgtcttgaggacatttttgcttgctcatgactagataatggatagggcaagatcttatgagactggtagttttaacaaaccggcggatttcatanttgatagcgtcgacctcgc

SEQ ID NO: 43650 - protein, 105 aa, Zea mays
  misc_feature: Ceres CLONE 1444573-F
  misc_feature (2)..(104): Pfam Name: PX Pfam Description: PX domain
MGTGVQSYISYRVVTLTSLPEFEGPDEIVIRRCCDFEWLRDPLADTYLGLFIPPLPEKNAVDKFRFSMEFIELRRRALDLFCDTIASHPELWRSDVLRTFLLAHD

SEQ ID NO: 43651 - DNA, 719 bp, Zea mays
  misc_feature: Ceres CLONE 1444575-F
  misc_feature: Encodes the peptide sequence at SEQ ID NO. 43652
aaagctggagctccccgcggtggcggccgctctagaactagtggatcccccgggctgcaggaattcgcacgagaccattacctagaacatcctaatcgaaaaaaacaggcaaacacacaacacaaccaaccacctcactcgatctctcatcactcgcaagtccagctatcaccaaccagacagagctcggctgcaagcctccaacccaaggagacagatacgttcgcagatggcgggtgcagcgaaggcgtcgtggatggtggccatgagcgtgggcgccgtggaggcgctcaaggaccagggtggcctctgccgctggaactacgcgctgcggtccgtccaccgcaccgccaaggccaacgtccgcagcagcctcgccgcgcagcgggacaaggagctggccccggcggcccactcaaagaggcggccgggcaaggccgccgcggaggaggggatgaggaccgtcatgtacctcagctgctggggacccaactaggaggactagctagggttcactggttcagctcatgccggtgctaggttcaggtcagacctggctggccttcgattgaaaataggaatacggcccccaccaatgatgatgatgacgatgaaaaggtcccgcactggatggttcaggcctgtgggccccaaaacagaaatccgggggggcctggaggcttcccaatccaaaaaaaaaaaaaaaagccttatcgatc

SEQ ID NO: 43652 - protein, 88 aa, Zea mays
  misc_feature: Ceres CLONE 1444575-F
MAGAAKASWMVAMSVGAVEALKDQGGLCRWNYALRSVHRTAKANVRSSLAAQRDKELAPAAHSKRRPGKAAAEEGMRTVMYLSCWGPN

SEQ ID NO: 43653 - DNA, 748 bp, Zea mays
  misc_feature: Ceres CLONE 1444582-F
  misc_feature: Encodes the peptide sequence at SEQ ID NO. 43654
  misc_feature (454)..(454): n is a, c, t, g, unknown, or other
aagctggagctccccgcggtggcggccgctctagaactagtggatcccccgggctgcaggaattcgcacgagaccattacctagaacatcctaatcgaaaaatatataactgcgaagtaaccctaaccgtcaatagcctccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcgggaaggacattaccgagctcattgctgctggcagggagaaatccccctcactcccatgtggcggtggcggtgtggctgtttncgcagctgcccctgctgctgggggcgctcctgcagctgaagcgaaaaaaaaaaaaaaggggggaggaaaaggaagaaagtgttgaccaccttgggctttcaccttcttcaaccaagcctggtgaaaaatcaaaaaaattgttttttaaattccggaagcccaagggaaaaaaaaacccagccctgtttggggctttaactttgttttatgtgggagagaactttaaaaaactttttccgggggaaattttaagccaaagtgttcctgctcctttgtggggttttacggggaaaa

SEQ ID NO: 43654 - protein, 102 aa, Zea mays
  misc_feature: Ceres CLONE 1444582-F
  misc_feature (17)..(99): Pfam Name: Ribosomal_60s Pfam Description: 60s Acidic ribosomal protein
  misc_feature (75)..(75): Xaa is any aa, unknown, or other
MKFVAAYLLAVLAGNSSPSAEDLTAILESVGCEVDNEKMELLLSQLSGKDITELIAAGREKSPSLPCGGGGVAVXAAAPAAGGAPAAEAKKKKKGGGKGRKC

SEQ ID NO: 43655 - DNA, 680 bp, Zea mays
  misc_feature: Ceres CLONE 1444587-F
  misc_feature: Encodes the peptide sequence at SEQ ID NO. 43656
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaactaccgcaatatggcaattcttggtgtccagggcttctctgctctgcccctgcattgtttgcagttgtgctacggattctttggatttgcagtggcagccaatctgatgagggacctcttgccaccaaagtatggcaaatgggttccattaccaatggcaatgggggttcccttcctagttggtgcgagctttgccatcgacatgtgtgtggggagcttgatggtcttcatctggcacatcattgacagaagtaaaagcatctttaatggtgcccagcagtgcatctgggtttgaaatgtggcgatgggctttggatccttcctgaaatccctgctttgccnggccaaaaatcagcccaccattgggcattgcattcaggtcctccaacctaagtaacaaaattgctcaaattctaaaaacatttcctttcccatccaaaaaaatttttgccttcccaaattttccctaaattaccggggaaaataacactgccggggggaaaaaaacccggcccctctcggggtttcccccaaaaaaaacccaaagggggcccccccaaaaaatttaaatgaacaaa

SEQ ID NO: 43656 - protein, 94 aa, Zea mays
  misc_feature: Ceres CLONE 1444587-F
  misc_feature: The sequence is a functional homolog of SEQ ID NO 774 in the 10/412,699 US patent application
MAILGVQGFSALPLHCLQLCYGFFGFAVAANLMRDLLPPKYGKWVPLPMAMGVPFLVGASFAIDMCVGSLMVFIWHIIDRSKSIFNGAQQCIWV

SEQ ID NO: 43657 - DNA, 654 bp, Zea mays
  misc_feature: Ceres CLONE 1444603-F
  misc_feature: Encodes the peptide sequence at SEQ ID NO. 43658
  misc_feature (654)..(654): n is a, c, t, g, unknown, or other
ggagctccccgcggtggcggccgctctagaactagtggatcccccgggctgcaggaattcgcacgagaccattacctagaacatcctaatcgaaaacttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtctaggttgccaaggaaccgcaggactgtgaaccgtccatatggtggtgttctgtctggtaccgcagtcagagagaggatcatccgtgcctttttggtcgaggagcagaagatcgtgaagaaggttttgaagatccaaaagaccaaggataaggcctccaagaactaggcgatataggcatcttccacaatgttcaagtcccttagatgatatggtttaaattttgagcggaagttgcggatccttttatttttttaaaatctcggtggaatgtttttcactcgtctatgn

SEQ ID NO: 43658 - protein, 119 aa, Zea mays; identical to SEQ ID NO: 13398
  misc_feature: Ceres CLONE 1444603-F
  misc_feature (5)..(103): Pfam Name: Ribosomal_L34e Pfam Description: Ribosomal protein L34e

SEQ ID NO: 43659 - DNA, 638 bp, Zea mays
  misc_feature: Ceres CLONE 1444619-F
  misc_feature: Encodes the peptide sequence at SEQ ID NO. 43660
ggagctccccgcggtggcggccgctctagaactagtggatcccccgggctgcaggattcgcacgagaccattacctagaacatcctaatcgaaaaaacctcgtctaatcgctgcggcgccagtgcccaaatctaaaccctagcgccgccaccgccatgctgcgccgcatcgccgccgtcgccccgcgggccttcttctcctcgtcacccccgcacgccccgtcgcttccggcgtcgggctacatcccgcgccgcgagtacggcctggtgcccatggtgatcgagcacacctcccgcggggagcgcgcctacgacatcttctcgcgccttctcaaggagcgcatcgtctgcatccatggccccatcaccgacgacacggcctccctcgtcgtcgcccagctgctcttcctcgagtccgagaaccccgccaagcccgttcacctctacattaactccccggggggggcgtcgtcacgggcggggcctcgcatctacgacacatgcagtacattcgctcccccgttacacgctctgcatcggccagggcgccttcatggcgtcgctactcctccccccgggggccaccggaaaaaaggcgggcccttgccaaacccccgggtcatgatccaccagccctcc

SEQ ID NO: 43660 - protein, 161 aa, Zea mays
  misc_feature: Ceres CLONE 1444619-F
  misc_feature (46)..(139): Pfam Name: CLP_protease Pfam Description: Clp protease
  misc_feature: SWISSPROT Homolog: EC 3.4.21.92 Endopeptidase Clp
MLRRIAAVAPRAFFSSSPPHAPSLPASGYIPRREYGLVPMVIEHTSRGERAYDIFSRLLKERIVCIHGPITDDTASLVVAQLLFLESENPAKPVHLYINSPGGASSRAGPRIYDTCSTFAPPLHALHRPGRLHGVATPPPGGHRKKGGPLPNPRVMIHQPS

SEQ ID NO: 43661 - DNA, 666 bp, Zea mays
  misc_feature: Ceres CLONE 1444621-F
  misc_feature: Encodes the peptide sequence at SEQ ID NO. 43662
ctccccgcggtggcggccgctctagaactagtggatcccccgggctgcaggaattcgcacgagaccattacctagaacatcctaatcgaaaaataacaaagacacgttagccgagagctcctctgctcctctcgtgtctggccgaacatgcagagcgaccagtctcaagagcgctccccatggcatcaggagatgcggcggcccctgtcgatcagactgtggtgctcaaggttgccatccactgccatgtctgcgagaagaaggtcctgaacgtgctcaggggcatcaaaggcgtgcacgacgtgactgtggacgcctctcaccacacagtgactgttacgggcaccgtggacgacgacacgctcataaagaggctgtacaagtccggcaagaagggagtgccctggacctctcacccgcccgccaataacagcgagcccgcaccggatgccccgtcggctccgcaacctgcctgcgacggccgcaaggatgctgctgctgctgctgctgtggccgcggcggacaataagtcggatgaggcggtgaaggagccgcatggcgagagctccgatgaggaggagaagaagaagaacaagcccgatcaggaccaagacgacggggcccgcataaatgaagcagcccgaagcaaagtcgtcatatgaggtg

SEQ ID NO: 43662 - protein, 160 aa, Zea mays
  misc_feature: Ceres CLONE 1444621-F
  misc_feature (14)..(75): Pfam Name: HMA Pfam Description: Heavy-metal-associated domain
MASGDAAAPVDQTVVLKVAIHCHVCEKKVLNVLRGIKGVHDVTVDASHHTVTVTGTVDDDTLIKRLYKSGKKGVPWTSHPPANNSEPAPDAPSAPQPACDGRKDAAAAAAVAAADNKSDEAVKEPHGESSDEEEKKKNKPDQDQDDGARINEAARSKVVI

SEQ ID NO: 43663 - DNA, 681 bp, Zea mays
  misc_feature: Ceres CLONE 1444626-F
  misc_feature: Encodes the peptide sequence at SEQ ID NO. 43664
ctggagctccccgcggtggcggccgctctagaactagtggatcccccgggctgcaggaattcgcacgagaccattacctagaacatcctaatcgaaaatccgctttggcaggaggcccagcccgactagggttctgtccaccttccaggtccttcgaacttccacgcattcctactactcctggctcccgcgacctgacgccgccactcctgacttcgccatccggcgatcgccacagccctagctccggcgtctctagcgatccccaaaacccactccgccgcatttctgccgacttggccggattggtcgcttattgagatggctacgccacttatagcaggacttgcagttgcagcaactgctcttgctggtcgatatggcgtccaagcttggcaagcttataaggcaaggcctatagttccaaggatgcgcaaattctatgaaggtggctttcaacctacaatgaaccgaagggaagctgcattaatccttggtgtcagggaaactgccaacgcagagaaggtaaaagaggcgcacaagagggttatggtcgccaaccatccagatgctggtggaagtcattaccttgcgtcaaagattaatgaggcgaaggatgtgttgtcagggaaaacaaaaggaggtgggtcggccttctgattgtagaattaagaatgcact

SEQ ID NO: 43664 - protein, 112 aa, Zea mays
  misc_feature: Ceres CLONE 1444626-F
  misc_feature (53)..(113): Pfam Name: DnaJ Pfam Description: DnaJ domain
MATPLIAGLAVAATALAGRYGVQAWQAYKARPIVPRMRKFYEGGFQPTMNRREAALILGVRETANAEKVKEAHKRVMVANHPDAGGSHYLASKINEAKDVLSGKTKGGGSAF

SEQ ID NO: 43665 - DNA, 654 bp, Zea mays
  misc_feature: Ceres CLONE 1444627-F
  misc_feature: Encodes the peptide sequence at SEQ ID NO. 43666
ctccccgcggtggcggccgctctagaactagtggatcccccgggctgcaggaattcgcacgagaccattacctagaacatcctaatcgaaaaatcctgttctataaagcgagccgaggggaagagccggaaccctagcccagcaccgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggccgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggcaaggagattgttgacctgtgccttgatcgcatcaggaagcttgccgacaactgcactggtctccaggg

SEQ ID NO: 43666 - protein, 133 aa, Zea mays
  misc_feature: Ceres CLONE 1444627-F
  misc_feature (49)..(133): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQ

SEQ ID NO: 43667 - DNA, 668 bp, Zea mays
  misc_feature: Ceres CLONE 1444630-F
ggagctccccgcggtggcggccgctctataactagtggatcccccgggctgcaggaattcgcacgagaccattacctagaacatcctaatcgaaaaatggatgtagggtgaccggacaccctcaattgaaatctgccctccgtcatcatctcgtctcatcatactggaggggccccacgtccaccccctcctgattatatcgccggagtccaaatcgcatctcagattcactcggccccggagccgccgccgggttcttcgcgcggaccaaggttggggctgccgagggcgaaggcgcggaggcggtggagagggagcacgggatctaccgtggcgggtggcatggggaggcgctggatctctactccgtcgcgatggctgcggagctgggccgcgcgcaaccccaccccctctacattaaccgcgccggctgatacctaaagctccagtactggcaccaggccagacaggaccggacatctgtcctcgagttcgatacggagcatgcaggagctctgatgttacatgcccatactcttatctctctgaaggattaggagttagatctgttttatgtcgccaggctcgttgagataaacccgtcgtgtgaagtgtgtcgtaacctgcaggcacgattgtaaacacaggtatcactggccccaattcct

SEQ ID NO: 43668 - DNA, 784 bp, Zea mays
  misc_feature: Ceres CLONE 1444635-F
  misc_feature: Encodes the peptide sequence at SEQ ID NO. 43669
  misc_feature (371)..(371): n is a, c, t, g, unknown, or other
  misc_feature (416)..(416): n is a, c, t, g, unknown, or other
  misc_feature (433)..(433): n is a, c, t, g, unknown, or other
  misc_feature (475)..(475): n is a, c, t, g, unknown, or other
agagctggagctccccgcggtggcggccgctctagaactagtggatcccccgggctgcaggaattcgcacgagaccattacctagaacatcctaatcgaaaaaacacaagctcgacggaactgtgactagaactagtagatccaatccaacactcgggacgaaattaaaggagacgacgcatcatccggccggcaggcatcgcacggtcaccaccatggcggcgcaggagggcggcatgaggctggtgtcgcacccgatcgcggcgcacgacgggcggctgccgcggcagtacacggcggaggggcagggcgccaagaaggacatgtcgccgccgctggagtggtacggcgtgccccagggcgcgcggtcnctggcgctgctggtgcaggacatcgacgccgaccccgtccccccntggacgcactgggtggntggcaacatcccggcccggcaccagggggctcccccgagggntcccctggcccctccggggccgggggcggggccggcccccaaacaacttcgggggcctggaggaggggggcaaacaactggaaaccacccggttggccccgggccctggcccccctctcccgggccccggaatccagtttaaagtcttatcccctccaaaaaaaaagtggcccccctgcacaaagggggaccggggtaaaacccttggggggcccctccccgggccccctcgttgaaaaaaacccaaataattcccccgttttccaggggggtcctcccccaaaaaaaataacaccccccccagaaaat

SEQ ID NO: 43669 - protein, 133 aa, Zea mays
  misc_feature: Ceres CLONE 1444635-F
  misc_feature (73)..(73): Xaa is any aa, unknown, or other
  misc_feature (87)..(87): Xaa is any aa, unknown, or other
MAAQEGGMRLVSHPIAAHDGRLPRQYTAEGQGAKKDMSPPLEWYGVPQGARSLALLVQDIDADPVPPWTHWVXGNIPARHQGAPPRXPLAPPGPGAGPAPKQLRGPGGGGQTTGNHPVGPGPWPPSPGPRNPV

SEQ ID NO: 43670 - DNA, 726 bp, Zea mays
  misc_feature: Ceres CLONE 1444637-F
  misc_feature: Encodes the peptide sequence at SEQ ID NO. 43671
  misc_feature (395)..(395): n is a, c, t, g, unknown, or other
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaaatcagcaataatctcgccgtctcatcgcaaaacccagcgcccccccccaccgaagcgtcccagcccgaccggaatggcgatggcaccgtgcgcacccgcctccgtctcctccttccccgcccgcccagtgcgggccccttccgctgtccggccgcgcgccgccgcgatccgcgccactgcggcggcggcggagggtggcaggtggtgggcgccgctgctggggtggtcggggaaggccgactaccttgaggccccggccccggtgccggcggtgctgcaggatgacgacgcgnccgcggcgcgcaggcacctcgtgggggggctgacggaagagaaagcccgccagctgcgggcgcggatggcgcaaacggattcctccacgacgccatgaaccanttcggcattggcttaggcctggccggttcgcctaaaaccggccggccgccgggcaatttggccccccccctaaattttagacctcccccgctttggggaaacagggtttcccctccaatttggggaatggctttgtttcccacaccccattttgcccctcccctcccggagacaagggggggggggggatctttcggtttttttgagggccccaaccccctcctttac

SEQ ID NO: 43671 - protein, 105 aa, Zea mays
  misc_feature: Ceres CLONE 1444637-F
  misc_feature (74)..(74): Xaa is any aa, unknown, or other
MAMAPCAPASVSSFPARPVRAPSAVRPRAAAIRATAAAAEGGRWWAPLLGWSGKADYLEAPAPVPAVLQDDDAXAARRHLVGGLTEEKARQLRARMAQTDSSTTP

SEQ ID NO: 43672 - DNA, 1221 bp, Zea mays
  misc_feature: Ceres CLONE 1444639
  misc_feature: Encodes the peptide sequence at SEQ ID NO. 43673
cactgtctggtcttccccgatcgccgcgaaagcagtaaagagtccgcaatctttgccgcccccaccctcatcctctgctctcgtatcgtctcctctccacttcctctttctctcctctacaagggtatccactatccagaatcacctctatcatcaggatgcgggaggcacagttgggctcccacacgattcagacgcacggagtgagactggccagaaagcacacacacgactgggttgttctgattcttctggctgcactggtggttgccgtgcattacgctcccccgttcagtcgatttgtcgggaaggatatgatgactgatattaggtacccggtgaaaccaagcacagtaccagcatgggctgtccctatgatctctatactctgtccctggctcgtcttcatatccatatatgttgccaggagagacgtttatgatctgcatcacgctgcactaggtgttcttttcgctgtgctgataactgcagtttttaccgatgtgataaagactgcagtagggagaccgaggccagacttcttctggcgatgctttcctgatggaaagcagttatacgatcaggtgattggcgatgtgatttgccatggtgataaaaacttcttaaaagatgggcgcaagagctttcctagtggccacacttcgtggtcttttgctggtcttggatttttgtcactctacctgtcaggcaaaattaaggccttcaatcgccaaggtcacgtggccaaactttgcatagtgatccttccgcttcttcttgcttcactcgttggggtttcaagagtagatgattatcgacaccactgggaggatgtgtttgttggcggtcttattggatttatcatggcagtgctatgttacctgcatttctttcctcctccataccatgatcaaggttgtagaccgtatgcatacttccatatgctggaagaacttcaagcggcaaattcaaacaacgcacaaaaccaacagtccacaggtgatcatcgcattggcatgtccgagcagcagcataacaggacatcaagaaacgatttggaatctggaaccgtgtaacatgcctcctgcacttttactgaagtagcagcagcgatgtacattggacagtaagtgcaacctaacctagtatgcgtgtactcgacatgtgttacaatctatataattagaggtatatagtttctccttaaaaaaaaaaaaaaaa

SEQ ID NO: 43673 - protein, 305 aa, Zea mays
  misc_feature: Ceres CLONE 1444639
  misc_feature (99)..(249): Pfam Name: PAP2 Pfam Description: PAP2 superfamily
  misc_feature: SWISSPROT Homolog: EC 3.1.3.4 Phosphatidate phosphatase
MREAQLGSHTIQTHGVRLARKHTHDWVVLILLAALVVAVHYAPPFSRFVGKDMMTDIRYPVKPSTVPAWAVPMISILCPWLVFISIYVARRDVYDLHHAALGVLFAVLITAVFTDVIKTAVGRPRPDFFWRCFPDGKQLYDQVIGDVICHGDKNFLKDGRKSFPSGHTSWSFAGLGFLSLYLSGKIKAFNRQGHVAKLCIVILPLLLASLVGVSRVDDYRHHWEDVFVGGLIGFIMAVLCYLHFFPPPYHDQGCRPYAYFHMLEELQAANSNNAQNQQSTGDHRIGMSEQQHNRTSRNDLESGTV

SEQ ID NO: 43674 - DNA, 643 bp, Zea mays
  misc_feature: Ceres CLONE 1444642-F
  misc_feature: Encodes the peptide sequence at SEQ ID NO. 43675
  misc_feature (571)..(571): n is a, c, t, g, unknown, or other
  misc_feature (643)..(643): n is a, c, t, g, unknown, or other
acccgcggtggcggccgctctagaactagtggatcccccgggctgcaggaattcgcacgagaccattacctagaacatcctaatcgaaaaacaagtcatcaccgaccgcatccgcatctcgtcgtcctcaccatgccgatccggcgtcagcgctagggttagggtctcctctgcgcctttatcgccatggctcctaacgaagccgctagcatcaccaccccgtccgagccggagagcgtgggcggcagtgagatgagcagcgaagacatggccgccgccagtccgctcctctcgtcgtcctccccctccccttccccctccgcggactccgcagccccggtgctggagagcatagaggaactggaccggaagtacgcaccgtacgcgcggcgggacgcgtacggaccgatggggctcggccccgtgagcgcagcggaggcggcgcggctggggtttgccgcggtcgtgctggtcccgctccgtgtcgtggcaggcgttctcgtactcgtggtctactacctcgtgtgccgcgtgtgcacgctgcgggtggaggaggaccgggaaggcggcnaaaggggatgggtacccccggttgaacgggtggaagccgggcgggggctgtgccgtgcgggcgcgcactcgn

SEQ ID NO: 43675 - protein, 152 aa, Zea mays
  misc_feature: Ceres CLONE 1444642-F
  misc_feature (129)..(129): Xaa is any aa, unknown, or other
MAPNEAASITTPSEPESVGGSEMSSEDMAAASPLLSSSSPSPSPSADSAAPVLESIEELDRKYAPYARRDAYGPMGLGPVSAAEAARLGFAAVVLVPLRVVAGVLVLVVYYLVCRVCTLRVEEDREGGXRGWVPPVERVEAGRGLCRAGAHS

SEQ ID NO: 43676 - DNA, 736 bp, Zea mays
  misc_feature: Ceres CLONE 1444648-F
  misc_feature: Encodes the peptide sequence at SEQ ID NO. 43677
aaaagctggagctccccgcggtggcggccgctctagaactagtggatcccccgggctgcaggaattcgcacgagaccattacctagaacatcctaatcgaaaacctcagccctctggcctcggcggcgctcaaaccttcgccgtcccgccgtctccaaaaccctcttaccatggccgccgcgacaaccgcgggggccggagccgcgacgccgcagccgccacggcagtacaagctagctccgcagagcgagctgcgtgtggaggtgctccccgacgcgcccctccgagtgcgcctcgtcactggcaccgcagagatcttcggcaccgagctgcctccggagggctgggtccccgtccctccccgatccaagatcgccattttcacctggcacggcgcgacggtggaactggacccccccagcgagagcgagtacacgtctgacgagactccaatggtaatttatgtcaacacgcacgccattctggatgcccgcagggcaagggcgagaacagccgcagctcagggggggcgataaggaggcatcacagggacctagagtgattgttgtggggccaacagattctggaaaaagtactctctgcaaaatgcttcttaactgggctgccaaactgggctggaagcctacgtatgtcgatttagatatgggcccagggatctataacgatcccctgaatgaattttcggccaccccaattgagaaaccttatagaataa

SEQ ID NO: 43677 - protein, 121 aa, Zea mays
  misc_feature: Ceres CLONE 1444648-F
MAAATTAGAGAATPQPPRQYKLAPQSELRVEVLPDAPLRVRLVTGTAEIFGTELPPEGWVPVPPRSKIAIFTWHGATVELDPPSESEYTSDETPMVIYVNTHAILDARRARARTAAAQGGR

SEQ ID NO: 43678 - DNA, 798 bp, Zea mays
  misc_feature: Ceres CLONE 1444666-F
  misc_feature: Encodes the peptide sequence at SEQ ID NO. 43679
  misc_feature (307)..(307): n is a, c, t, g, unknown, or other
  misc_feature (322)..(322): n is a, c, t, g, unknown, or other
  misc_feature (412)..(412): n is a, c, t, g, unknown, or other
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaaagtctacgccggcctaacgccttgggacctccgctgctgttctctcgccggtcatttttggttcacgggctgatcgcttgatcggatcggtgtcgcagccctatacatcatacatgacgacgcccggctcctgtcctgcgacaaccgccgccacccaccctcccatgtgcgccggtagcgcctcacgtggatcccaaaaaaaggngcgtccgcgactagngctcttcggggactccatccccaacccagactttcagccccggtgggtgggggggcccaccttggccgatactcactccgcgcagggggngnccccccccgggaagggtcccccctcctaccactccaagagggggatccttgttttgagccaatcgacattctttccttctggggagggttaaaaaacacccctcctggaaccctccctttattccttttggagaccaaagtaaccataactccttgttaggaacgaactgggcgaaaccaaaaaccctgttccccgttgccgggaaatcggaaaattactccttaaaagtgatgccgaatattctgtaaagagaaatgtggttagaggcccgttgttttacgcgtgtccccgcacccctcccccccctttgcttataaggatcggagcgcggagaaatttctcccatgatttcctattgccataaaatccccggaaatccatcc

SEQ ID NO: 43679 - protein, 79 aa, Zea mays
  misc_feature: Ceres CLONE 1444666-F
  misc_feature (14)..(14): Xaa is any aa, unknown, or other
  misc_feature (19)..(19): Xaa is any aa, unknown, or other
  misc_feature (49)..(49): Xaa is any aa, unknown, or other
  misc_feature (50)..(50): Xaa is any aa, unknown, or other
MCAGSASRGSQKKXRPRLXLFGDSIPNPDFQPRWVGGPTLADTHSAQGXXPPGKGPPSYHSKRGILVLSQSTFFPSGEG

SEQ ID NO: 43680 - DNA, 667 bp, Zea mays
  misc_feature: Ceres CLONE 1444673-F
  misc_feature: Encodes the peptide sequence at SEQ ID NO. 43681
ggagctccccgcggtggcggccgctctagaactagtggatcccccgggctgcaggaattcgcacgagaccattacctagaacatcctaatcgaaaagcccccgtccctggtcggaccacgagagccccggactgcgttcacctctgccttttgttcacccctgcacgcattctctgccgctcttgtctcgtgcgtgcgacaacaactgggcgaccgccgccgccgccgccgccgccgccgccctacgccaggtgcgcaggtcttcgtcggatccttcgccggcgaggcgacgagcacccaccaggtgatgcccccggcttaattgaatgggctctcttctcaccaggactggcgtcctgccatggctccaggccaagatcgtggatcccgtgctgcaggtcatcagaaggggagcagaacccaagcaactggccttctctgctgccctcggtgtcacgattgggatctttccgatatgtgggaccactgttattcttggtgctgttgttgtagcaatgttgggaagtcgttgcaatgctgttactcttatggttctaaatttggccgccactccaattgaactaagcttgatcgttcctttcttgcgtttgggtgaagctgtcaccggcagcgggcacttccccttgacggccgacgcactgaagaa

SEQ ID NO: 43681 - protein, 113 aa, Zea mays
  misc_feature: Ceres CLONE 1444673-F
MGSLLTRTGVLPWLQAKIVDPVLQVIRRGAEPKQLAFSAALGVTIGIFPICGTTVILGAVVVAMLGSRCNAVTLMVLNLAATPIELSLIVPFLRLGEAVTGSGHFPLTADALK

SEQ ID NO: 43682 - DNA, 685 bp, Zea mays
  misc_feature: Ceres CLONE 1444674-F
  misc_feature: Encodes the peptide sequence at SEQ ID NO. 43683
atagctggagctccccgcggtggcggccgctctagaactagtggatcccccgggctgcaggaattcgcacgagaccattacctagaacatcctaatcgaaaaacccgtgctctctccctcatcccctgcgcataggaagccagctccttcatgtcgcctcctccctaggcggcgatcctacagagcctcgccgatcatccctgctccctcggcgtctctcccatggcgccctccctgctccttcacatggtgtggacgccagccccctctcttgttgccatggatagcccctctcccatctccttccccaagcacaagtcccatggtcgcccaaccccagctcgccctgccccagccatggacgctgtcgagccgcccgtttcctatctcccctcgccttcatcctctggctgccgcccctccctggatttcaccctctctactcgtcgatcttctctgttgtggcgcgcactggctgtcttccacctccatcggaccacgccgagctccctccttgctccagtcttctccatggtcgctcctctcctttccctgattaatactaggcgcagcagcaacatgccagatctctgtagcccagacgagcaagccactgtgggaactgaggttcaacaagtagaggtagctgaacaggagctccttgaaggagaagaacaggtggttc

SEQ ID NO: 43683 - protein, 35 aa, Zea mays
  misc_feature: Ceres CLONE 1444674-F
MPDLCSPDEQATVGTEVQQVEVAEQELLEGEEQVV

SEQ ID NO: 43684 - DNA, 686 bp, Zea mays
  misc_feature: Ceres CLONE 1444682-F
  misc_feature: Encodes the peptide sequence at SEQ ID NO. 43685
  misc_feature (411)..(411): n is a, c, t, g, unknown, or other
  misc_feature (486)..(486): n is a, c, t, g, unknown, or other
ctggagctccccgcggtggcggccgctctagaactagtggatcccccgggctgcaggaattcgcacgagaccattacctagaacatcctaatcgaaaatccgactgctcccagtggctggacgcgcagccgccgggctccgtgctctacgtctccttcggcagctacgcgcacgtcacccggcaggagctgcacgacatcgcggccggggtcctcgccagcggcgccaggttcctgtgggcgatgcggccggacatcgtcagctccgacgacccggacccgctgcccgagggcttcgcggccgcctccgccggccgcggcctcgtcgtgccctggtgctgccaggtggaggtgctcgcccacgccgcgctcgccggcttcctcacgcactgcggctggaactccgtcctcnagagcgtgtgggccggcgtgcccatgctctgcttccccctgctcaccgaccagttcaccaaccggcggctcgtcntgcgcgagtggcgcgtcggcgtgcccatcggcgaccgcggcaaggtgttccccgacgaggtgagcgccaggatccagggcgtcatatccggtcaaggaggccagcagctccgccaggcgctcaggaaggtgacgggcaagctcaaggccgcccgcggcgcccggcgggtcgtccgcagaggagctccgacgacttcgtcc

SEQ ID NO: 43685 - protein, 228 aa, Zea mays
  misc_feature: Ceres CLONE 1444682-F
  misc_feature: SWISSPROT Homolog: EC 2.4.1.121 Indole-3-acetate beta-glucosyltransferase
  misc_feature (137)..(137): Xaa is any aa, unknown, or other
  misc_feature (162)..(162): Xaa is any aa, unknown, or other
GAPRGGGRSRTSGSPGLQEFARDHYLEHPNRKSDCSQWLDAQPPGSVLYVSFGSYAHVTRQELHDIAAGVLASGARFLWAMRPDIVSSDDPDPLPEGFAAASAGRGLVVPWCCQVEVLAHAALAGFLTHCGWNSVLXSVWAGVPMLCFPLLTDQFTNRRLVXREWRVGVPIGDRGKVFPDEVSARIQGVISGQGGQQLRQALRKVTGKLKAARGARRVVRRGAPTTSS

SEQ ID NO: 43686 - DNA, 651 bp, Zea mays
  misc_feature: Ceres CLONE 1444684-F
  misc_feature: Encodes the peptide sequence at SEQ ID NO. 43687
ccccgcggtggcggccgctctagaactagtggatcccccgggctgcaggaattcgcacgagaccattacctagaacatcctaatcgaaaagaggccagggtgcagcagcaggacccccaacggcaacctccgccacgcaccacggagcaaccaagcagcaggtaaggcaaggtaagtgacgagacaaagatggtgcaggaggagatgccgcaggcatggtggttcgacagccacaacctcgcgaggccgtcgccatggctgaacagcacgctctcagagctggatgacaagaccaagcaaatgctgaagctgatcgaccaagacgcggactcgttcgcccagcgcgccgaaatgtactacaagaagcggccggtgctggtggacatgctcggcgacctgtaccgcacgcaccgctcgctggcggagcagtacgacctgctgaagcacggcagcggcgcgcggcacacggtgttcggcctgtcctcctgcacacagagccggtcgtcgacgaacggcaggaccactcctcgctcctcctgctcggcctctacgtacgactcggagtccgaagtggacgaccccgggcaggaagaatacgaggcagagcagctggcgcgtgcggggatggccaagacggagcagcagcaagaa

SEQ ID NO: 43687 - protein, 154 aa, Zea mays
  misc_feature: Ceres CLONE 1444684-F
  misc_feature (9)..(82): Pfam Name: KIP1 Pfam Description: KIP1-like protein
MVQEEMPQAWWFDSHNLARPSPWLNSTLSELDDKTKQMLKLIDQDADSFAQRAEMYYKKRPVLVDMLGDLYRTHRSLAEQYDLLKHGSGARHTVFGLSSCTQSRSSTNGRTTPRSSCSASTYDSESEVDDPGQEEYEAEQLARAGMAKTEQQQE

SEQ ID NO: 43688 - DNA, 725 bp, Zea mays
  misc_feature: Ceres CLONE 1444692-F
  misc_feature: Translation starting site: 459
  misc_feature (43)..(43): n is a, c, t, g, unknown, or other
ggggaggtccaaaataattttttcggtttagtgtttggttttngggaaaaacaaaaaagctgggactccccgcggtggcggccgctctatactagtggatcccccgggctgcaggtattcgcacgagaccattacctagaacatcctaatcgaaaaagttggccgtcctcctgagctgcggcggccgcatcgattgctagggtggaaatcccttctcccggggatgttgggctctcgggaacagacaggaggatccgcgggaaggattcagctgcgtgcctagtgtagtgtcaacatggctgggggcaaggagaacgctctcgacctgtcgaagttcgtcgacaaaggcgtctaggtgaagctcaccggcggacgcgaagtgacgggaactttaaagggatatgaccagttactcaggcgattgctagatcaccccccccaatattaaacatagtaagatgatctatttccacctatcatggaaaacccgaccgcttggcctcattgtgtgcagaggcacagcagtcatgctgggctcaccgactgacggaaccgatgagatcgcctaccctttacttgcgcaaggagcataagcttgcacttggtccattattaagaaccgagctctcatgtccccctcagaacgatgtgtccgagaggggaaacgaacgctatactcgtacccgatgaggatgaactccgcaatattccccgtgcaagtggaa

SEQ ID NO: 43689 - DNA, 684 bp, Zea mays
  misc_feature: Ceres CLONE 1444696-F
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (109)..(109): n is a, c, t, g, unknown, or other
  misc_feature (110)..(110): n is a, c, t, g, unknown, or other
  misc_feature (121)..(121): n is a, c, t, g, unknown, or other
  misc_feature (122)..(122): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (156)..(156): n is a, c, t, g, unknown, or other
  misc_feature (157)..(157): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (298)..(298): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (314)..(314): n is a, c, t, g, unknown, or other
  misc_feature (330)..(330): n is a, c, t, g, unknown, or other
  misc_feature (337)..(337): n is a, c, t, g, unknown, or other
  misc_feature (484)..(484): n is a, c, t, g, unknown, or other
ccccnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggnnnnnccccggnnggggggggggnngnnnnnnnnnnnnnnnnnnngggggnnnnnnccnnccnnnnncnnnnnnnnnnnnnnnnnnnnnnnnnnnnnnnnnnnncnnnnnnnnnnnnnnnnnnnnnnnnnnnnnnnnnnncgnnnnnnnnnnnnnnnnnnnnncccgctcannnnnnncccaaggcctggagactccaccncggnnntggcggccgnctctataactagtggnatccccncgggctgcaggaattcgcacgagaccattacctagaacatcctaatcgaaaagctgattgttgttcagacagaggaaggaaggaaggaaaggaggagatcagaagcatcagccatgtcgaactcggcgtcgggaaatgggcccgggntttttgggtgggaacccgaaaaaatggccaaaaaactttccaaggttttccccctggggaaaacctcccaaggggcgcgggaaaaaaaggaaaagggggaaaagccccctttttttccccccggggttttttttccccatttcccgggggggtttcccaaggggaaatttccccaaaaacccgggaaggggaaaacccgt

SEQ ID NO: 43690 - DNA, 684 bp, Zea mays
  misc_feature: Ceres CLONE 1444699-F
  misc_feature: Encodes the peptide sequence at SEQ ID NO. 43691
tagctggagctccccgcggtggcggccgctctagaactagtggatcccccgggctgcaggaattcgcacgagaccattacctagaacatcctaatcgaaaaatcaaccctaaaccacccactatacccgcccgcccggctagggttttgccaccatggccgccgccgcggccgccgcccggaggctcctctcccgccgcgcctcctcgaactcgctctccgcgttcctccgccgcggcgctgccccggagcagtcgctgctgcgcccggccgtcgtcgcggcggcctcccgcctcggcttcccgcgcgggatggcgcggcgacctggcggggacggctacggcgcgggccgggaccgcgcgcccaccgagatggcgccgctgttccccggctgcgactacgagaactgccccaccccgatggacaagcccggcggggagggcgccaccaagcagcagatgatcgactgctacatccagaacctcgccaaggtccctcgcaatcgaggaggaggcgaagaagaagatctacaacgtcctcgtgcgaagctctattttcgggttccgggtgccgagatcgatggagggagacttcttaacaaggctccgaggggggccccccggggtgttccccctttgtcggcaacccggattccctttgtttgaccccctgaagtaacaaagaa

SEQ ID NO: 43691 - protein, 169 aa, Zea mays
  misc_feature: Ceres CLONE 1444699-F
MAAAAAAARRLLSRRASSNSLSAFLRRGAAPEQSLLRPAVVAAASRLGFPRGMARRPGGDGYGAGRDRAPTEMAPLFPGCDYENCPTPMDKPGGEGATKQQMIDCYIQNLAKVPRNRGGGEEEDLQRPRAKLYFRVPGAEIDGGRLLNKAPRGAPRGVPPLSATRIPFV

SEQ ID NO: 43692 - DNA, 676 bp, Zea mays
  misc_feature: Ceres CLONE 1444702-F
  misc_feature: Encodes the peptide sequence at SEQ ID NO. 43693
ctggagctccccgcggtggcggccgctctagaactagtggatcccccgggctgcaggaattcgcacgagaccattacctagaacatcctaatcgaaaagcaacgattacggtaacgccgtcgccgccctacggctcagatcttcgtcgtcatcttctccggcaacgagcacccaaggatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagttccaagcttcatacgcaacagttcttaaggcccatatgcatgctctgaagaaaagggagaggaaagacaagaagaaggctgcagatgctgagaaggcaattgagaccgcacccaagaagcagaagaaagcatcttcaaagaaatcttcggggtccaagtcataaggcgctcgcagaaatcagtgtcttctcccttctgttgttaccgcaccgccagactaattagagtgtcgtgaattttatctggtttttatccgaatgtgtgtct

SEQ ID NO: 43693 - protein, 131 aa, Zea mays; identical to SEQ ID NO: 43322
  misc_feature: Ceres CLONE 1444702-F
  misc_feature (4)..(93): Pfam Name: SRP14 Pfam Description: Signal recognition particle 14kD protein

SEQ ID NO: 43694 - DNA, 658 bp, Zea mays
  misc_feature: Ceres CLONE 1444704-F
  misc_feature: Encodes the peptide sequence at SEQ ID NO. 43695
tccccgcggtggcggccgctctagaactagtggatcccccgggctgcaggaattcgcacgagaccattacctagaacatcctaatcgaaaatttttgtcctcaacagtgatgtcataagtgaatacccatttgctgaactcatcgaatttcacaagtgtcatggtggtgaggcaacaattataggtcactaaggtggatgaaccatcaaaatacggtgttgtggttatggaggacgcaactggcagcgtggaaaggtttgttgagaagccaaaaatatttgcgggtaacaagatcaatgctgggatttacttactgaacccatctgtccttgaccgcattgagctgatgccaacatctattgagaaagaagtcctccctcaaattgcagctgatcaacagctctatgcaatggtccttccacgtttttggatggatgatggtcaccctatggactacattactggcttgcgtctttatctagactcgattaggaagaaatcagctgccaagctagctactggagcacatgttgtaggcaatgtgctggagcatgagaacgccaagattggagaaagttgtctgactggtcctgatgtggccattggacctgggtgtgttgtggaggacagcgtgaggctttcccgctgcactgtcatg

SEQ ID NO: 43695 - protein, 144 aa, Zea mays
  misc_feature: Ceres CLONE 1444704-F
  misc_feature: SWISSPROT Homolog: EC 2.7.7.13 Mannose-1-phosphate guanylyltransferase
MEDATGSVERFVEKPKIFAGNKINAGIYLLNPSVLDRIELMPTSIEKEVLPQIAADQQLYAMVLPRFWMDDGHPMDYITGLRLYLDSIRKKSAAKLATGAHVVGNVLEHENAKIGESCLTGPDVAIGPGCVVEDSVRLSRCTVM

SEQ ID NO: 43696 - DNA, 670 bp, Zea mays
  misc_feature: Ceres CLONE 1444718-F
  misc_feature: Encodes the peptide sequence at SEQ ID NO. 43697
ctccccgcggtggcggccgctctagaactagtggatcccccgggctgcaggaattcgcacgagaccattacctagaacatcctaatcgaaaaaatccggagtatggtgctcagggtgtaactttagctcagttttcgttccagatacctagacctctacggcaggactatgtgaaaaagaaaccgaagttgataaatccaagtgatgaagcaatgaaacccatagcctgggcagttgctacaaaacacgagggcgatgccagtgaagaagcttctctcaccgatgaggcacctacatcagaagtcatgctagcccggaagagaaaagcaggaagctctttgtcggtagagccaaaccatctctctgatgaacttgaaccaaagctggaggatgcttagaacggggagacgtctacctgataagtaaaagttagcagcatcgtgatgccaactgccccctatcatggttttattggccctctgcttgtttctcatttccctttggagccagtttctctgttttgcgaggtcacacaagccttatttgtagtattacaacacagaagctggctgacccaaaatccgacactctgggggcagcaacttaacaaaatgtttgtacgagggtttagagccccacggtgcttctttggataagtatgtttattacc

SEQ ID NO: 43697 - protein, 131 aa, Zea mays
  misc_feature: Ceres CLONE 1444718-F
PRGGGRSRTSGSPGLQEFARDHYLEHPNRKNPEYGAQGVTLAQFSFQIPRPLRQDYVKKKPKLINPSDEAMKPIAWAVATKHEGDASEEASLTDEAPTSEVMLARKRKAGSSLSVEPNHLSDELEPKLEDA

SEQ ID NO: 43698 - DNA, 655 bp, Zea mays
  misc_feature: Ceres CLONE 1444722-F
  misc_feature: Encodes the peptide sequence at SEQ ID NO. 43699
  misc_feature (574)..(574): n is a, c, t, g, unknown, or other
  misc_feature (575)..(575): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
ggagctccccgcggtggcggccgctctagaactagtggatcccccgggctgcaggaattcgcacgagaccattacctagaacatcctaatcgaaaattccaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaggtcactgtccaccacttccatggaaacaatgtcgaccttggaactgcctgtggtaaatactttcgggtctgctgcctcagcattattgatcctggtgattctgatatcatcaagactacaccgggtgagcagtaaagaagcccctgcagtagggggatcttactgcatttgttcttctgtnnctgttaaaacagcaatttaccctgctaagaaaatggaggttattccggaacatttggcctttgaaaatgtgtaannnnnn

SEQ ID NO: 43699 - protein, 112 aa, Zea mays; identical to SEQ ID NO: 21066
  misc_feature: Ceres CLONE 1444722-F
  misc_feature (12)..(106): Pfam Name: Ribosomal_L7Ae Pfam Description: Ribosomal protein L7Ae/L30e/S12e/Gadd45 family

SEQ ID NO: 43700 - DNA, 676 bp, Zea mays
  misc_feature: Ceres CLONE 1444725-F
  misc_feature: Encodes the peptide sequence at SEQ ID NO. 43701
ggagctccccgcggtggcggccgctctagaactagtggatcccccgggctgcaggaattcgcacgagaccattacctagaacatcctaatcgaaaagaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgctctcccccccaaactccacgagcccaagaagaccgtcaaagcggagtagcggccgctgctgccttgcttctcgtgctgctgttcctggattggaaaggtggatctgaccctttcctttgagttgaattgaagtagccctgaacctgggggaagttccgcctttttaaatcctaagcctgctgattgaaccttcaaataaaaatctttggcccaaaaaaaacttttctggggggccccacctggttgccccgctccaacctgtttttatttga

SEQ ID NO: 43701 - protein, 104 aa, Zea mays
  misc_feature: Ceres CLONE 1444725-F
MVRKAKVEFDEQPPDNFDPKNPYADPVAMLEYREHLVREKWIQIETAKIIRERLRWCYRIEGINHHQKCRHLVDQYLEATRGVGWGKDALPPKLHEPKKTVKAE

SEQ ID NO: 43702 - DNA, 652 bp, Zea mays
  misc_feature: Ceres CLONE 1444730-F
  misc_feature: Encodes the peptide sequence at SEQ ID NO. 43703
ggagctccccgcggtggcggccgctctagaactagtggatcccccgggctgcaggaattcgcacgagaccattacctagaacatcctaatcgaaaaacccagagctctctcggtctcggtctcggtctctcactctcttgtgtcttgtcctcgcagttctaaaccctagccgccaaaccaacacgagcagctgtcgccctccaggccggccgagcggggcgccgggcaccgtcgcgccgagctgagcggagagtggagcacctgcaccgagcggccagcggtgcgccgacgcgccgtgcgccgagcacctgagtggccagcggggcgcccagcactcgtctagtcgtcttctctgatcctgggcgtgcctgccaatgagcaagaagaggaagcatctggatccagcgaactcgttgaaagacagcgaacaagtagtcgcctcagatttcataagaggagacgatcttgatgacctattatcgaagcttatcaggagtgtggagattgccaaggcttcaaggggaggcttaccagaaaagatatggatgaagcaacaatttgctatcggcgtcaatgatgtcacaagggttcttgagcgaatgccgcattctgtcactgctcatcctgctcaaatgtctaatgaagcaccaac

SEQ ID NO: 43703 - protein, 92 aa, Zea mays
  misc_feature: Ceres CLONE 1444730-F
MSKKRKHLDPANSLKDSEQVVASDFIRGDDLDDLLSKLIRSVEIAKASRGGLPEKIWMKQQFAIGVNDVTRVLERMPHSVTAHPAQMSNEAP

SEQ ID NO: 43704 - DNA, 661 bp, Zea mays
  misc_feature: Ceres CLONE 1444745-F
  misc_feature: Encodes the peptide sequence at SEQ ID NO. 43705
ccccgcggtggcggccgctctagaactagtggatcccccgggctgcaggaattcgcacgagaccattacctagaacatcctaatcgaaaaataactttgatggctacaggttgagggttgaattagctcatggtggcagaggccagtcttattcttatgatcgttcaagcagctatagcagtgcatgccgtggaggtgtttctaggcgctctgatttccgtgttatggtcactggtttaccctcatcggcatcgtggcaagatctgaaggaccacatgcggcgcgctggtgatgtctgtttctctgatgtataccgtgaggctggagaaactattggaatttgtggattatacaattatgacgatatgaaatacgcggatagggaagcttgatgactcacagttcaggaatgcatttttcagagcatatatcagggtgaaggagtatgatgctagatcccgaagcagaagccgtagccccttctactcttaaagcccccgctacgggaggacccggagtccaaaaatcgttttcccagccccccccctctgggggaaaaaagggttcccttttggtttttcccaaaaattggccccagcgggcaaattggggggctggccttgaaaaaaacctcgggagttttttaaaaaacccggagggg

SEQ ID NO: 43705 - protein, 55 aa, Zea mays
  misc_feature: Ceres CLONE 1444745-F
MVTGLPSSASWQDLKDHMRRAGDVCFSDVYREAGETIGICGLYNYDDMKYADREA

SEQ ID NO: 43706 - DNA, 700 bp, Zea mays
  misc_feature: Ceres CLONE 1444747-F
  misc_feature (362)..(362): n is a, c, t, g, unknown, or other
ggagctccccgcggtggcggccgctctagaactagtggatcccccgggctgcaggaattcgcacgagaccattacctagaacatcctaatcgaaaaagaatcgctcgttccctgtccctcctcctgtgtgcggcgccgccgctgcgcacaggccacatctcctcgccctactccacatctgcgggcaatgcgctcacttctcaggccctcctcgatatctcctcggctccaccccatccacttcctgtccaagactggctacagagctcgacggtagcggcccttctccaagactgcagctgaggtgctcggcggctgcgagcacgaagctgatgtagctcgacccgaccagttcatcgtangcactatcacggtgcagcagcaacagcatcgagggcgttcccttgactaaacagacaacttcttctgtgaaagtaaaagcaaggataattatgggttaatggaggatggggaaaaaccccccctcccagccgaacccccctaggcccctattgccacggaaacaattccccttttcccaatgggaaaagaccgcccccccccacccttggggttttcccccccccaaaagttagcggccccccccggaaaaaaaaaagggggggaagaaaacttttcccccggcccttaaaaacccctgggggaggttcccccccctccccgggagggaaacaccccc

SEQ ID NO: 43707 - DNA, 635 bp, Zea mays
  misc_feature: Ceres CLONE 1444753-F
  misc_feature: Encodes the peptide sequence at SEQ ID NO. 43708
ctggagctccccgcggtggcggccgctctagaactagtggatcccccgggctgcaggaattcgcacgagaccattacctagaacatcctaatcgaaaacttcctcctcatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccagcatggatctgctcgacctcctcctgtcaaaaggagaggagagcagcctgtcggctgcgtccacgctgtcctgcggctcgccaccgcggcgggcgtcaaaccccgtgtccacgacagccggttcggcgtggactgcccgcccctg

SEQ ID NO: 43708 - protein, 95 aa, Zea mays
  misc_feature: Ceres CLONE 1444753-F
MSHFAAAAVKSPLAVAAPAAGDAKSPLFCPKPRRPAAPLRCHQGGDASMDLLDLLLSKGEESSLSAASTLSCGSPPRRASNPVSTTAGSAWTARP

SEQ ID NO: 43709 - DNA, 618 bp, Zea mays
  misc_feature: Ceres CLONE 1444755-F
  misc_feature: Encodes the peptide sequence at SEQ ID NO. 43710
  misc_feature (274)..(274): n is a, c, t, g, unknown, or other
  misc_feature (292)..(292): n is a, c, t, g, unknown, or other
  misc_feature (384)..(384): n is a, c, t, g, unknown, or other
acccgcggtggcggccgctctagaactagtggatcccccgggctgcaggaattcgcacgagaccattacctagaacatcccaatcgaaaagaaggttccagcgagcgactgtgtcgagcaggagagagcgcgatggggaagatgcggcagctgatctgcctcgtggccgccgtcgccgccgcggccatcctcctgacagcgtcggccaagaagtccggcgacgtcaccgagcttcagatcggcgtcaagtacaagcctgagtcatgtacgctgncagcacacaaaggagacnaaattaaggttcactatcgtgggacactcactgatggatcagttttcgattctagctatgacagaagtgacaccgtttgattcactcttggnaatggccaagtgattaaaagttgggaacaaagattgctcggtatgtgcgtgggtgaaaagagaagctaaagatacctgccaagatgggttataggtgagcgaggctccccaaccaagaatcccagtggagcaactctgattctcgacacggagcctatcgcccgtcacgggagacaatcccggcggtgcaagggcagagagtgacagtgagctctgatacatgcaattggagaa

SEQ ID NO: 43710 - protein, 79 aa, Zea mays
  misc_feature: Ceres CLONE 1444755-F
  misc_feature: SWISSPROT Homolog: EC 5.2.1.8 Peptidylprolyl isomerase
  misc_feature (48)..(48): Xaa is any aa, unknown, or other
  misc_feature (54)..(54): Xaa is any aa, unknown, or other
MGKMRQLICLVAAVAAAAILLTASAKKSGDVTELQIGVKYKPESCTLXAHKGDXIKVHYRGTLTDGSVFDSSYDRSDTV

SEQ ID NO: 43711 - DNA, 725 bp, Zea mays
  misc_feature: Ceres CLONE 1444757-F
  misc_feature: Translation starting site: 185
  misc_feature (363)..(363): n is a, c, t, g, unknown, or other
  misc_feature (377)..(377): n is a, c, t, g, unknown, or other
  misc_feature (442)..(442): n is a, c, t, g, unknown, or other
  misc_feature (443)..(443): n is a, c, t, g, unknown, or other
  misc_feature (499)..(499): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctagaacatcctaatcgaaaatcaactcgcaatttcgcattcgtccaaactcttgagcactttctcctcgtccccgacaagccactcgaagccgagatacggccatggactccaccggcaccggagcagcggggaagggaaagaagggagcggccgggcgcaaggtcggcgggccaaggaagaagtcggtgtcgaggtccgtgaaggctgggctccagttccccgtcggccgcatcgggcgctacttgaagaagggcgctacgcgcagcgtgtcggcaccggngcccccgtctaccntcgcgctgtcctcgaatacctcgccgctgaaggtctggagctcgccggtaatgctgccaggaacnnacagaagactcgcattatttccgcgccacgtgctttctggcgatccgggaacgacnaagnacctcgggaaagctggctgggcggcgttgacaatcgcctcacggaaagggtggctccccaatttccaaccctggttctgctgccccaaaaaaacgggggaaaaagggctcccaggggcgggaaccaagggaggcaaattccccccaaaaaaggccccccaagtcccctaaaaaaggcaataaccgaaacttccccggaggttttctagattttttacccatc

SEQ ID NO: 43712 - DNA, 634 bp, Zea mays
  misc_feature: Ceres CLONE 1444762-F
  misc_feature (450)..(450): n is a, c, t, g, unknown, or other
  misc_feature (451)..(451): n is a, c, t, g, unknown, or other
  misc_feature (459)..(459): n is a, c, t, g, unknown, or other
  misc_feature (523)..(523): n is a, c, t, g, unknown, or other
  misc_feature (536)..(536): n is a, c, t, g, unknown, or other
  misc_feature (553)..(553): n is a, c, t, g, unknown, or other
  misc_feature (607)..(607): n is a, c, t, g, unknown, or other
tggagctccccgcggtggcggccgctctataactagtggatcccccgggctgcaggaattcgcacgagaccattacctagaacatcctaatcgaaaacggccggaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaagtcggcaaaacggatccgtaacttcgggaaaaggattggctctgagggttgggctcgggggtcccggccccgaacccgtcggctgctggcggaatgctcgagctgctcgcgcggcgagagcgggccgccgcgtgccggccgggggacggacccccaacggccccctcgggggccttccccgggcgtcgaacnnccgactcngaactggttcggacaaggggaatccgactgtttaattaaaacaaagcattgcaaaggtcctccnagatgctgacgcnatgtgatttcttcccantgctctgaatgtcaaattgaagaaattcaaaccacccccgggtaaacggccggnactaactattaaattttttaaggaatg

SEQ ID NO: 43713 - DNA, 668 bp, Zea mays
  misc_feature: Ceres CLONE 1444763-F
  misc_feature: Translation starting site: 223
  misc_feature: Pfam Name: MGS Pfam Description: MGS-like domain
ctccccgcggtggcggccgctctagaactagtggatcccccgggctgcaggaattcgcacgagaccattacctagaacatcctaatcgaaaaaacattagaaatagaaaaaattgttggcagccgttctttcctgtaccctgcacctgccttttactccattcccctcggtgcgccgccgccagtccgccccgccccgccccgcccagcagacagcgcagccatgccgctccacctccacctgctgtcgtccccggccaccgctgccaagctcgcggcaggtctgcgtgcggcgcctctccgccggtgccacagcttggccccggcgccgcgccacacggatcgcgtggcccttgcgtcgtccctctcggcggtggcgcggtctgctggccccgccgtggcagcggcgcagaccaagcccagcgtttcaggaaagaaacaagtattgatatccttgtcggataaaacggatttggcttatcttggcaatggtcttcagggtttggggtattccatcgtttccactggtggaacagcatccagtctggaagcagcaggagtcagtgtaacaaaagttgaagaaatcacacactttccctgaaatgcttgatggacgagtgaaaacattgcaccccagtataccatgggggtattcttgcccagaagaga

SEQ ID NO: 43714 - DNA, 682 bp, Zea mays
  misc_feature: Ceres CLONE 1444773-F
  misc_feature: Encodes the peptide sequence at SEQ ID NO. 43715
ctggagctccccgcggtggcggccgctctagaactagtggatcccccgggctgcaggaattcgcacgagaccattacctagaacatcctaatcgaaaattccgttctgttctctcagtcctgtttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatctacgacaacgtcgactcagccaagaagttcgagcccaagtacaggcttatcaggaacggtcttgctaccaaggtggagaagtcgcgcaagcagatgaaggagaggaagaacagggcgaagaagatccgcggtgtgaagaagacaaaggctggggacgccaagaagaaatgagcaaggtttcagtgtactttagccgtcttgagttcgagtaacacctgttcgccgtcagaaattttgtaccccatgtcgcaat

SEQ ID NO: 43715 - protein, 137 aa, Zea mays
  misc_feature: Ceres CLONE 1444773-F
  misc_feature (28)..(111): Pfam Name: Ribosomal_S24e Pfam Description: Ribosomal protein S24e
MADTKASPAVTLRTRKFMTNRLLSRKQFVLEVLHPGRANVSKAELKERLAKMYEVKDPNCIFVFKFRTHFGGGKSTGFGLIYDNVDSAKKFEPKYRLIRNGLATKVEKSRKQMKERKNRAKKIRGVKKTKAGDAKKK

SEQ ID NO: 43716 - DNA, 633 bp, Zea mays
  misc_feature: Ceres CLONE 1444789-F
  misc_feature: Encodes the peptide sequence at SEQ ID NO. 43717
ggagctccccgcggtggcggccgctctagaactagtggatcccccgggctgcaggaattcgcacgagaccattacctagaacatcctaatcgaaaaaactcatgtcagaccagagctccaccctcgcctcgaagggcaaagcctcgacggctggcggcggccgaagcgatgtcgcggcggccgttggagtgtcatcttgcggcgtaagacccggactaccacccactggccagacgacggaggaggaggaggcgcgcgtcaggcgcgaggcggagaaagccgagctcgaggaggagatcgccacgttgaaggcggagatcttcgccctggaggaagagttggccaggatggatgccgccgccgccgctacgcgcgcgagcgcttctcactctcgtgtttcagctaggccactgtgattggctggagctgttgtcgtaaatctcggaggtaggtagatggaattccccattgcaattacttcaggtcatgttctgctgaaacagctgcaacgttctcgaattttattgcccttagcacgattgtttttggattatccaatcaaagaactgttctgcccaccttccaaaccaaaacaggcgtcctggttgtgggggaaggccccaaaaaccgtag

SEQ ID NO: 43717 - protein, 104 aa, Zea mays; identical to SEQ ID NO: 41333
  misc_feature: Ceres CLONE 1444789-F

SEQ ID NO: 43718 - DNA, 558 bp, Zea mays
  misc_feature: Ceres CLONE 1444793-F
  misc_feature (210)..(210): n is a, c, t, g, unknown, or other
  misc_feature (211)..(211): n is a, c, t, g, unknown, or other
  misc_feature (220)..(220): n is a, c, t, g, unknown, or other
ggaactccccgcggtggcggccgctctataactagtggatcccccgggctgcaggaattccacgagaccattacctagaacatcctaatcgaaaaattctttcttcctgtcctgtcctggtgtcctgtcctgtccacctctcctccgactccgatcctctccgccatttccctgcgcttctggaactgttgttctaaaccccccaacccnntacgcctancctctgcgctgccggcgtcgcccacgcccggagctgcggccatgaacgcccttccggttccctcggggacctgacccccccttctttcccgccctccgggtcctcctccaaaattaccccaccaatcctgctcagggggttccagaaaaaccccggacctgaactttttgggttccggggaaagaaccccaaaccttttcaggaaaaaggtccgccttaaaccccggggggaaaaaggggttcccccccccccctcccccaaatttgtggggctaccccccccccccccgggggggggggggattttcccaagggggggggggccccctccccccccg

SEQ ID NO: 43719 - DNA, 601 bp, Zea mays
  misc_feature: Ceres CLONE 1444805-F
  misc_feature (259)..(259): n is a, c, t, g, unknown, or other
aaagctggagctccccgcggtggcggccgctctagaactagtggatcccccgggctgcaggaattcgcacgagaccattacctagaacatcctaatcgaaaaacatacatcgtactacaggtgggacccgcttactagatcagattctaacatcctgttcgtggagtcgtctcggcggcggcggaacaagccgggaacctaccgcaaagggcgccaccgatgctaaagccacagacgtcgtggacagcttccctccctnctcccttctcatccgccggttggttccaaaaaaacccgggggccaaaacccattttcctctggggcgggggggagggggcccccttccccttttttttcccccgccttcaaaaaagggggggggaaaaaaaaaaaacccggggggccccacccccacaagagggggcgggggccccctcccccccctccgagggggggggtgttttctcccaccccaaaaaggggggggggggggaaaaaaaacaacgggggggggtttttaaaaaaaaaaaacggggggggggttattaaaaaaaaaaaaaaaaaatttttttttttctcccccccccctgcggggggggg

SEQ ID NO: 43720 - DNA, 626 bp, Zea mays
  misc_feature: Ceres CLONE 1444807-F
  misc_feature: Encodes the peptide sequence at SEQ ID NO. 43721
  misc_feature (484)..(484): n is a, c, t, g, unknown, or other
ggagctccccgcggtggcggccgctctagaactagtggatcccccgggctgcaggaattcgcacgagaccattacctagaacatcctaatcgaaaaatcagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgaggaccagctcgacccggcgccgcccgccatcgaccccaacgaccccnactacgaaggagggaggggcggcggacgaggacgacgaggcggccagggaggtggtcgtcggggaggtggaggtcgctaaggtcgccgagagcagggacggcgtcgccagggtcgacgtcgcgccgggcctgctccaggacc

SEQ ID NO: 43721 - protein, 124 aa, Zea mays
  misc_feature: Ceres CLONE 1444807-F
  misc_feature (99)..(99): Xaa is any aa, unknown, or other
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDPNDPXYEGGRGGGRGRRGGQGGGRRGGGGR

SEQ ID NO: 43722 - DNA, 710 bp, Zea mays
  misc_feature: Ceres CLONE 1444809-F
  misc_feature: Encodes the peptide sequence at SEQ ID NO. 43723
ctggagctccccgcggtggcggccgctctagaactagtggatcccccgggctgcaggaattcgcacgagaccattacctagaacatcctaatcgaaaaacaggactgttatacaactaatggactataagaaccaaagctggttacgttgcccataccacagagctagagagctaagaatttccccatggcggcctctcttcatgctctggcctgcgccatgctcctcctagccgtctccccgctcgcttgcacggcctccaagacgctgctgcaggacaggtgcgagagctacgcgggtggcgaccggagcagctacgactactgtgtctggacgctgcggcgcgacaacaagagcgccaccgccgacgagctgggcctcgccgtgatcgccgcgaggatggccaggcccaccgccaaggccccggggtcaagatcccctgggctgcggcccaccaaaacggccccggggcggggttgactcctgggccccttggcccagggaattaccccccccccctggccccggtttgggaacccccctttatcgccccaggggcgggaaaaccccccaaccccaaaaaactgcccccgagagaacaaaggcccccccccctctttaaaccccccttttttggccccccccgaaaaaaaccccccctgggtgtaaaaacaaacactggtgttaaaaaaaaaaaaatggtgggcccc

SEQ ID NO: 43723 - protein, 97 aa, Zea mays
  misc_feature: Ceres CLONE 1444809-F
MAASLHALACAMLLLAVSPLACTASKTLLQDRCESYAGGDRSSYDYCVWTLRRDNKSATADELGLAVIAARMARPTAKAPGSRSPGLRPTKTAPGRG

SEQ ID NO: 43724 - DNA, 849 bp, Zea mays
  misc_feature: Ceres CLONE 1444812-F
  misc_feature (331)..(331): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (621)..(621): n is a, c, t, g, unknown, or other
  misc_feature (689)..(689): n is a, c, t, g, unknown, or other
  misc_feature (693)..(693): n is a, c, t, g, unknown, or other
  misc_feature (826)..(826): n is a, c, t, g, unknown, or other
ccccgcggtggcggccgctctatactagtggatcccccgggctgcaggaattcccacgagaccattacctagaacatcctaatcgaaaaactctctctctctccactggctgacgccgcgaccgccccaacccaactgcccttttcggagatctcgccgcctccgccgtcgacttccgtcgcccccctatcccgcgtccgggcttacccgatggcacggctgcactggcttgagggcgtcctgacgctggggatcatcggcggcatgctccgcactttgggcaacgcccaataattcccccacaacgcccccccacgacagggtacacccnccctcggtttcccttttccttcttttggtgggtggaccaccctctcccccttggatttacccggttttggtggtgtacccttccccccaagaaannncctattcccccccttgcctatgtccgggaggggatacgggccgcaaaaccctatgggaaaactattatttggggggaaatttgcatatggggggccttttttatcccaccaaacttctcgtttaccaccattttttttggttccattcgcgcgttcggaattcccccctcccgctttttcccgttttatccanttaataaaccccttttttaacaacccccccgaaaaacccaccggctccgtcttcccttacccttcacncctntttaaaccaacaaactcacactgtgtgtttgtgttatcacgccaaaataattatttatttcagaaaataaccgctgtcttccccatcaatgtctgtaaagtcactcaagtccacaaattattttttgttaaanacacaacaacacctatccgcgtg

SEQ ID NO: 43725 - DNA, 704 bp, Zea mays
  misc_feature: Ceres CLONE 1444815-R
  misc_feature (704)..(704): n is a, c, t, g, unknown, or other
tgaggtccgggccccccctcgagggcgactttcccgataagcttcagaaagtcttctctgcagatcgtcttccttctttccttcgtactcagagttctccatttcatttgccttctcttccagttcacgatataactctgtaaatactgacaagatccagatttgggttggaatatcaaatagcgtcttagctaaggtcaacgaagacttcaggatctctttagcctgtgctgcgtcatgtagctgaagcgccaatgtgcccagtattgtcaaatactgagaaactaactggatgttacccaactgttggtgcgctattttcaaaccacttgcaaggcggttccgtgcttcctgcggattatgctgtctcataaccaatagtccataaacaaaaatggatacaggttttctcccccacaccaacagatgagtccatttgttctataggcaggaccaaccagtgtctagtgcctgagaagaacgactctgcatcacccctttacaaatatatgacacgcctgcataggtttcacacatcgagtgctttgatttactctctgtcagctttttttctttcaggataggtggaaagttgcttcctcaaaccagcccaacagaatgggcgcttttggcccctttaaatttttcaatgagacttttcgcaaccttggaaaaaattgtgggggaagtcgaggaaaacttgn

SEQ ID NO: 43726 - DNA, 626 bp, Zea mays
  misc_feature: Ceres CLONE 1444817-F
  misc_feature: Encodes the peptide sequence at SEQ ID NO. 43727
tccccgcggtggcggccgctctagaactagtggatcccccgggctgcaggaattcgcacgagaccattacctagaacatcctaatcgaaaagttcatatttggaccattacccagatctggcggagcaaattatgaacaatggccgtcgtaatggcctagctctgatgcgcgggtttctcttctggttgcagaacgcagtacatgaagatcagttcaagccatgggtagatgattctaataaagaacatgaagttatttatttggtggattgagctcgcactgacttggtggctatatcattcgtttgcttgatttcgcccgatggtggtaataactctgcgcgcgtgacaaattgtcctcagcggagactgtacggattccaacatgcgatggaaacctcgatcctgggacctggaataccatgttcacgagtatctattggatagcaatgcacatacattccagctgttgagtgaataaacggttcctcattgaaaataatacatgaacgctctatcttatgcattgtgtgattacgtctgggatgtgacccctgtagagttttcccaagactggagttagggcttggtcaatctgatgagttgttgcacttgatctccctatc

SEQ ID NO: 43727 - protein, 46 aa, Zea mays
  misc_feature: Ceres CLONE 1444817-F
MNNGRRNGLALMRGFLFWLQNAVHEDQFKPWVDDSNKEHEVIYLVD

SEQ ID NO: 43728 - DNA, 656 bp, Zea mays
  misc_feature: Ceres CLONE 1444820-F
  misc_feature: Encodes the peptide sequence at SEQ ID NO. 43729
  misc_feature (506)..(506): n is a, c, t, g, unknown, or other
tagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaaggccccgccccggctcccgcgtccgacgccgcggccgccgtaccccttcgcggggcttcccttggcgcgccggctttcggctacctcttctgctaaatccgggctggaaacccggtttcctgctccaaaaatgaatcccctcggccgggcccgcgtgatccaaccccgggggcccgggggtccctcgggtaaggggcccccgggccttgtttttttttatggaatcccccccnccgccggcggaaaaaaaaggtgcccccccgggggggggaaaactttttcacccccccccttttttgcccgggcaaaatagaacccccccgggggttttttgggggttaaaagaaaaaattttttttttttttttttggcgggggaacaaa

SEQ ID NO: 43729 - protein, 57 aa, Zea mays
  misc_feature: Ceres CLONE 1444820-F
MAGLRMKFVAVAAMAAALVASAAAAEGPAPAPASDAAAAVPLRGASLGAPAFGYLFC

SEQ ID NO: 43730 - DNA, 640 bp, Zea mays
  misc_feature: Ceres CLONE 1444830-F
  misc_feature: Encodes the peptide sequence at SEQ ID NO. 43731
  misc_feature (423)..(423): n is a, c, t, g, unknown, or other
  misc_feature (425)..(425): n is a, c, t, g, unknown, or other
aagctggagctccccgcggtggcggccgctctagaactagtggatcccccgggctgcaggaattcgcacgagaccattacctagaacatcctaatcgaaaaaaattgggtgtgctgtggcgaccgggctttccctacgggctggtcatcattttcgggagcgtcgtggctacctccggtgctgcggctagcgcgactaggccagatcgacccagcgcgatgacggctgtgtgcggcgtcctcggacatcgctccgccagctcaaatctccaagcgctcgagctcgaaactcctccaaccggtcatccgctgccagcaatcgacctccatccgcagagcactcaccgaaaggtggctctggatatctcctgctctaacagctccacaaaaattgcattcaacacttgggatgagtgaccgaccnanaagttttctcgggtgcacacgagtgaagtcaaagtacgcacaaaagactcgtgttagtctgtggggatgatatatgatcgtaaagggttgcttgggagtaagtatcgaatagcggcttcgatgccagtaaatggtccggggtcggggtaggggggggggggagggggccgaggaccacggttctccaatggcgccgcttgctccaaacaagtgga

SEQ ID NO: 43731 - protein, 65 aa, Zea mays
  misc_feature: Ceres CLONE 1444830-F
MTAVCGVLGHRSASSNLQALELETPPTGHPLPAIDLHPQSTHRKVALDISCSNSSTKIAFNTWDE

SEQ ID NO: 43732 - DNA, 639 bp, Zea mays
  misc_feature: Ceres CLONE 1444837-F
  misc_feature: Pfam Name: AMPKBI Pfam Description: 5'-AMP-activated protein kinase, beta subunit, complex-interacting region
ccccgcggtggcggccgctctagaactagtggatcccccgggctgcaggaattcgcacgagaccattacctagaacatcctaatcgaaaaacctcctcactcgagccagccagccagccagccaggcgcttgggcgccatctctctagagtttcgtaccatcgaagagagatccggcgcgacccaataaacacccgggtcactacagactctgatatggtcggcctcaggatgaagttcgtcgacgacaccgccatgggctgctggatcgtggagtccgccgcatcgcgtgaggatcaaggctcggctcctgcgggatatgaagtcgccgctttacgcatctccgctaccacaatcgtcggccctggcattgaggtacatcgtctgcagcacccactgtatgatacctgatctgtgctacacactgctaatcttctgacctggccaacatgagtccagctcgcgggcccagccccacaccgtgttacggaaccacctttacgtcgagatagataacactaggtccatggttgctctgcggatcacgcatcgcttcatggctagtacgtgatcgtcgtgcttcagatccagcgctgatcatgtacgacgctgccgcgtgtctgcgctactgctccatcat

SEQ ID NO: 43733 - DNA, 691 bp, Zea mays
  misc_feature: Ceres CLONE 1444839-F
  misc_feature: Encodes the peptide sequence at SEQ ID NO. 43734
tccccgcggtggcggccgctctataactagtggatcccccgggctgcaggtaattcgcacgagaccattacctagaacatcctaatcgaaaaacacccccacatcctacgcccaggaagtacgaagcacgagcagcatatgtcacagagggccagcgtcccacactcctcctgcatagccttcgcgctccattcccatctcctggtctccagtgagatgtgccccagctcctattggtagcaatagctattctgcgccttccttttttctttcttcttcttcctttcctcccgtctggatttcatttccgtgtgatcgagctggctctcagctaccttttttagttttgttgggatttttgttatcagatccgtctctccataactcttgaaagcgaaccaccccccaaaaaccaggcaagcaagcgataggagtcaagggattcctcgagggcggcatcgcctccctcgtggccggctgctccacccacccgctggacctcaccaaggtccgcatgcatctacatggggaggcggcggccgccgtgtcgcccaaaccggcgctgcgcccggcgctcgacttcccccgccgggggccaaacccgtggggcctcccgaaccaccaacgacatcccgggcgccgcccttgcaacaccaggagccgctgggttcgtttgaaacgcagaagcctt

SEQ ID NO: 43734 - protein, 59 aa, Zea mays
  misc_feature: Ceres CLONE 1444839-F
MHLHGEAAAAVSPKPALRPALDFPRRGPNPWGLPNHQRHPGRRPCNTRSRWVRLKRRSL

SEQ ID NO: 43735 - DNA, 710 bp, Zea mays
  misc_feature: Ceres CLONE 1444840-F
  misc_feature: Encodes the peptide sequence at SEQ ID NO. 43736
  misc_feature (1)..(1): n is a, c, t, g, unknown, or other
  misc_feature (322)..(322): n is a, c, t, g, unknown, or other
  misc_feature (397)..(397): n is a, c, t, g, unknown, or other
  misc_feature (401)..(401): n is a, c, t, g, unknown, or other
  misc_feature (423)..(423): n is a, c, t, g, unknown, or other
naaagctggagctccccgcggtggcggccgctctagaactagtggatcccccgggctgcaggaattcgcacgagaccattacctagaacatcctaatcgaaaagccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccaggactggcatcctgccatggctccaggccaagatcgttgatcccgtgctgcangtcatcagaaggggagcagaacccaagcaactggccttctctgctgccctccccgtcacgatggggggggggccnattntgggaccactgttattcccccngctgttgttgtagcaatgttgggaagtcgttgcaatgctgttactcttatggttctaaatttggccgccactccaattgaactaagcttgatcgtccctttctggcgtttggggggaagccttcactggcagcgggcacttccccttgacagccgacgcatttgaagaatgttctcaccggtcatgcctcaaaggatgtgcttatggagcatcctccatggcaatgcttgggttgggtatttggcgccccaattggactggccgtgctttaccccgtttccgtcccc

SEQ ID NO: 43736 - protein, 61 aa, Zea mays
  misc_feature: Ceres CLONE 1444840-F
  misc_feature (24)..(24): Xaa is any aa, unknown, or other
  misc_feature (51)..(51): Xaa is any aa, unknown, or other
  misc_feature (58)..(58): Xaa is any aa, unknown, or other
MGSLLTRTGILPWLQAKIVDPVLXVIRRGAEPKQLAFSAALPVTMGGGPIXGPLLFPXLLL

SEQ ID NO: 43737 - DNA, 678 bp, Zea mays
  misc_feature: Ceres CLONE 1444853
  misc_feature: Encodes the peptide sequence at SEQ ID NO. 43738
aagttcaagcacctggctacacatatctcctagaaatcaagcagcgtcgagtttctccaggtccgaatcagtgatccgatcgcaagaagcaagcaacaatgtcgccggcgagcagcagcaacccgctgtcgctggacttctgggcgtcgtccgccgacccgttcggcgtcgtccggccgctggcggagcagtgccccgtcctcaccaacgtgcgcgtcgactggaaggagacccccgaggcgcacgtgttcagggccgaccttccgggcgtcaggaaggaggctgccaaggtcgaggtggaggacggcaacgtgctcgtcatcagcggcgagcgcgccagggaggaggaggaggccggcaaggacgaggcgtggcgctggcgcctcgtcgagcgcagcagcggcaggttccagaggcggttccgcctgccgcgcggcgccaggctggaccaggttcacgcgtccatggagaacggcgtgctcaccgtcaccgtgcccaaggaggaggccaagaagccgcaggtcagggctgtcgagatctctggttgatcgatccgttcactgcatgcattacgagtgcccgagctgtactacaggtagtataacttttcgaaattcgctggtaggacatctgccaagcaaatacaaactgtctatctgtccaaaaaaaaaaaaaaaa

SEQ ID NO: 43738 - protein, 149 aa, Zea mays
  misc_feature: Ceres CLONE 1444853
  misc_feature (41)..(148): Pfam Name: HSP20 Pfam Description: Hsp20/alpha crystallin family
MSPASSSNPLSLDFWASSADPFGVVRPLAEQCPVLTNVRVDWKETPEAHVFRADLPGVRKEAAKVEVEDGNVLVISGERAREEEEAGKDEAWRWRLVERSSGRFQRRFRLPRGARLDQVHASMENGVLTVTVPKEEAKKPQVRAVEISG

SEQ ID NO: 43739 - DNA, 570 bp, Zea mays
  misc_feature: Ceres CLONE 1444857-F
  misc_feature: Encodes the peptide sequence at SEQ ID NO. 43740
  misc_feature (211)..(211): n is a, c, t, g, unknown, or other
  misc_feature (277)..(277): n is a, c, t, g, unknown, or other
  misc_feature (281)..(281): n is a, c, t, g, unknown, or other
  misc_feature (332)..(332): n is a, c, t, g, unknown, or other
  misc_feature (458)..(458): n is a, c, t, g, unknown, or other
aagctggagctccccgcggtggcggccgctctagaactagtggatcccccgggctgcaggaattcgcacgagaccattacctagaacatcctaatcgaaaactttttcctcgagtttcctattttcctctcctcccccacagcagctcggcgaaaaccctagtaagcaaaccaccggagcagcggcgcttgcgcgagtcggagccatggcnggacgaaacgattacaacgaaattgacatggggtatgaggatgagcccccagaaccggagattgangaangagctgaagaagagcctgagaaaacatgagatgcccttgatgacgtcatangtggtgagggtgaagataaggaacaggaaaagactagcgtgacgccaaacaccaaatactgacgagttccgaactgccccattcttggtaaccaaacctggcaaaaacctgaaaggtcccgttttnttgacatggggggaaaacggacccctttgaaattccaaaaagagcttaaaacgccccaaaaaaacctttcgaaataaagggggttttcccgtggggaaactcttaaaagggg

SEQ ID NO: 43740 - protein, 34 aa, Zea mays
  misc_feature: Ceres CLONE 1444857-F
  misc_feature (24)..(24): Xaa is any aa, unknown, or other
  misc_feature (26)..(26): Xaa is any aa, unknown, or other
MAGRNDYNEIDMGYEDEPPEPEIXEXAEEEPEKT

SEQ ID NO: 43741 - DNA, 641 bp, Zea mays
  misc_feature: Ceres CLONE 1444858-F
  misc_feature: Encodes the peptide sequence at SEQ ID NO. 43742
acccgcggtggcggccgctctagaactagtggatcccccgggctgcaggaattcgcacgagaccattacctagaacatcctaatcgaaaaaagcgaaggtggcgatcgagcaccgccatggggcaaccaagaacagagctcctcgccctcgcattccttctcgtcgccctcgccgccgccgtggccgccgcggcgacagaggtggtagacgcggcgccggcaccagcgaggacgaggacgacgacggcggggtgccggcgcggcgacctggtggtgcggcagcgcgcgacggggcgcgtggtggaggggaagcccgagtacgcggtggaggtgcggaacgcgtgccggtgcgcgcagtcccgcgtgctgctgcgctgctacgggctcagcagcgtggaggccgtggacccgcgcgccatccgcgccgtcgacggcgagcgctgcctgctccgcggcggccgggcgctggcgccgcgcgggggcgccgtgcgcttcacctacgcctggatgacgccgcaggacttcccgctcctcagctcgcgcccgcactgctagccgttccagtaccttactttagctctggcctgggctgttcctgtattacaattggttgttggtacgcactgattcattcagcaagg

SEQ ID NO: 43742 - protein, 145 aa, Zea mays
  misc_feature: Ceres CLONE 1444858-F
MGQPRTELLALAFLLVALAAAVAAAATEVVDAAPAPARTRTTTAGCRRGDLVVRQRATGRVVEGKPEYAVEVRNACRCAQSRVLLRCYGLSSVEAVDPRAIRAVDGERCLLRGGRALAPRGGAVRFTYAWMTPQDFPLLSSRPHC

SEQ ID NO: 43743 - DNA, 618 bp, Zea mays
  misc_feature: Ceres CLONE 1444860-F
  misc_feature: Encodes the peptide sequence at SEQ ID NO. 43744
  misc_feature (618)..(618): n is a, c, t, g, unknown, or other
cgcggtggcggccgctctatactagtggatcccccgggctgcaggaattcgcacgagaccattacctagaacatcctaatcgaaaaaataaaaaaacgcacctttccttcccctcgctttccccctccttcctcccctcgatcccctcgccgggaaagatccgatcccatccacctccactccacgtcgcggcgcaaccagagttccccgtcggcgaagcaggaagtcggaagcgaaaggaatgttgcacctttgaagcggcgcggcgacccggtgtttcttcctggccggcgatgggctgcttctcgtgcttcgactccccggcagatgagcagctcaaccccaaattcggtgccgactgtgggtacggcggcacctctgcggccgcggcgtacggagccggcttcggccggcacggggacagggggtacccggacctgcagcaggcgcccatggcggcgccgcgcgtcgagaagctctccgcagcggctgagaaagcaagagctaagagtaatgggctcaccaaagaggcttcagtgccaaaggatgccaacggcaatgccatctcagcgcagactttcaccttccgtgagctcgccaccgccaccaggaacttcn

SEQ ID NO: 43744 - protein, 108 aa, Zea mays
  misc_feature: Ceres CLONE 1444860-F
  misc_feature: SWISSPROT Homolog: EC 2.7.11.1 Non-specific serine/threonine protein kinase
MGCFSCFDSPADEQLNPKFGADCGYGGTSAAAAYGAGFGRHGDRGYPDLQQAPMAAPRVEKLSAAAEKARAKSNGLTKEASVPKDANGNAISAQTFTFRELATATRNF

SEQ ID NO: 43745 - DNA, 734 bp, Zea mays
  misc_feature: Ceres CLONE 1444863-F
  misc_feature: Translation starting site: 191
  misc_feature (463)..(463): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctagaacatcctaatcgaaaactctagccaaaaccctagcagccgcccggtgctccctctctgcagatctcccttcgcagccgccgaggaaccccttcacagcgcggaagatggctgaacaggaggccccagtcgcggttgaggcaccaaccccagttcttggggagcctatggacttgatgactgctctgcagctcgtgatgaagaagtcaagtgctcatgacggtcttgtgaagggtctccgtgaggctgctaggccatcgagaagcacgccgctcagctttgcgtgcttgctgaggactgtgaccagccagattacggtcagttggtgaagcactctgcgctgagcacaatgttcacctggtccactgtcctgccgctangactcttggcaagtggcccggctttgcaagattgactttnaggcaggcaggaaagtttaagctgctcctgcctcccctcaagacttcggggaaaaacaaggcctttacataggggaggtattgcaagcccccaaaagggggcaagtttccggaaatctttggttggcccgggtaaaaattgctttttccctggggtttcccgggaaaataaaattttttcggaggcccaggaggtgttggaaccttgggcccccttttttttttttggggg

SEQ ID NO: 43746 - DNA, 680 bp, Zea mays
  misc_feature: Ceres CLONE 1444871-F
  misc_feature (238)..(238): n is a, c, t, g, unknown, or other
  misc_feature (267)..(267): n is a, c, t, g, unknown, or other
  misc_feature (268)..(268): n is a, c, t, g, unknown, or other
  misc_feature (277)..(277): n is a, c, t, g, unknown, or other
aagctggagctccccgcggtggcggccgctctagaactagtggatcccccgggctgcaggaattcgcacgagaccattacctagaacatcctaatcgaaaaaccggtgtgaggactgagacgccgacctccgacctcaccgaggcattcgattcgtcgcaatcctcgccctcactcgcgtgttcaggcaagcgattccgtcggttattgtgatctgcgcttttgttcttctcgattgngggtgtgacgaatctgatttgcgaatgcnnagcgtcagntttgtcgggctgccccgggataggaatgcttctgtcaaattgttaacccccggaaaccctggcggtttcctcctttaattttttcccgggcctcccccccttcggctttggaatttgaaaaacccaaaagggggggtatatttctcctcccacggaattttgggcccccaaaaaagttttttgttttttgggggggttccctctcaccccccccccccccccaaagaggggggggaaatctctcccggggagagggggttttttttttttttttgggggccgcgggggggggttctcccccgggggggcggcttttattatttaggggggtttttttttgtgggggggggggggggcggccccccccccctctttctaggggggggggggggggggggggggg

SEQ ID NO: 43747 - DNA, 714 bp, Zea mays
  misc_feature: Ceres CLONE 1444876-F
  misc_feature: Encodes the peptide sequence at SEQ ID NO. 43748
  misc_feature (412)..(412): n is a, c, t, g, unknown, or other
  misc_feature (413)..(413): n is a, c, t, g, unknown, or other
  misc_feature (468)..(468): n is a, c, t, g, unknown, or other
aaagctggagctccccgcggtggcggccgctctagaactagtggatcccccgggctgcaggaattcgcacgagaccattacctagaacatcctaatcgaaaaatccaggcgtacagccctccgcctcgtgaaggcaaagcacgcgcaaagccaccacagcgtcttcatcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatggaattcgtcggcttctttgtcaagctcatcttcatccctanntcacacatcatcgtcggctccggctgatccgtaaacctcaggctagtggctgcangagtggacaatggcgtccctacttggaagcagccacgttttcagctctgatttcgcaaagcaattctttaggacttgggttgtaaaagggaacttccttaacttttcctctttaaggggccggggggaaatttggacctttttggacctgggggcaaaaaccctttgtgggatccgggggggacaaataaaaggggaccctttttcttggggaatggtttaaaaaaaaaaaaaaaacctttttttt

SEQ ID NO: 43748 - protein, 69 aa, Zea mays
  misc_feature: Ceres CLONE 1444876-F
  misc_feature (10)..(66): Pfam Name: SecE Pfam Description: SecE/Sec61-gamma subunits of protein translocation complex
  misc_feature (61)..(61): Xaa is any aa, unknown, or other
MDAVDSVVDPLREFAKDSIRLVKRCHKPDRKEFTKVAARTAIGFVVMEFVGFFVKLIFIPXSHIIVGSG

SEQ ID NO: 43749 - DNA, 604 bp, Zea mays
  misc_feature: Ceres CLONE 1444881-F
  misc_feature: Encodes the peptide sequence at SEQ ID NO. 43750
  misc_feature (241)..(241): n is a, c, t, g, unknown, or other
  misc_feature (254)..(254): n is a, c, t, g, unknown, or other
aagctggagctccccgcggtggcggccgctctagaactagtggatcccccgggctgcaggaattcgcacgagaccattacctagaacatcctaatcgaaaactgaccggcgggggcggcctggcggccctgagggcggcgcgcgccgtgaaggagacgacggggatcgtgggccttgaggtggtgccctacgcgcgagaggttctggtagggctctacgagcgcacgctcaaagagatcanggccgtccccgangacgagggttacccgcagggccgttggttccctccaccggtcacgccttcaaatcttgcaggaggaggagaactggaacccctttcaggaacccattcggattccggcgggtccaggacctcttttgggagagccaagaaaaaacttaacctctttttaaaaaatttgaaggggccccggggggtttcccaaaaacacccaagaggggggggggtgttaaaaaacaacccccccttttccaaaggggttttttcccacaccgccggggtgtttttttttttggggggaattttttttggggggaaaaaagggtgggaaaaaaatattctcctttcttttaagggggatcc

SEQ ID NO: 43750 - protein, 200 aa, Zea mays
  misc_feature: Ceres CLONE 1444881-F
  misc_feature (80)..(80): Xaa is any aa, unknown, or other
  misc_feature (84)..(84): Xaa is any aa, unknown, or other
AGAPRGGGRSRTSGSPGLQEFARDHYLEHPNRKLTGGGGLAALRAARAVKETTGIVGLEVVPYAREVLVGLYERTLKEIXAVPXDEGYPQGRWFPPPVTPSNLAGGGELEPLSGTHSDSGGSRTSFGRAKKKLNLFLKNLKGPRGVSQKHPRGGGVLKNNPPFSKGVFSHTAGVFFFLGGIFFGGKKGWEKNILLSFKGD

SEQ ID NO: 43751 - DNA, 665 bp, Zea mays
  misc_feature: Ceres CLONE 1444886-F
  misc_feature: Encodes the peptide sequence at SEQ ID NO. 43752
  misc_feature (479)..(479): n is a, c, t, g, unknown, or other
tggagctccccgcggtggcggccgctctagaactagtggatcccccgggctgcaggaattcgcacgagaccattacctagaacatcctaatcgaaaaattttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcctctgtggcgcgcggagtcggatgccgcggggggtggcgcccccgccggcgatgtcatgggcctcctcctccgggagcgcatagtcttcctcggcaacgagatcaagtacnttctcgcggacgccgtcgtcagccagctcctcctccttgacgccatcgacccggactctgacttccgcctcttcgtcaactcaccagggggatcctttaacgcaacaatggccatctatgatgtaatgcagcttgtggaggcaaacctgttcactattggaatgggcataactggatcaacagctt

SEQ ID NO: 43752 - protein, 157 aa, Zea mays
  misc_feature: Ceres CLONE 1444886-F
  misc_feature (69)..(157): Pfam Name: CLP_protease Pfam Description: Clp protease
  misc_feature: SWISSPROT Homolog: EC 3.4.21.92 Endopeptidase Clp
  misc_feature (96)..(96): Xaa is any aa, unknown, or other
MATGSASAIASFSVAAAAAAALRVRRPCARACAWAPSQRPQQGALVSLKPCASLAPQAPLWRAESDAAGGGAPAGDVMGLLLRERIVFLGNEIKYXLADAVVSQLLLLDAIDPDSDFRLFVNSPGGSFNATMAIYDVMQLVEANLFTIGMGITGSTA

SEQ ID NO: 43753 - DNA, 724 bp, Zea mays
  misc_feature: Ceres CLONE 1444887-F
  misc_feature: Encodes the peptide sequence at SEQ ID NO. 43754
aaagctggagctccccgcggtggcggccgctctagaactagtggatcccccgggctgcaggaattcgcacgagaccattacctagaacatcctaatcgaaaaaagtgcagatcacactagcctacacacaccgagcgccgtctaaactgacagcaggtcagcagcctagcgaagccaagacatccgccgatctcagatggccgggagaagggtgcgcggcaagagtgccgtggccgtggcggccgtcgcgctgctggcgctgctcttcgcggcgagcgaggccgacgggacgtgcaacgtcgaccggggcacggtgctgaggcagtgcgcgtcctgctcgagcggcgcgccgagccaggggtgctgcgacgcgctgaggaacgccgacttcggctgcctctgcagcaactactggaacaagctcaagaacacgccatacgccagctgcgccaaggccatcccttccgcgtgcaacctcccaaacgccaagtgccagtagatggagacatggagtgcgtgacccggacagcgaacgggcagcttggaccaaacagaataaatccgcttcattaccctgtttcttcctcctctgagtgtgttagttctttgctttgagtcgttatccgatatgatcggctgccctgctagccggcgggacgttctatatatgtctttgcaactcaaaaaaaaaaaaaaaagcttatcgataccgtcgacctcgagg

SEQ ID NO: 43754 - protein, 100 aa, Zea mays
  misc_feature: Ceres CLONE 1444887-F
MAGRRVRGKSAVAVAAVALLALLFAASEADGTCNVDRGTVLRQCASCSSGAPSQGCCDALRNADFGCLCSNYWNKLKNTPYASCAKAIPSACNLPNAKCQ

SEQ ID NO: 43755 - DNA, 723 bp, Zea mays
  misc_feature: Ceres CLONE 1444891-F
  misc_feature: Translation starting site: 333
  misc_feature: SWISSPROT Homolog: EC 3.4.21.92 Endopeptidase Clp
aagctggagctccccgcggtggcggccgctctataactagtggatcccccgggctgcaggaattcgcacgagaccattacctagaacatcctaatcgaaaaactacattcaagtggggagcgcctccgctgcggatgtcaccttctcccaaggagtcctgcttcgtctgagatggctaccgggagtgcgattgccctcgagtccttctcctatgtgtgcaactgccgctgctgctctatccgtcaggtggacttgcgctcgcacttgatctaggtccacctcgcagcaacacgcagaaaggggcgctcgacaacctcaaggcttgcctcacaatgacaccacgagctcctctgtggcgcgtggagtcagatgccacgccacgtggtgccggctcaggctatgtcatgagtgtccacccccgagagcgcatagtcttccttggccaatagatcgaggacttcctcgcggacaccgtattgagttagctcctcctcattgacgccttgctggcgcgaagtctgacatccgcctcttcgtcaactcagcaaggggatcccttagcgcgactctggacatctatgacgccatgcaccttgtgagggaagacatgtccactctagcaatgctgatatctggatcaacagctacttaatacttggtggaggcacgacaggccaactatttgccatgcccgaaactgaattatgatccatcagactgctg

SEQ ID NO: 43756 - DNA, 622 bp, Zea mays
  misc_feature: Ceres CLONE 1444897-F
  misc_feature: Encodes the peptide sequence at SEQ ID NO. 43757
acccgcggtggcggccgctctataccagtggatcccccgggctgcaggaattcgcacgagaccattacctagaacatcctaatcgaaaaaaaaaccctatcagcccaaaaccgaacccacacctctgcccttcccatggcggccacgctattctccacctccctcttgccccagttcctctccctctccgctaagcccgccgccgccgccgccgccccgtccgccgccgccttcccatcggggatgccgcagctccacgcgctgtccgccgcggcggtgggctttaggccgctcgagcccgtgcgagcagccgcgaccgcggccgtgacggaggagctcgaggcggagaggcgttcgggcggggacgagttttcagatgatctcagggtcttcgtcggtaaccttcagttcagcgtcgacagcgcccagctcgcgggacttttcgagcaggccggctccgtcgagatggtcgaggttatctatgacaaattgacgggaagaagccgtggattccggtttgtgaccatgtcttcggtcgaagaaagtgaagtggctgttgaccaatttaatggctatgtgcttgatggaaaaagtttgacggtgaactctgggtctccaacac

SEQ ID NO: 43757 - protein, 126 aa, Zea mays
  misc_feature: Ceres CLONE 1444897-F
  misc_feature (49)..(120): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MPQLHALSAAAVGFRPLEPVRAAATAAVTEELEAERRSGGDEFSDDLRVFVGNLQFSVDSAQLAGLFEQAGSVEMVEVIYDKLTGRSRGFRFVTMSSVEESEVAVDQFNGYVLDGKSLTVNSGSPT

SEQ ID NO: 43758 - DNA, 741 bp, Zea mays
  misc_feature: Ceres CLONE 1444899-F
  misc_feature: Translation starting site: 169
  misc_feature: Pfam Name: DUF339 Pfam Description: Protein of unknown function (DUF339)
  misc_feature (390)..(390): n is a, c, t, g, unknown, or other
ggagctccccgcggtggcggccgctctagaactagtggatcccccgggctgcaggaattcgcacgagaccattacctagaacatcctaatcgaaaaattcacatctgtagccgcgcctctccgtatcactccgcgcctctctcccgccaggccgccgcccaagcaaccatggtggccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgtcgccgcctcctcaataggttggtgtactggagcaagcantcgagtttttctggaaccccaccctgttgctggggacctgggccgagcagcacgtgcacgccatggacgaggccaacatccgcgcccttctggaagtgctcgacctccaaaaccccaaatttgtgaaaagggttaactactcaggaccaccccccaaaggaactgaaatccaaaccgggtgtttgcctcccctcaaatcaaagggccaaaaataacctgaaaaaaaatgggtttccccgaaagacccaatcttaccccaggttcacccctgtggttaaggagagggcgcccccttaacaaacggcaaaaatggccccccgttttggaaaaaccgggtaaccctctttgaaa

SEQ ID NO: 43759 - DNA, 605 bp, Zea mays
  misc_feature: Ceres CLONE 1444904-F
  misc_feature (253)..(253): n is a, c, t, g, unknown, or other
  misc_feature (286)..(286): n is a, c, t, g, unknown, or other
  misc_feature (290)..(290): n is a, c, t, g, unknown, or other
  misc_feature (324)..(324): n is a, c, t, g, unknown, or other
  misc_feature (325)..(325): n is a, c, t, g, unknown, or other
ccccgcggtggcggccgctctagaactagtggatcccccgggctgcaggaattcgcacgagaccattacctagaacatcctaatcgaaaagattgggtccaacaccagccgccgccatgtcgaagcgaggcaggggaggttcggcggggaacaagttccgcatgtcgctgggtctgccagtggccgcgacggtgaactgcgcggacaacaccggcgccaagaacctctacatcatctcccgtcagggcatcangggccgccctcatcgcctcccgtcccgctgcgntggncgacatgggtcatgggcccacccgttcaagaaanngggggaaagccccccaacccctccgggggaaaaaaaaagggggggggggcccccccccccttttttttttttccccccccaaaaaaaaaaaaaagggggggggggcccccccaagaagaggggggggggtttctctttttatttttttttttttctaaaaaaaaaaaaaaaaaaagggatgggggggggtgttgttttttttttttgtgtcccccccccccccccccccgggggagagaaaaaaaaaaaaaacccccccccccccccccccccccccccc

SEQ ID NO: 43760 - DNA, 666 bp, Zea mays
  misc_feature: Ceres CLONE 1444914-F
  misc_feature: Encodes the peptide sequence at SEQ ID NO. 43761
aagctggagctccccgcggtggcggccgctctagaactagtggatcccccgggctgcaggaattcgcacgagaccattacctagaacatcctaatcgaaaaacattctcttcctcgactcctcgtgctcccctctcctactctttggcgcgtactggcgaactggagaggtgtacaatcgtccggagatccggacttcgattggttctctgctggtggtcggatgggaagtaaagacggcaccggtgacatatcggaagcccaaggctatgctgccgacattgattccatcagggaggctcacgcccgcattgcgccgtacgttctcaggacgcccgttatgtcctcgacatccatctatgccatggagtggaagaagctcttcttcaagtgcgactgcttccataaagcgggcccattcaagatccgaggtgcttctaattcgatattcacacttgacgatgatcaggtatcacaggctgttgtgacacctagcagtgcgaaccatgccgctgctgtggctttggctgcagagctgcatgacatacctgcgcacattgtcattccaagaaatgcaccagcgtgtgatgttaaacatgttaagcgctacagtggtcatattatttggagcgatgcctccttttgatcgagagaatatgtttgtaaa

SEQ ID NO: 43761 - protein, 140 aa, Zea mays
  misc_feature: Ceres CLONE 1444914-F
  misc_feature: SWISSPROT Homolog: EC 5.1.1.18
MGSKDGTGDISEAQGYAADIDSIREAHARIAPYVLRTPVMSSTSIYAMEWKKLFFKCDCFHKAGPFKIRGASNSIFTLDDDQVSQAVVTPSSANHAAAVALAAELHDIPAHIVIPRNAPACDVKHVKRYSGHIIWSDASF

SEQ ID NO: 43762 - DNA, 721 bp, Zea mays
  misc_feature: Ceres CLONE 1444927-F
  misc_feature: Encodes the peptide sequence at SEQ ID NO. 43763
  misc_feature (406)..(406): n is a, c, t, g, unknown, or other
aaagctggagctccccgcggtggcggccgctctagaactagtggatcccccgggctgcaggaattcgcacgagaccattacctagaacatcctaatcgaaaagctaaaggttggtgggtcgaacggaccaggccatcaggttatctagaaagctctcatgctcttccatttctaggctagcctaggtctggaccaattaggcacgcaagtatcaatcgattcataagaggaggagaccattgagggagctagccaagtagaaggcagtcacggcaaacaacgaaagctggtgaacaactttgtcaagcctcaagagctcatggaagatggcagtgctccaagacggtctactccacccgtctgcagaagcagatctgccgagttccacaatttttcagaaagggangagaagggattaagatcaacgaggagctgaaagcattacaggagcttcttccaacttgcacaagaccaacaaatttcgatgctaaaccaagcaatcgactactaaaatccttcggctacgttttcaatgctggcaaggggaagggaaattccccggggttccctttgagtgggcaaaaaatggtttaatcccgggtgaacctgcccatttccccccttggccccccccgggcgagaccccgggatttttaaaaattcccccccccccccaaaaaaatttagcgcgaggggtttttttttggcaaaaaaaaaaatt

SEQ ID NO: 43763 - protein, 38 aa, Zea mays
  misc_feature: Ceres CLONE 1444927-F
  misc_feature (29)..(29): Xaa is any aa, unknown, or other
MEDGSAPRRSTPPVCRSRSAEFHNFSERXEKGLRSTRS

SEQ ID NO: 43764 - DNA, 604 bp, Zea mays
  misc_feature: Ceres CLONE 1444930
  misc_feature: Encodes the peptide sequence at SEQ ID NO. 43765
attccgttctgttctctcagtcctgtttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatctacgacaacgtcgactcagccaagaagttcgagcccaagtacaggcttatcaggaacggtcttgctaccaaggtggagaagtcgcgcaagcagatgaaggagaggaagaacagggcgaagaagatccgcggtgtgaagaagacaaaggctggggacgccaagaagaaatgagcaaggtttcagtgtactttagccgtcttgagttcgagtaacacctgttcgccgtcagaaattttgtaccccatgtcgcaatgctttgatctagaaaaaaa

SEQ ID NO: 43765 - protein, 137 aa, Zea mays; identical to SEQ ID NO: 43715
  misc_feature: Ceres CLONE 1444930
  misc_feature (28)..(111): Pfam Name: Ribosomal_S24e Pfam Description: Ribosomal protein S24e

SEQ ID NO: 43766 - DNA, 829 bp, Zea mays
  misc_feature: Ceres CLONE 1444944-R
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (749)..(749): n is a, c, t, g, unknown, or other
  misc_feature (750)..(750): n is a, c, t, g, unknown, or other
  misc_feature (765)..(765): n is a, c, t, g, unknown, or other
  misc_feature (768)..(768): n is a, c, t, g, unknown, or other
cgagtagttttatgtcaagtggcagaggtatgtgacaacgaactaagaactttaagataacgtgaaagttgattacaaaaaacagaaaatggttgatgctgtattgggatctctcacttcttctagggatcaccagcgttggccttcttaacaccacagatctactatggcgcgattcttcctttcctaaagttgtttccttgatttatcgatcttggggtcaagaccattcctgataagtctgtacttgggttccaacttcgtagcgctctcgacattggcatatatcaaacgcgaccctgaagatttaccacctcccaagtgggttctgaatatgaaaacaaagatggcgtttgggtccttgacctcctacatccttggcagctactccttcagctacctctttgaaatattgtctcttccacgctgaaaaatatcgattacgaactgctgccttgagacaactctgtagctcatgaatttacgaggtcggatcaagactgcctactccgccatcgttgccatagcgcccgtgatcgaatgaagataaggctgcagcagcattgagttcgtccgattcggacgttcgatcgacggctcgcgtctaactatctggatgttctaggatatggtattgtgagaattcctgcagccccggggaacctctagcttagtcgtgnnnnnngggggggggaaaactcagctttgtctannngggggggggggttgaaaaaannnnnnnnnnnngnnggggggggggggggnaanataataagagtggggggtggagtgagatggtaattagtggtgtgaattaaagtgtggatgg

SEQ ID NO: 43767 - DNA, 630 bp, Zea mays
  misc_feature: Ceres CLONE 1444954-F
  misc_feature: Encodes the peptide sequence at SEQ ID NO. 43768
acccgcggtggcggccgctctagaactagtggatcccccgggctgcaggaattcgcacgagaccattacctagaacatcctaatcgaaaaactttttacatcttcacttcacttggcctaccagcagtccagcagagtttccgtctccccgactcccgagtcccgactgccggccctgacctgccctgcgccgcgcggagccgcggaccgcccgcccaccaccgaaaccctagagcaagcagggatgcacagtccggtcccgctcctcctcctcctgctcctctgcacggccgcggcggcctccgacggctcccagccccaggcgcaggcgcaggcacctggcgcggcacggcgggggatggtgccggtggcccccgcggaggcggagctcggcgccgtgaaggcgctcgccctcaacggcacgcggcgccggctcgggggcagcttccagctctgcgcgccctgcacctgctgcggcggggccagcggcgcctgcatcctcgcgccctgctgctactccatcaactgcaacatccccaaccgccccttcgggtactgctccttcacgcccaagtcctgccagtgcgtcggatgcaacctctgagctccgtggccgcgggattcattgga

SEQ ID NO: 43768 - protein, 119 aa, Zea mays
  misc_feature: Ceres CLONE 1444954-F
MHSPVPLLLLLLLCTAAAASDGSQPQAQAQAPGAARRGMVPVAPAEAELGAVKALALNGTRRRLGGSFQLCAPCTCCGGASGACILAPCCYSINCNIPNRPFGYCSFTPKSCQCVGCNL

SEQ ID NO: 43769 - DNA, 604 bp, Zea mays
  misc_feature: Ceres CLONE 1444961-F
  misc_feature: Encodes the peptide sequence at SEQ ID NO. 43770
acccgcggtggcggccgctctagaactagtggatcccccgggctgcaggaattcgcacgagaccattacctagaacatcctaatcgaaaaccctttagtactgacttcgttttcgcatggaagcatgaatgtgtaccgtaccgtgcacgtagacttcttcataaaaccctctttccaccaacaaaccccagtcacaaattctcagctattgagatttgaacatttcatccaaaaaatgttctttcagattattcagggggttttcaccggcgttgaggcattagctctattggcattcgctggtataacccttggcggctcagccgtgggactcgctttaagcacgccgctttttatcctattcagtccgattctcgtgccagcaactatagccaccactttgttaactacgggtttcacgacctccgggggcttaggaattgtggctctccgcatcttctggaagctcttcaagcgtcttaggaagaaggggaaaggaacgccaaaaattccgggattggccccgggggctccagattctaactcagtgtctgggggataaacggagtaggctttcgtagtatgagataatctatggaggaat

SEQ ID NO: 43770 - protein, 145 aa, Zea mays
  misc_feature: Ceres CLONE 1444961-F
  misc_feature (38)..(142): Pfam Name: Oleosin Pfam Description: Oleosin
MNVYRTVHVDFFIKPSFHQQTPVTNSQLLRFEHFIQKMFFQIIQGVFTGVEALALLAFAGITLGGSAVGLALSTPLFILFSPILVPATIATTLLTTGFTTSGGLGIVALRIFWKLFKRLRKKGKGTPKIPGLAPGAPDSNSVSGG

SEQ ID NO: 43771 - DNA, 654 bp, Zea mays
  misc_feature: Ceres CLONE 1444962-F
  misc_feature: Encodes the peptide sequence at SEQ ID NO. 43772
tggagctccccgcggtggcggccgctctagaactagtggatcccccgggctgcaggaattcgcacgagaccattacctagaacatcctaatcgaaaaatccccaccgtcgcctcgctcgacctccacctctctttcctcccggcagcaatggaggcggcacccaggtgaggcgagcaagcagccagtcctggctccccgatggcgtgcctggcgccgcagttcaagtgggcgccgtcggccgccgcccacgtgccttcctcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcaggtggccccccctctgctctgttgtctctgctggattgtcttccgaattgcatttgctgtactgtccttgcccgttttttgatgctgtgttttttctttgcgtttagtttaacatgtggcaaattgggagactttgtccactcctttgttcgacatgttgatgatcaacagatacgagtacattaatccccatctcaaacaatgccatgaacctatgatcatgtgggcacatcaaaatgagttcagggccattgatgggagcgg

SEQ ID NO: 43772 - protein, 90 aa, Zea mays
  misc_feature: Ceres CLONE 1444962-F
MACLAPQFKWAPSAAAHVPSSSSSYSRCSALRVHCAVTSAAVVEDRTNGSAAQLRLAYAAPAIQVAPPLLCCLCWIVFRIAFAVLSLPVF

SEQ ID NO: 43773 - DNA, 622 bp, Zea mays
  misc_feature: Ceres CLONE 1444971-F
  misc_feature: Encodes the peptide sequence at SEQ ID NO. 43774
  misc_feature (622)..(622): n is a, c, t, g, unknown, or other
ccgcggtggcggccgctctataactagtggatcccccgggctgcaggaattcgcacgagaccattacctagaacatcctaatcgaaaaattcacaacttcagctgcgcctcgactcgtagcccgaaccctagccaccaagccggaggcgagagagcagccatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcgagcgcgtcgccgtctccgtcgacctctacaaccagggatccgcgactgcctatgatgtgtccattaatgacgactcttggccaacagaagtgtttgagcttgtcactggagagaaatcgaagacattgggaaaggcttgacccctgggtgccaccttggctttcaaaaaaaattttggtcgcgggggaaaaacaaaaaaaaaaaaggggggggggggtttcccacggggtgctcccccccccccctctttttttttttaataatcggggggggggggggggcccgccacacaaaaaaaaaaaaaaatttctttttttttttaaggagagagn

SEQ ID NO: 43774 - protein, 89 aa, Zea mays
  misc_feature: Ceres CLONE 1444971-F
MARCLALVALLVLGLAAAAASAADAPFVVAHKKISLSRPKPGVERVAVSVDLYNQGSATAYDVSINDDSWPTEVFELVTGEKSKTLGKA

SEQ ID NO: 43775 - DNA, 635 bp, Zea mays
  misc_feature: Ceres CLONE 1444980-F
  misc_feature (635)..(635): n is a, c, t, g, unknown, or other
ggagctccccgcggtggcggccgctctagaactagtggatcccccgggctgcaggaattcgcacgagaccattacctagaacatcctaatcgaaaatttttctagcatttctcaattcttttttgttccggccccaatatgctctgtctcaaagtcaatttgcctacgagttcgaacgaaccgacaagaaggagcaatacacaagagagaagacaaggaatagcgccagcggcggccagggtgccgctcgatctctatgacttgttcttccctccctttcttcccttcacaaggttcctgaggcccgctttgagctgagatggattcgtcccagtagtgttctgggtgctcccgtttcttgatttcttccgttacagtgagtgaagttgaagcactgcatgacctcttccggaaaataagtaattcagttatcagagataatctaattcacaaggaagaattccaacttgctctctttaggggcaagaagcagcaaaatctctttgttgataggttgcatttaagttgtatgacttaaaacagacaggctttatagaacggcatgagttaaaggagatggtgctggctctgctggacgaatcagatttggatattgcgagcgacgctgtcgagan

SEQ ID NO: 43776 - DNA, 613 bp, Zea mays
  misc_feature: Ceres CLONE 1444988-F
  misc_feature: Encodes the peptide sequence at SEQ ID NO. 43777
tggagctccccgcggtggcggccgctctagaactagtggatcccccgggctgcaggaattcgcacgagaccattacctagaacatcctaatcgaaaaacccagtacccagtagtcagtaaccacatctcctccccctctcccgcaaagacaaggccggtgtccatggccgtccaggcgcagcacttactcaaccccgccttcctgccccacgacatggggcacgccttcagggcactggagggcgccacggtcggcggcggcggctccgcgttcctcgacgagctcggcttcggcgggtgcgcgccggcgccggcgccggcgcccttcgaggtcgccgcgtttggcgacacccagccgcgcagcgagctcacctgcaacgggcgcggcggcgacaacagcgacgtgtttctcccgacgaagcgtgcacgcgtcgcgcccgggttcctggatgatgcccaccagcaggggttggttactgccggtgccgcagggcccaggtgttcccccgaccacttgcaaaacaggaaagcaagggtgcggcccggccttcccacaagtggttcgggcggggggccccccaacaaaggggggtcttggcccttgctctaaccg

SEQ ID NO: 43777 - protein, 148 aa, Zea mays
  misc_feature: Ceres CLONE 1444988-F
MAVQAQHLLNPAFLPHDMGHAFRALEGATVGGGGSAFLDELGFGGCAPAPAPAPFEVAAFGDTQPRSELTCNGRGGDNSDVFLPTKRARVAPGFLDDAHQQGLVTAGAAGPRCSPDHLQNRKARVRPGLPTSGSGGGPPNKGGSWPLL

SEQ ID NO: 43778 - DNA, 745 bp, Zea mays
  misc_feature: Ceres CLONE 1444999-F
  misc_feature: Encodes the peptide sequence at SEQ ID NO. 43779
  misc_feature (407)..(407): n is a, c, t, g, unknown, or other
  misc_feature (644)..(644): n is a, c, t, g, unknown, or other
  misc_feature (651)..(651): n is a, c, t, g, unknown, or other
ggagctccccgcggtggcggccgctctagaactagtggatcccccgggctgcaggaattcgcacgagaccattacctagaacatcctaatcgaaaacttcaacaacattagaaactggatccgcaacatagagcagcacgcgtctgacaacgtgaacaagatcctggtgggcaacaaggtcgacatggacgccaaacgggtggtgtccatggctcaaggccagaagcttgcagacgagtactggatcaagtttttcgagacgagcgcgaaaacaaaccagaatgtggagcaggtcttcttcgccatggcgagggacgtgaagcgaaggctcaccgagaccgttgccgccgcggccgagcctccggctatccagatcagcaagccggactcgggccaggtcggcgcancctcgtcgacgaggtggtcatcatcctgctgtaacacctgatctgccgccgtgtgtgtggctggctctggctgctataggttactgcttaccgcgtggcgtgtggctgtgtgtgcttacttcctccggtgccaagcaagatttaaattcgactcaagatttgccggatcaacgtgtacgcagatagctaggctgggctgctgcgtttgcttgctcctgtcgtgtaaacaaaccctgnagagacngcagtgtctcattgtgtcggaacatgacatgcttgtacattagtagtgcatcatattccagctgttgctccaaaaaaaaaaaaaaaagctatca

SEQ ID NO: 43779 - protein, 87 aa, Zea mays
  misc_feature: Ceres CLONE 1444999-F
  misc_feature (75)..(75): Xaa is any aa, unknown, or other
MDAKRVVSMAQGQKLADEYWIKFFETSAKTNQNVEQVFFAMARDVKRRLTETVAAAAEPPAIQISKPDSGQVGAXSSTRWSSSCCNT

SEQ ID NO: 43780 - DNA, 860 bp, Zea mays
  misc_feature: Ceres CLONE 1445000-R
  misc_feature (770)..(770): n is a, c, t, g, unknown, or other
  misc_feature (775)..(775): n is a, c, t, g, unknown, or other
ccgattgggtaccgggccccccctcgaggtcgacggtatcgataagcttttttttttttttttttaaagggagactgaaattctctaaattaaatgtgccgctgagcaaaccaagggcatattatgataaagatatctgcgtcaataacccagaaggtacatccaaactttggccctttttgagttgcttttttataagaactaacattacacacttctaatcaaattcaaacaatgcacctggacctgtggatatctcatgtataagttcaacctagcctattctgagactgatagcagtgaatttctagacctaaatttcaggtatactcatcttgcctaggagtcccgttcttgcaatctcgtgaataaaacatgcataaaaaatcgaatctcgcagcgcgaacacgaccgatctcccaaatcttaaatcaaatccatggcagatcgcgagcaccaaatctatgaggaactctagagcatatgtatgatttttctatgaggaactccaaatacaacaaacccaatcttgcacacatctcacagtttagatgcagtcaattgatctccttcgtagtcccgataataaagatattggactttttgcctttgctctttcataagagatttcatctccggctttcagtaattggctttttcattttcaggaggagaaagcttcacggaaagcctttcttctttccatcaggcctggatcaggggtggtgaatccaaacatctgcttgctttatggtcagtttttgcctgangggcntttttaaaacaaatcgggcggggaatcccaaccaaccccccgggctgggttattttttttcctcatctaggcaggcatggccaaa

SEQ ID NO: 43781 - DNA, 746 bp, Zea mays
  misc_feature: Ceres CLONE 1445007-F
ctggagctccccgcggtggcggccgctctagaactagtggatcccccgggctgcaggaattcgcacgagaccattacctagaacatcctaatcgaaaaaaccctaaccctaacgcactctcctccctcccacctgcgtcttcgtgcggcggccgcggctctctgtctcgcggcgtcggcgactcggtctcgggcgcggaactcggctgctccctcctcccggtgctccctgctcggctgctccctcatcccggtggtccctggctggctggctccctgctcggctgctccatccacccggcgctccctgctccctcgatccctcctcctcccggagctcctggtccctcggtccctccggcggtgcggcgccctcctcgtcgaccagctcgcacgttagcttcgccgccaacgtgtagaagtggtgtagcgcggctgctgagggagttcctgaaccgtggcagctcgcccagcgtgaagtcggagacgtcgagcagatcggccctgttgtagactaacacgcgctgtacgggcgggatgactggctgcaatgatggtttgctcgggatgactggcttcgtgatctgtgactctctgtaccggggaccgatttactctaaaatatcgcatgttagcagcagactcacctagtataattcgcaatcgccaaatcattggacattgggctgcctacaaaaaaaaaaaaaagctatcagaaccgtcaactcgagggggggcccggtacca

SEQ ID NO: 43782 - DNA, 774 bp, Zea mays
  misc_feature: Ceres CLONE 1445015-F
  misc_feature: Encodes the peptide sequence at SEQ ID NO. 43783
  misc_feature (452)..(452): n is a, c, t, g, unknown, or other
aagctggagctccccgcggtggcggccgctctagaactagtggatcccccgggctgcaggaattcgcacgagaccattacctagaacatcctaatcgaaaaagatgggaatcacctcctcaacctccagcccaacctccagcccgggatcgagagcaatggcgctcgccaaggccaaggagatcgttgcctccgctcccctcgtcgtcttcagcaaaacttcctgccctttctgcgtccgtgtgaagcagttgttcgagaagctcggagcaagctacaaggccattgagttggataaggaaagtgatggagctgagctccagaatgccctgaaggagtggactggacagaggactgtcccaaatgtcttcatcaatggggagcatatttggcgctgtgatgatactatggcactgaacaatgatggggaagctggtgcctctgctgactgangctggaaccatcgcccgttctgcctcaagaaaaacatcactggctgaaatggggggtaaccattcccgggcttaaaaaaatgatgctttacaaggctaaaatttcaaagccttgggggaaaaaatttccctcccccgggaaaaaaccccaaaaaaccccaaaactgttttttttggggggtttgaaaaacccacaaaaatttgcccaaaaaatgggggggtcccccggggcttgagagaaaaaaggaaaaaaaaaacttttttttttttccaaactttttgggggcctttttttttaaaaaaaaaaaaaaaaattctttccc

SEQ ID NO: 43783 - protein, 97 aa, Zea mays
  misc_feature: Ceres CLONE 1445015-F
  misc_feature (15)..(77): Pfam Name: Glutaredoxin Pfam Description: Glutaredoxin
  misc_feature: SWISSPROT Homolog: EC 1.11.1.15 Peroxiredoxin
MALAKAKEIVASAPLVVFSKTSCPFCVRVKQLFEKLGASYKAIELDKESDGAELQNALKEWTGQRTVPNVFINGEHIWRCDDTMALNNDGEAGASAD

SEQ ID NO: 43784 - DNA, 767 bp, Zea mays
  misc_feature: Ceres CLONE 1445017-F
  misc_feature: Encodes the peptide sequence at SEQ ID NO. 43785
  misc_feature (403)..(403): n is a, c, t, g, unknown, or other
  misc_feature (452)..(452): n is a, c, t, g, unknown, or other
  misc_feature (453)..(453): n is a, c, t, g, unknown, or other
caccactggagctccccgcggtggcggccgctctagaactagtggatcccccgggctgcaggaattcgcacgagaccattacctagaacatcctaatcgaaaaacacgcacctcacctctcacaattccaagcccaccagtccaccactctccgcttcgcttcttgtcgctgcggcgcgcggccatggtctccctccgcttccctaccgctgcaatcccccgcctcccgccatcccaggcccccaacggcgtcgccatcgccgccacggtcgccgctgcagccgcggccgcagctgcagtagcggccagcttgaccctcacgggcaagtccaccggccggccagtcccgcaccctgcccctctctgggcctccctctcccggggggaggcgggcggcccccanatccgtcaaacccccccccgtttccaactttcccaaccgaggcccccgnngggcgccgcctactccggataaggcccccagaaaaccagcgacctcggggtccaagtccatccgacgtctacccattcggcgtgtatgcggatggccacgaatttgaagcaccacctgaaggaaaagaactcaaaattccccggctccgaacctaagggaaaccggcacctaaacaactaatcaccaaagcggcgactacccgagaacagaccaccccccaatggacacaggaagcctaagaattccacccgcccgcacactcttagataagacagagaaaccacccatctcaccttttccgaccacctccctt

SEQ ID NO: 43785 - protein, 96 aa, Zea mays
  misc_feature: Ceres CLONE 1445017-F
  misc_feature (73)..(73): Xaa is any aa, unknown, or other
  misc_feature (90)..(90): Xaa is any aa, unknown, or other
MVSLRFPTAAIPRLPPSQAPNGVAIAATVAAAAAAAAAVAASLTLTGKSTGRPVPHPAPLWASLSRGEAGGPXIRQTPPRFQLSQPRPPXGAAYSG

SEQ ID NO: 43786 - DNA, 806 bp, Zea mays
  misc_feature: Ceres CLONE 1445020-F
  misc_feature (395)..(395): n is a, c, t, g, unknown, or other
  misc_feature (397)..(397): n is a, c, t, g, unknown, or other
  misc_feature (403)..(403): n is a, c, t, g, unknown, or other
  misc_feature (405)..(405): n is a, c, t, g, unknown, or other
  misc_feature (806)..(806): n is a, c, t, g, unknown, or other
acagctggagctccccgcggtggcggccgctctagaactagtggatcccccgggctgcaggaattcgcacgagaccattacctagaacatcctaatcgaaaaatctagaaatccacttcgattcgccctggacgctcctgcctcctgctagtcgacgcgcaatccttggcaatctggaacacaggtgaggcgctgagcctgctactactaactaggagccgcggcgggaaatgagggatgcggaggcggcgtcgcgccggcggtggacgctggtgctggtgaacatgacgtccgtgctggataaggcagacgaggtgttgctgccccccttgtacaaagaggtgggcacggcgcttggtttcttctccccccgcgctggggggcgggggaccttntnccccgngnttctaccaaacccccggggttacccggttggacgactacgcactccccgcggccaagaggtggggcccctagtcctccaccgggggaaccctttcctttggggcccccgccagccttccttcgttcaccgattcccgggaatgttcctccagggccccgcccgtcttccccgaattccctccccaatctctctccccctttctccctgggggaaagaaaaggggcgaacaccctgttccccgttttttccccccaaaaacgaggttggagatttcccctctggcctcactcacccccaaaggatagaggtagtcgcgagatttttctttcttttttcggccgccaatcaaataaagacgcgggcgatatattttgagactccacccgaaaggagccccccn

SEQ ID NO: 43787 - DNA, 780 bp, Zea mays
  misc_feature: Ceres CLONE 1445021-F
  misc_feature: Encodes the peptide sequence at SEQ ID NO. 43788
  misc_feature (404)..(404): n is a, c, t, g, unknown, or other
  misc_feature (406)..(406): n is a, c, t, g, unknown, or other
aagagctggagctccccgcggtggcggccgctctagaactagtggatcccccgggctgcaggaattcgcacgagaccattacctagaacatcctaatcgaaaaactttccggcctccgcttcccatcccgatcagcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgatcgcctcgatccggacgacatcgaggcgctccgcgagcgccggatccagcatatgcgccgcgccgccgagtgccgcgccaagtggttttgttttctccctcccagaggggggggaggggccccnanaaaaaatttcttctcccccccccaggttagctagaggatacactgccactttctaccgcgagcaccggccctgccacggcatggaaaaagacttgtcggttctggcgaaaaaactcccgaagacacgattcccaaaggccccccccgagaaagccgcccttcctgaaaaagaaaaccaagaaactcaccctccccacctccccgcatattaaaacaaaccatgggcaaggactactgggtcggctttccaccaccccgcccgccaggaaaaacctgcgccccctagcatcttggaaaatcgccggtcggagcccccgctctcttttcttaggctgggatggttctttcccctttcttaataggcttggctcgcc

SEQ ID NO: 43788 - protein, 84 aa, Zea mays
  misc_feature: Ceres CLONE 1445021-F
  misc_feature (74)..(74): Xaa is any aa, unknown, or other
MDEVVSQILEKQVLSAAKAVEDKLDEEIAALDRLDPDDIEALRERRIQHMRRAAECRAKWFCFLPPRGGGGAPXKNFFSPPQVS

SEQ ID NO: 43789 - DNA, 769 bp, Zea mays
  misc_feature: Ceres CLONE 1445022-F
  misc_feature: Encodes the peptide sequence at SEQ ID NO. 43790
aagctggagctccccgcggtggcggccgctctagaactagtggatcccccgggctgcaggaattcgcacgagaccattacctagaacatcctaatcgaaaaaatattccgttctgttctctcagtcctgtttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatctacgacaacgtcgactcagccaagaagttcgagcccaagtacaggcttatcaggaacggtcttgctaccaaggtggagaagtcgcgcaagcagatgaaggagaggaagaacagggcgaagaagatccgcggtgtgaagaagacaaaggctggggacgccaagaagaaatgagcaaggtttcagtgtactttagccgtcttgagttcgagtaacacctgttcgccgtcagaaattttgtaccccatgtcgcaatgctttgatctagaaaaagagttttttttagctgtttacatcgactactggtacatttgaaaggcatattccccatctttg

SEQ ID NO: 43790 - protein, 137 aa, Zea mays; identical to SEQ ID NO: 43715
  misc_feature: Ceres CLONE 1445022-F
  misc_feature (28)..(111): Pfam Name: Ribosomal_S24e Pfam Description: Ribosomal protein S24e

SEQ ID NO: 43791 - DNA, 761 bp, Zea mays
  misc_feature: Ceres CLONE 1445026-F
  misc_feature: Encodes the peptide sequence at SEQ ID NO. 43792
  misc_feature (615)..(615): n is a, c, t, g, unknown, or other
  misc_feature (684)..(684): n is a, c, t, g, unknown, or other
ctggagctccccgcggtggcggccgctctagaactagtggatcccccgggctgcaggaattcgcacgagaccattacctagaacatcctaatcgaaaacttcttgtgcgccgccaacgcgccggcgccctccgcccctgcgcctcagcctggtaccgtgcctgtgccgccctgtgcctccggtcctccgccctccgcatctgcctggtaccgtgctagtgccgcctgcgcatccgtcttccgcctgggtctccgccctccgcggctccgccttgcgactttaccctgcacggcccgccgccggccggtcgcccgtctggagccactgacccgagtttccgtccagcactccagggaccagcgcctgttcgtccagagtaccaacagatctcgtcaagaggtctgaaggatgaggaagggactgcatcctcagatgcaatggatttcatatgtgacgcagagtggtaggctgatcaatatcatgatgaccaaggtgaaccatactggcaaagtgtaccacatgagggccaagcggcaaatggctcaaagcctcggccagattgcgaagttcaaacgtcgatatgagcaggaagcagagaaaagcaaagacaagtangatggtgttgggaagggagtgtagcctctgtggtcttagtcagttctgttgactgcgaaagtttcagcntaagaacttttcgatgatgatgattttattttagatcacatcatcttttgctccactttcacattgggttgtacccc

SEQ ID NO: 43792 - protein, 76 aa, Zea mays
  misc_feature: Ceres CLONE 1445026-F
  misc_feature (69)..(69): Xaa is any aa, unknown, or other
MRKGLHPQMQWISYVTQSGRLINIMMTKVNHTGKVYHMRAKRQMAQSLGQIAKFKRRYEQEAEKSKDKXDGVGKGV

SEQ ID NO: 43793 - DNA, 768 bp, Zea mays
  misc_feature: Ceres CLONE 1445027-F
  misc_feature: Encodes the peptide sequence at SEQ ID NO. 43794
  misc_feature (768)..(768): n is a, c, t, g, unknown, or other
aagctggagctccccgcggtggcggccgctctagaactagtggatcccccgggctgcaggaattcgcacgagaccattacctagaacatcctaatcgaaaactaaccctaaccctctctcgctcctgcgtcctctccgtgcggcggctcccggatccagctctcgctctcagtctctctcgctcctgtgtgcggctcatgtgctccggtgctctcggtcctgtgcgcggctgcctccggtgctccctgcttcttctccggcttgagagctccggtgctctctggtccctcctcccggcgcgagcggattcttcttcgggtaccggcaactggtggcggcggtgataggcacggcgaaggcgtcgggtaaccgggcgctgttcgtgccggcagaggggatggatctgctcgcccaaatgttcctggagccgccatactaccccagcctagacgccgtcaagacgtttctagcggattactgggtacaacagatagcgttgttttgcaggatttaaaatactatgcaggcatcgtaatttcgttggggccttttgccctttagtgatagagcgattcatttctataagcgatcatgtactggtgttctacgtagatagatggattcagttagataacagtaagatctctttatctctgagaattttttgtgatgtcagttttaggtttttatgctaaatatgattgtgtgttttgcgggctcgggccggcccggtctaataaatgggtcgtgctattcgggcccagccgn

SEQ ID NO: 43794 - protein, 38 aa, Zea mays
  misc_feature: Ceres CLONE 1445027-F
MDLLAQMFLEPPYYPSLDAVKTFLADYWVQQIALFCRI

SEQ ID NO: 43795 - DNA, 752 bp, Zea mays
  misc_feature: Ceres CLONE 1445031-F
  misc_feature: Encodes the peptide sequence at SEQ ID NO. 43796
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaacccccgaccttcaattcccctgcctgttgccgtacgtgcctaagctagcttcgtcgtctcgttgcacgtacgtagtagctagacagccgaatcggctctctagctagctcctcccttccgatcgatatcatcgccatgtcggggatctcgctggcggtggcgccaaggtccgacccggaccacgggtcggagcggcagccgacggcgatgctgggcggcgtgatgggctcgctccgcgtcatcgagctgcagctggtggtcttcctcatcgggggcggggcgggggggcctcntcccgctcatcaacccccccccccccgtcgccaccaccatctacctccttcgcatctccggccgcgcctttcccccgctggcccccaaataattcaaccaaacctgatgaccccgttggttcgcccgccgcctcctcccagatgtcccccggaaatttcccggggcccagacctgttcccggggtacaggctggcgggccacaagcgggcgcctgttcctagcctccggcgccacctcctgggggggttcgcgccggggcgaccacaccgggcggtgcggcccgtacaagcccaaaccgtatctagctcttctggcacaacccccactaacttctgtgtggtgtcccgagggcccct

SEQ ID NO: 43796 - protein, 171 aa, Zea mays
  misc_feature: Ceres CLONE 1445031-F
  misc_feature (53)..(53): Xaa is any aa, unknown, or other
MSGISLAVAPRSDPDHGSERQPTAMLGGVMGSLRVIELQLVVFLIGGGAGGPXPAHQPPPPRRHHHLPPSHLRPRLSPAGPQIIQPNLMTPLVRPPPPPRCPPEISRGPDLFPGYRLAGHKRAPVPSLRRHLLGGFAPGRPHRAVRPVQAQTVSSSSGTTPTNFCVVSRGP

SEQ ID NO: 43797 - DNA, 771 bp, Zea mays
  misc_feature: Ceres CLONE 1445036-F
  misc_feature: Encodes the peptide sequence at SEQ ID NO. 43798
aagctggagctccccgcggtggcggccgctctagaactagtggatcccccgggctgcaggaattcgcacgagaccattacctagaacatcctaatcgaaaagataaccaagaacaaaccattgttggacgcgttcccctcctgcacgcaacctcatctcgtcctccagatccaggatggccgtcctccttgagaccttgcctccccgagtgctctcgtccttgcctgcaaggttcttgttgttttgttttggtggtcgagcatcgcatgttctgcttctggatccagatctggagaaatcgcgaagtcgtcgtcgttcggttcggagcggatctgatgcgaccatagatggaggcggcgggatctctcggtctgcagtcctgctccacctcgatggatgatgtctctgcgctgataattattggatcaatttccataattattagtagatctatgagatatgccgcctggaagaggcgaggtaagctgcagcatgtaaaaaagagaaaaaagatgtgacatcctacaggaggaggcctttgccatgatgggtgcgctcgcatgggcagcaggcaataataaaaagatgattattgcgtgccgggggaggacatcgcacggaggttgatgtttttggccccaggttctcctcactcatcttgatcgagattctgcatgcgatgcttccgctcatgttgatccgctactcacgaccgatttttgcatcgagcacgtagatctactacagaatcgtggagctactacgagattc

SEQ ID NO: 43798 - protein, 74 aa, Zea mays
  misc_feature: Ceres CLONE 1445036-F
MAVLLETLPPRVLSSLPARFLLFCFGGRASHVLLLDPDLEKSRSRRRSVRSGSDATIDGGGGISRSAVLLHLDG

SEQ ID NO: 43799 - DNA, 808 bp, Zea mays
  misc_feature: Ceres CLONE 1445040-F
  misc_feature (232)..(232): n is a, c, t, g, unknown, or other
  misc_feature (233)..(233): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (372)..(372): n is a, c, t, g, unknown, or other
  misc_feature (373)..(373): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (461)..(461): n is a, c, t, g, unknown, or other
tctgaactcgtggatcccccgggctgcaggaattctcacgagaccattacctagaacatcctaatcgaaaaacttcattccggtttccggatagcttacctcccatcgacggtcggtgagccgttggtgagtggcgagacagcgggtgcgctgggcagaacaggcgaccaagaacatgagcacgctggacacccggacgctcaacgaccacctgacaagcttggtcgggaannccccggaggaacccggctcccccccggagcggcggggcggcgcacggcttctttttctgccactggggtcaggggcggaccgggcccgctttttttttttttttttttttttttacgggaaagaaatgggccannnnannttttttnnnnnnnncccccccttctcttcccccaaaaaaaaaaaagaacccccccccaccacagcgcggcgcgcgcctccccatttcnacccccccattgtacggtatctcttcccgctccacgcggcgcccggctcacacaagcttgtcgcacccccccccactacaacgatgattcgtcggccccccgctctcgtaccgccccccgctatctctcgtcaacccggccctagctcgagttctctccgcgcccgcctctctctgtcgcgcgccctggcctgcttctcgttttggtactaccaccgcccctttcttccatcgcactcggggtggaaaatcacccttcaccgctctcatctgacactcccgcacaccctctacacggcccggtcgcgcacgcacagctcgttcgccccgcacccacttctacctcct

SEQ ID NO: 43800 - DNA, 767 bp, Zea mays
  misc_feature: Ceres CLONE 1445044-F
  misc_feature: Encodes the peptide sequence at SEQ ID NO. 43801
tggagctccccgcggtggcggccgctctagaactagtggatcccccgggctgcaggaattcgcacgagaccattacctagaacatcctaatcgaaaaaacaaacaaccctaatccgtgaccgtggacacgccgcaagctccatcgcgcgaatagattggggggattcaatagaggctacgcggggattggtcgcgctcgagatctcagcaccctcgcgcctgaaatctttctattgttgtcgtggttcaggtgatgagatcttggggagcgcgactcgctcggtcctgagatgctggcgggctacggcggcggtggccgcagcgtccatctctcctcccacaaggacctcctcctcggccgctgcggccggagcttcctcttcggcaacacgtggtttctcctccccacttacccggcgcgcctcctgcacaccacggaccgtcgcgctccctccgctttcgtcgccgccatcaaccgagtcccctgcgtgcggtcacactgcacggggcagggcctgctgcagagaggcagcattgtcatggctgcctgcggctatgttcttaggcgagctgagctggttgctgccagccgcagcagccggataaggacccatctggcggaacaccgcctcccgtattgcagccatggggtcactgggcaatgctgcgcgggcagaagtggctttccagaacagggggctggagcattgtaagaagatggtgcaagcttgaattgcctggaccatggggaataaggcgttctggaa

SEQ ID NO: 43801 - protein, 140 aa, Zea mays
  misc_feature: Ceres CLONE 1445044-F
MLAGYGGGGRSVHLSSHKDLLLGRCGRSFLFGNTWFLLPTYPARLLHTTDRRAPSAFVAAINRVPCVRSHCTGQGLLQRGSIVMAACGYVLRRAELVAASRSSRIRTHLAEHRLPYCSHGVTGQCCAGRSGFPEQGAGAL

SEQ ID NO: 43802 - DNA, 827 bp, Zea mays
  misc_feature: Ceres CLONE 1445046-F
  misc_feature: Encodes the peptide sequence at SEQ ID NO. 43803
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (81)..(81): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (432)..(432): n is a, c, t, g, unknown, or other
  misc_feature (815)..(815): n is a, c, t, g, unknown, or other
  misc_feature (827)..(827): n is a, c, t, g, unknown, or other
nnaatacnnnnnccaagattggagctccccgcggtggcggccgctctagaactagtggatcccccgggctgcaggaattcncacgagaccattacctagaacatcctaatcgaaaaagtgttgtgtcctagcgccgccgccgccccaactcgccttgcgtgactgaaagctcgtcggcttccgtccacgcgagaagcgagagcatggacacccaggtgaagcttgctgttgtggtgaaggtgatgggcaggaccggctcccggggtcaggtgacccatgccaaaatgaaattcttggatgatcttatcccccccagcggggggaaagtaaaggggcccctttttttttttgaaatcctccccccgctcccgccccactttttttttttcccccccccgggaaaaagaaaagggnnnnnnnnnnnnncnnncnccccccccccttgtctttaaaaaaaaaaaaaaaaaaaaaccccgggggggggggcccccccagaataaacccgtgcttgataaagtagactcctattctcccctctgtcaaaaaacgaaatatctttggtttaccctaccactgtctctccgtattcgctagattagaaaccccgccggtttctcccgcgacccttaaaatacatccgcgcctagtcctcgccttccactctagagggtggctccgccacgcgccccccgacccctcacttgcggtcttatatttccacgtccctcctatcacgtgcggtatatacgatttcttgtcatttcctggtgtcacaacgcacctactcccccttggtaatagttgtcgtctcttcntcgtggagtgtn

SEQ ID NO: 43803 - protein, 82 aa, Zea mays
  misc_feature: Ceres CLONE 1445046-F
  misc_feature (1)..(56): Pfam Name: Ribosomal_S28e Pfam Description: Ribosomal protein S28e
  misc_feature (71)..(71): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
MDTQVKLAVVVKVMGRTGSRGQVTHAKMKFLDDLIPPSGGKVKGPLFFFEILPPLPPHFFFFPPPGKRKGXXXXXXXPPPCL

SEQ ID NO: 43804 - DNA, 771 bp, Zea mays
  misc_feature: Ceres CLONE 1445047-F
  misc_feature: Encodes the peptide sequence at SEQ ID NO. 43805
  misc_feature (443)..(443): n is a, c, t, g, unknown, or other
  misc_feature (485)..(485): n is a, c, t, g, unknown, or other
  misc_feature (523)..(523): n is a, c, t, g, unknown, or other
ctggagctccccgcggtggcggccgctctagaactagtggatcccccgggctgcaggaattcgcacgagaccattacctagaacatcctaatcgaaaaaagcttaaaccacaacgcaaacaaccaccaaagcaatcgaaaagcaaccctgcaagtgcaggcaaagagagggcgcgaccaaacagatccaatccaatggcgatggcaccgtccgcagcatgcgtcgtctcgttccccgcccgcccggcggcgtccacggccgggccccgcgccgccgcgggcgccggggcggtccacgctttcgcggggtcggcggagggcgccaagtggtgggcgccgctgctggggtggtcggggaaggccgactacctggaggccccggccccggcgccggcgggggcgcaggacgaagcgccgcggaggcagttcgtgggggtgatgacngaggagaaggcccgggagctgcgggcgcgaatggcgcaaacngagtccttccacgacgccatgtaccactcccgcatcgngtcgcgcctcgcacgctccctcctaggttggtgcgcgcgcggccagctcgccggtgggttgcgccgccgccgtagccgggtctctgtctggccgtctctgtgtacatatggtagaattgtcagtagctggctagctgctcgccttttttggtgaaaggaggggggaacgaaagaacagggagaatctggatttttttttttaaccgggggctcctggcttggttccatctccctccgccccgttgggt

SEQ ID NO: 43805 - protein, 160 aa, Zea mays
  misc_feature: Ceres CLONE 1445047-F
  misc_feature (110)..(110): Xaa is any aa, unknown, or other
MAMAPSAACVVSFPARPAASTAGPRAAAGAGAVHAFAGSAEGAKWWAPLLGWSGKADYLEAPAPAPAGAQDEAPRRQFVGVMTEEKARELRARMAQTESFHDAMYHSRIXSRLARSLLGWCARGQLAGGLRRRRSRVSVWPSLCTYGRIVSSWLAARLFW

SEQ ID NO: 43806 - DNA, 754 bp, Zea mays
  misc_feature: Ceres CLONE 1445048-F
  misc_feature: Encodes the peptide sequence at SEQ ID NO. 43807
  misc_feature (278)..(278): n is a, c, t, g, unknown, or other
ctggagctccccgcggtggcggccgctctagaactagtggatcccccgggctgcaggaattcgcacgagaccattacctagaacatcctaatcgaaaacagtggtgctcgtatattgcttgatggaagaaagatagtggttcctcgctatgaagatggaaattttgttggcccaaccattctggctgatgttaaaagtgacatggagtgttacaaggaggaaatatttggtccagtgcttctcttaatgaaggcggagagcctagaagatgccatccnaatcataaacagaaacaagtatggcaatggtgcttccatattttacacatctggcgtctctgccaggaaatttcaaacagacattggagcctggccaggtgggcatcaacgtggcgattccagtccccctgcccgttcttctccttcacggggaagaaagcttcattcccaagaaaatggaatttctacgcgaagggtggggtggaattttttccccctatacaaacctatccccccattggaagggttccccggtggaaagggttcccttcccctggcccccccccaaaaaggagacccaaaagggcctctcccccctcccaaaatccccccccttggggaaaaaacccccgttgggccaaaaaaaagaaatttgtgggggggggcccccccgcgggggggcaaaaaaaagggggggcccctttttttcttttgtggggacctttccgcccttttaaaaacccggggaaaatttt

SEQ ID NO: 43807 - protein, 184 aa, Zea mays
  misc_feature: Ceres CLONE 1445048-F
  misc_feature: SWISSPROT Homolog: EC 1.2.1.27 Methylmalonate-semialdehyde dehydrogenase (acylating)
  misc_feature (26)..(26): Xaa is any aa, unknown, or other
MECYKEEIFGPVLLLMKAESLEDAIXIINRNKYGNGASIFYTSGVSARKFQTDIGAWPGGHQRGDSSPPARSSPSRGRKLHSQENGISTRRVGWNFFPLYKPIPPLEGFPGGKGSLPLAPPQKGDPKGPLPPPKIPPLGEKTPVGPKKRNLWGGAPPRGGKKKGGPLFFFCGDLSALLKTRGKF

SEQ ID NO: 43808 - DNA, 753 bp, Zea mays
  misc_feature: Ceres CLONE 1445051-F
  misc_feature: Encodes the peptide sequence at SEQ ID NO. 43809
  misc_feature (433)..(433): n is a, c, t, g, unknown, or other
  misc_feature (541)..(541): n is a, c, t, g, unknown, or other
  misc_feature (620)..(620): n is a, c, t, g, unknown, or other
ctggagctccccgcggtggcggccgctctagaactagtggatcccccgggctgcaggaattcgcacgagaccattacctagaacatcctaatcgaaaactctcaaacgagtccacactccacatccacatcggcgtgctcccgagccctgaaccctgtccctgacccgttcacccgtcgcaggcgagcagcagacagccagaggagacgtcgcgcctgtgcctaccatggacgagaaggagttctggcgcatgctcgacctcttccccgtcgtccgctcccgtgactattgcgctgatcctggaacatctatcagaggaaccagacagcgatcacgagttcaggaggcagcgaagggcaatgacaaggactcatccgacgcacaagatttgtttatgcagaagttgaagatggctgcagagaaaaagattggnaaacacaaagcagagttcttctgcaaggcatttgaaagaactcatgagaagcttggtttacaagagctgaatttggatgctgctaagaagtttctgagcgcatatganagctgatgatgaacagtaggtagatgctgctcaaggatcggcaggtgccaatgatcctagaaaagtgttgatgctgccnagattttgatcattgacaaacttgtgttgtgtgcagacagtaaactccctttttgtccaccacccttcttttttcaaagaacttttgaagtgtccattgaccctgaatacgtttttcccgtttgccggcccct

SEQ ID NO: 43809 - protein, 106 aa, Zea mays
  misc_feature: Ceres CLONE 1445051-F
  misc_feature (105)..(105): Xaa is any aa, unknown, or other
MDEKEFWRMLDLFPVVRSRDYCADPGTSIRGTRQRSRVQEAAKGNDKDSSDAQDLFMQKLKMAAEKKIGKHKAEFFCKAFERTHEKLGLQELNLDAAKKFLSAYXS

SEQ ID NO: 43810 - DNA, 751 bp, Zea mays
  misc_feature: Ceres CLONE 1445052-F
  misc_feature (615)..(615): n is a, c, t, g, unknown, or other
  misc_feature (698)..(698): n is a, c, t, g, unknown, or other
  misc_feature (704)..(704): n is a, c, t, g, unknown, or other
  misc_feature (726)..(726): n is a, c, t, g, unknown, or other
ggagctccccgcggtggcggccgctctagaactagtggatcccccgggctgcaggaattcgcacgagaccattacctagaacatcctaatcgaaaaaaatccgattcaacggccgagaaaaaaccctcgaagaggaaaaaagaaaaaagaaaacagggagagcccaagcctgagacgaacacgaagaagcaaggagcgaagcagacacgagcgagcccatcccaagttcccaacccacacgaagctgcagcagcaggcagccgcctcgccacgcgcccgagcaacgccgccgagagagccgcccgcccgccggtgagcagcgagggcaattcgtctacggctggtccccgtcccgctcccgcccgccaaccccaattgctcccctctcggaggtcagctcaattcctgctgtttctcggattcgattcggttgcaccgggcgcgtcgtctccctcgccggagatccagcaggtacgagctcgcctggggccgaggatcatgcccccattgctctagggtttgggtgggtaatccaattggctcgccaggcccgcggcctctatgcttgattcgggcctgccgcgccgctccctgggatctcgcggcggttggtgncgcgccagcggtgatgagatcccctccatggccggcgagctgggaattggggtacgggctcgctctctgcaggaagcggcgcnagcccntatggtttgatcctagctgggntgcgcgtgctatcccccattcattg

SEQ ID NO: 43811 - DNA, 748 bp, Zea mays
  misc_feature: Ceres CLONE 1445055-F
  misc_feature: Encodes the peptide sequence at SEQ ID NO. 43812
ctggagctccccgcggtggcggccgctctagaactagtggatcccccgggctgcaggaattcgcacgagaccattacctagaacatcctaatcgaaaaccctccaactttgcacagtctgcgcaccctgccacgacgagatggcttcctgttcctcatcgccacggccacccaccatccctctcctcctcctcctcctctacctcctcctccacttctcctccgtcctcgccgcaccagctcctccagccttgtcacaacaggctggtaccggcggcggcaatgcgacggattcggcggcggcgtggacgccgcggctgaggaagacgttcttggacggcggcatggagcgctggcgcgggcggcggctggtggggcggttccaggtgtgcgcggtgtgcacctgctgcgggggcccgcacgggatgtgcatcccggcgccctgctgctacgcccatcactgcaacatccccaaccgcccccttcggcgtctgctccttcaccccgcgcacctgcaactggctcacctgcccactctagctagcgctcgccgccctggatccatggttttgcttgtctagctggtcgtgtcgtttcgttgtcgatggaagggatatcgtgattcgtccatttggggacagatcgacgaagagtcatcctgccctaaactgcttggttgtagcatgactcacagtagtagcagtatggtgatggttggataatccagcttttttttttctgcactgctt

SEQ ID NO: 43812 - protein, 146 aa, Zea mays
  misc_feature: Ceres CLONE 1445055-F
MASCSSSPRPPTIPLLLLLLYLLLHFSSVLAAPAPPALSQQAGTGGGNATDSAAAWTPRLRKTFLDGGMERWRGRRLVGRFQVCAVCTCCGGPHGMCIPAPCCYAHHCNIPNRPLRRLLLHPAHLQLAHLPTLASARRPGSMVLLV

SEQ ID NO: 43813 - DNA, 743 bp, Zea mays
  misc_feature: Ceres CLONE 1445056-F
  misc_feature: Encodes the peptide sequence at SEQ ID NO. 43814
  misc_feature (743)..(743): n is a, c, t, g, unknown, or other
ctggagctccccgcggtggcggccgctctagaactagtggatcccccgggctgcaggaattcgcacgagaccattacctagaacatcctaatcgaaaaaaaccctacccgactccgccgccgctccgccgccgctccgcctcagcgcatcgccctccgccacagcgtaccgcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgaccctcgtcagctcttccccgcgcgcgccaggagaaaggtccagaggggtctgaagaagaagcccatggcactcatcaagaagctgcgcaagggcgaaaaagatgctcctgctggtgagaaaagcagagcagtcaagacacatctccgtaacatgatcattgtccctgagatgattgggagcattgttggggtctacaacggcaagacattcaaccaggtgagatcaagcctgagatgatcggccactaccctgctgagtctccctctcctatagccggtcaagcatggcaggcccggtattcgtgccaccaactcctcgcggtttatcctctgaaatgagctgtaacccgctctgtagcccccaagagtcccgtggcatggccatccgcttttctactggtttgaacagttaatgccaagan

SEQ ID NO: 43814 - protein, 118 aa, Zea mays
  misc_feature: Ceres CLONE 1445056-F
  misc_feature (55)..(119): Pfam Name: Ribosomal_S19 Pfam Description: Ribosomal protein S19
MADVDVEPEVAAGAPKKRTFRKYSYRGVDLDALLDMSTDDPRQLFPARARRKVQRGLKKKPMALIKKLRKGEKDAPAGEKSRAVKTHLRNMIIVPEMIGSIVGVYNGKTFNQVRSSLR

SEQ ID NO: 43815 - DNA, 757 bp, Zea mays
  misc_feature: Ceres CLONE 1445057-F
  misc_feature: Encodes the peptide sequence at SEQ ID NO. 43816
  misc_feature (512)..(512): n is a, c, t, g, unknown, or other
  misc_feature (556)..(556): n is a, c, t, g, unknown, or other
  misc_feature (648)..(648): n is a, c, t, g, unknown, or other
  misc_feature (649)..(649): n is a, c, t, g, unknown, or other
  misc_feature (656)..(656): n is a, c, t, g, unknown, or other
  misc_feature (663)..(663): n is a, c, t, g, unknown, or other
  misc_feature (680)..(680): n is a, c, t, g, unknown, or other
  misc_feature (681)..(681): n is a, c, t, g, unknown, or other
  misc_feature (720)..(720): n is a, c, t, g, unknown, or other
  misc_feature (757)..(757): n is a, c, t, g, unknown, or other
ctccccgcggtggcggccgctctagaactagtggatcccccgggctgcaggaattcgcacgagaccattacctagaacatcctaatcgaaaagaacagccccgactgggctatattcgttctcccggcgtgctccgtctctcctctcagcgcgacgattacggtaacgccgtcgccgccctacggctcagatcttcgtcgtcatcttctccggcaacgagcacccaaagatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgccctcccatggcagaagaacatctccacctcggtttctctaaaggagtacacaaagtttcaagcttcatacgcaacagttcttaaggcccatatgcatgctctgaagnaaagggagaggaaagacaagaagaagactgcagatgctgagaanggcattgagaccgcacccaagaagcagaggaaagcatcttcaaagaaatcttcagggtccaagtcataaggcgctcacagaactcagggggnnctctccnttatgtngtttaccgccagactanntagagtgtcgtgaaagtttacttatcctggttttaatcnaattcgttgtctggaagataaaagccctgtgataccn

SEQ ID NO: 43816 - protein, 131 aa, Zea mays
  misc_feature: Ceres CLONE 1445057-F
  misc_feature (4)..(93): Pfam Name: SRP14 Pfam Description: Signal recognition particle 14kD protein
  misc_feature (95)..(95): Xaa is any aa, unknown, or other
  misc_feature (109)..(109): Xaa is any aa, unknown, or other
MVVLQPDRFLSELTSMYERSTEKGSVWVTMKRSTLKGKAQLRKMENKGQEVEHRCLVRALPWQKNISTSVSLKEYTKFQASYATVLKAHMHALKXRERKDKKKTADAEXGIETAPKKQRKASSKKSSGSKS

SEQ ID NO: 43817 - DNA, 784 bp, Zea mays
  misc_feature: Ceres CLONE 1445058-F
  misc_feature: Encodes the peptide sequence at SEQ ID NO. 43818
  misc_feature (361)..(361): n is a, c, t, g, unknown, or other
  misc_feature (363)..(363): n is a, c, t, g, unknown, or other
  misc_feature (373)..(373): n is a, c, t, g, unknown, or other
  misc_feature (380)..(380): n is a, c, t, g, unknown, or other
aaagctggagctccccgcggtggcggccgctctataactagtggatcccccgggctgcaggaattcgcacgagaccattacctagaacatcctaatcgaaaaactccgtactcggcgctcctcccccgtcgccgccggaaatcaggaagcccaagtgctctcttgggtgcgctcgtcgccggtggcagtgagccagtgatgcatcttcatctccggcttccttattaggatcagcccgtcgatcgatcatggcgtcgtcgagctcggctgctactactagtggtgacagtcagggtctcaaggctcgagatgcctgcatcgtcggcgtcgcccgcacgcccatcggcgcacttctcgggtngntgtccccctntctccgncaccgagctcggctccattcgcatccaggccccccctcaagagggcgaaggtcgacccggcgctcctgcaggaggttttcatggggcacgtcctcagcgccaacctcggccagggttcgggcaggcaggcagcccttggcgcccggttgcccaacttcggggcctgtaccaccggcaacaaaatttgctcctccagaaagaaagggttgccttgtttcagcgttccaaagatttcacgtggggaacaaccatgtccttggtcccccggtgggattgaaaagaatttccaattgcccccaaaaaatgggggtcttaaacaaaaaacaagaatccccggttccgaaaattgaatggccctttgttgaaaggggagagcttcaaagaatggcccttggggagaattt

SEQ ID NO: 43818 - protein, 89 aa, Zea mays
  misc_feature: Ceres CLONE 1445058-F
  misc_feature: SWISSPROT Homolog: EC 2.3.1.9 Acetyl-CoA C-acetyltransferase
MGHVLSANLGQGSGRQAALGARLPNFGACTTGNKICSSRKKGLPCFSVPKISRGEQPCPWSPGGIEKNFQLPPKNGGLKQKTRIPGSEN

SEQ ID NO: 43819 - DNA, 789 bp, Zea mays
  misc_feature: Ceres CLONE 1445060-F
  misc_feature: Encodes the peptide sequence at SEQ ID NO. 43820
tcacccgcggtggcggccgctctagaactagtggatcccccgggctgcaggaattcgcacgagaccattacctagaacatcctaatcgaaaaactcgcgtccgcccccgccgccgcctttcgtcccggcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgcccaatatgggcaagtcattgaaagctagattatcattgaccgtgagtctgggaggtctagaaggtttggctttgtacttacactcctctggagaggctcaactgccattactgcccttgaatggaaggactcccaatgaccgaacataccttgttatcatgctaaccaaaaaaaaggtggcttcccgggccgcggggggtatgggggcccgccctcaccggggggggaaaaaatatggggggggggcgcgggtttttggggggggggaaacataaggggggtgggccccccccaaaaaaaatttggcgccacaaattgggcccccccacaggggggggggggggaaataaaaattcctggggagaaaggaccccttttttccgggggaggacacaattcttccccaaaaaatttttttttaaaaaaattttgtggaaaaaggggggttgttttttacacacgcgccccc

SEQ ID NO: 43820 - protein, 59 aa, Zea mays
  misc_feature: Ceres CLONE 1445060-F
MALANKLGGLLKKATSSNLSVYQAIRCMSSKLFVGGISYQTDDHSLRDEFAQYGQVIES

SEQ ID NO: 43821 - DNA, 737 bp, Zea mays
  misc_feature: Ceres CLONE 1445065-F
  misc_feature (237)..(237): n is a, c, t, g, unknown, or other
  misc_feature (270)..(270): n is a, c, t, g, unknown, or other
  misc_feature (354)..(354): n is a, c, t, g, unknown, or other
ctggagctccccgcggtggcggccgctctagaactagtggatcccccgggctgcaggaattcgcacgagaccattacctagaacatcctaatcgaaaaacggccaccacacatcccttcctctctttctcctcgaggctcgagcattcgtgctgctccgaccccaccgccacaggctcggcggtccggcgatctcgctcaccggcgggacatgactacttcaaggcgcttgctgacnagagaacgcaaagttccagaagacatcaccagnaggggttctgtgcctgaaacactgtcaagagggaaatgactaccctgttggccctctagtgcttgggttcttcaatcttggcgncattgaacccccttgtttcagatcacaggaacgcaaccagcggcgggcggcctggaaagccgccccaatctaatccccaaaaaaaaagttgctgttaaacctgcccccctcagaatggggacaccctaaattttaaacgggaaaaaagcccggattcccttattttgggggcccttaactggaacgaaccccaggggaaaacttggccttataaaagggtaaaagggaaaagggcccccgtttttctttaaaaaaaaaaaaaaaattttttttccccccccccgggggggggcccccccccattcccccaaaagaagggaaaaacccccccccgcggccttttttaaacccgggggaaaaaaacgtggttccaatttatattg

SEQ ID NO: 43822 - DNA, 757 bp, Zea mays
  misc_feature: Ceres CLONE 1445067-F
  misc_feature: Encodes the peptide sequence at SEQ ID NO. 43823
ggagctccccgcggtggcggccgctctagattagtggatcccccgggctgcaggaattcgcacgagaccattacctagaacatcctaatcgaaaaaaccggcccaaccccgtctaggtttaggcacccgaccgccgcagcgtccccgccgccacgaccacgagcgaaaggaggtcgccggaagagggggcgcggagatgagcgggagcgcgttcaacgcgttcaagtcgcgggtgccggtggcgtggagtccccggctgtacatcacgctggtgcggggcctccccgggacgcggcgcctccaccgccgcacgctcgagggcatgcgcctccgccgctgccaccgcaccgtcgagcaccgcaccacgccgtcgctcctcgggatgctcacccaggtgaagcgcttcgtcgccgcgcacaccgaggagatgtactacgcgcggaagcaggccgaggcggagaggcgcgcgcccagactcccgctcgtcgtctcccaccagccacagccgccggctccgaagcccgcagccgccgccgcggtgggtgccgctaccactgcgcagtagcctccgggcatcagaagcctttctcacagttcagcggcataattattgatttgcctgtgtttgggtctgctggttttcaaacaatcgctttgggtcttctttgctcacgagatctagccacggatttgatcaatttcctcagatcgttgggggtgcaccctgctttggccgtgtttttaaatgggtttaaag

SEQ ID NO: 43823 - protein, 122 aa, Zea mays
  misc_feature: Ceres CLONE 1445067-F
  misc_feature (20)..(71): Pfam Name: Ribosomal_L30 Pfam Description: Ribosomal protein L30p/L7e
MSGSAFNAFKSRVPVAWSPRLYITLVRGLPGTRRLHRRTLEGMRLRRCHRTVEHRTTPSLLGMLTQVKRFVAAHTEEMYYARKQAEAERRAPRLPLVVSHQPQPPAPKPAAAAAVGAATTAQ

SEQ ID NO: 43824 - DNA, 1667 bp, Zea mays
  misc_feature: Ceres CLONE 1445071
  misc_feature: Encodes the peptide sequence at SEQ ID NO. 43825
agtgtgcgccgcttgccaccttccgcctttccatgaccacgccgctcctgctgtgtgatcctaggacgacgcgcctcccgactgccctcgcacgctaggagtggggaggggaggctgagcacgagcacaacacgagcgccgccaacgccaacgccaagacgagctcgcgaaggaccatgccgagatccaggggcaacgagccgccgctgcgggcgtcgcagcgcgcgccgctgcacctcaagacgacggcctgctccgaggcgaatggcgcgcaccaccgccccgtcgccgaccggagcagccccaaggtcggcgaccggcactcgccgcgcagccctctgcccgagaagaagcgtgcggccgggacgcgtttggcggagctggaggcgaagctggggaaagtgcaggacgagctcaagaagctgcgggagcagctcgcgtccgctgaggccgccaagaaagacgcgcaggtcgcgctcgaggaggccaagaagcgcgtcggtaccaagggaagcccggcctcctcatccaccaccaccacttcgcctccctctcccccttcgccaggtgtcgaaagcgcgaagaagcccgaggagctgaagctgccgcagccggcggccgaggaggagagcagcgtaaacgcgccggcgaccgatgtgtttgaggtcgtccgggccgagtccggggacaaggagaaccatagcgcgacggccacgggcgctgaggactgcgaggttgtgagctgcggcgaggaggcggcgctggccgagaaggaggaggaagaggagacgaagaaaatgatcgaggaggacaacagcgcggcggcggaaaccgacggcgccgagaaggagagctgggaggtcctggagctgaaggcgaagctggcggagaaggacgcggagatcgccgccctcgcggcagaaaacgccgagctcaagaagcggtccggagaggccgcggaggcggcgaagatggtcgaagaggacgcggcggcgaaggcggcccaagccgagcgcgatctgaaggatggcgcggcgcgggaggcccggacgggcgagcagctgagggcgtcggaggccgcgcgggaggcgctggacgccgagctgcggcgcctgcgcgtgcagaccgagcagtggcgcaaggcggcggaggcggcggccgcggtgctcggcggggacaaccacctcaccgggctggcgggcagcggcaacggcaacggcaacgggtggggggaccccgccacgatgcccgacgacggcgacgacgagggcttcggtggcaagcggaagggcgccggcatccgggtgctcagcgacctgtggaggaagaaggggagcaagtgaaggcctgcctcccgcggaatgggggtgatcgtgttttggatttcgcaacggtgagcccgcgccagcttcaactccattgcctgccttgcactagctttagctccatcattttaccgcgttttggtttggattctacttatgtttgtatgatgatgatgatgctcgtgagattgaactatgtctgtaacgactgatcccgctgctgcctgctacctcagcgtaaggagcagcaacaatgctggtttgggtgatcttctttgttattttccatagcggaattgaggaatgctcgattgcagcagcatccgaaaaaaaaaaaaaaaa

SEQ ID NO: 43825 - protein, 388 aa, Zea mays
  misc_feature: Ceres CLONE 1445071
MPRSRGNEPPLRASQRAPLHLKTTACSEANGAHHRPVADRSSPKVGDRHSPRSPLPEKKRAAGTRLAELEAKLGKVQDELKKLREQLASAEAAKKDAQVALEEAKKRVGTKGSPASSSTTTTSPPSPPSPGVESAKKPEELKLPQPAAEEESSVNAPATDVFEVVRAESGDKENHSATATGAEDCEVVSCGEEAALAEKEEEEETKKMIEEDNSAAAETDGAEKESWEVLELKAKLAEKDAEIAALAAENAELKKRSGEAAEAAKMVEEDAAAKAAQAERDLKDGAAREARTGEQLRASEAAREALDAELRRLRVQTEQWRKAAEAAAAVLGGDNHLTGLAGSGNGNGNGWGDPATMPDDGDDEGFGGKRKGAGIRVLSDLWRKKGSK

SEQ ID NO: 43826 - DNA, 730 bp, Zea mays
  misc_feature: Ceres CLONE 1445075-F
  misc_feature: Translation starting site: 612
  misc_feature (627)..(627): n is a, c, t, g, unknown, or other
  misc_feature (638)..(638): n is a, c, t, g, unknown, or other
  misc_feature (662)..(662): n is a, c, t, g, unknown, or other
  misc_feature (679)..(679): n is a, c, t, g, unknown, or other
  misc_feature (716)..(716): n is a, c, t, g, unknown, or other
ggagctccccgcggtggcggccgctctagaactagtggatcccccgggctgcaggaattcgcacgagaccattacctagaacatcctaatcgaaaaaccagaacaggcaacgcactactcgttcgtatctttaagcttgctgctgcagcgtaagaaaaagcagtctgcactcggtcggtcggtcgctctgttcagctagctgcatgctcggccaccatatctcctccagtacgttcgtcgttctccacgccgctatctggtctgcggtaagcagcagctagaggccgttgtgtaggctacacagaagatcatcgaggaggatgctggtgaagaaagacaacagcacggcgatggcggcgggcgtgctgccgctggcgtcgctgaacacatcagcatcgtgtgccggtcggtggaggcgtcgctgcgcttctacgcggacgtgctcggcttcgtgcccatccgccgccccggctccttcgacttcgacggcgcctggctgtttcactacgggatcggcgtccacctactgcagtcggaggaccccggcagccctccggagaaatagggcgagatcaaccccaggacaccacatctccttccagtgcgagagcatggtggcggtggaancgccgctcaanggagatggcatcccgtacgtgcancgctgcgtggagaaggncggcatcaacgtggaacagatcttcttcacgacccgnacgctttcatgatc

SEQ ID NO: 43827 - DNA, 748 bp, Zea mays
  misc_feature: Ceres CLONE 1445076-F
  misc_feature: Encodes the peptide sequence at SEQ ID NO. 43828
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
ggagctccccgcggtggcggccgctctagaactagtggatcccccgggctgcaggaattcgcacgagaccattacctagaacatcctaaccgaaaactaataaacccatctccgcctctggttcgtcctccatctcctcccaaatggcggcaccaagcacccaaccgctttccgcatggcttcccacatcgacttccgctgcttggatgagggcctcggcggcgagcgcggcaagcgcaagcgccgcgaggatgccgagnnncgcgcccgcggattccatggacctcgatgccgacgcgccacggccgtctaagctcccgcggcatggccttccctctcgaaaccctcgaaagcgggcttctttcggcccacccaacctacgacggcgtcatccaagggcggttgtcggaacccccggggaaggaagccccaccccggaaaggtcgccggggcggttccccaaaacccacccccttgaaaaacccccgagaaaaatccttaaaaccggtacaagcccccaagggggaatccaaaaaaaaaccccgaaaaaaagggggccaacaaaaacccccccggagggtgaaaacgaaaacgaaaaatttcccccccggccacaaatggaagggcccccccccaaaaaaccaaaaaaacccccccaaaaaaaacgggcttttgggggcccccaaaatattcttcccgaaaaaaaagggcgaacccccccaggggggcgcccaaaaaaaaaaaaaac

SEQ ID NO: 43828 - protein, 45 aa, Zea mays
  misc_feature: Ceres CLONE 1445076-F
  misc_feature (29)..(29): Xaa is any aa, unknown, or other
MASHIDFRCLDEGLGGERGKRKRREDAEXRARGFHGPRCRRATAV

SEQ ID NO: 43829 - DNA, 749 bp, Zea mays
  misc_feature: Ceres CLONE 1445077-F
  misc_feature: Encodes the peptide sequence at SEQ ID NO. 43830
  misc_feature (420)..(420): n is a, c, t, g, unknown, or other
ctggagctccccgcggtggcggccgctctagaactagtggatcccccgggctgcaggaattcgcacgagaccattacctagaacatcctaatcgaaaaccagacggccaatctaacctccatgtgcgctgcccaaaatgcaaccaacacttctgccttgattgtgatatttacatccatgagagcctgcacaattgccctggttgtgagagccaacgcagcatcgcttcatagagaccgtgttactgcgtgcattattcaggttgtaccttaagctttctcctacactgtaacagccagcaaagttgtttcatgatcagcttttttctggctagcttttctgagaatctagctgtagagagaatctggctgtgagaagaatctgtgtatcgtgggaatacgtgcggacgaagatgagtgntccaaatagttcaggatctagaaagcgatgaatttctaccatcgcgatgattccaccgattcggggtttaggttgatttgggagggttcccaccaaaacgattctaataaaaccggtttaaaaactggaaggttgaaattccccacacccttttggtggccaaaacctaaaaaaaacccaaaaaaaagggggcttccggccccctttataagaaaaccccggtaaaaatagaaccccaacaaaggggtgggggtattggccccccaaaaaaggcaagggggtgaaatttttttttttgccccaaaaaaaacccaaaagttttacccccc

SEQ ID NO: 43830 - protein, 76 aa, Zea mays
  misc_feature: Ceres CLONE 1445077-F
  misc_feature (20)..(70): Pfam Name: C1_4 Pfam Description: TFIIH C1-like domain
GAPRGGGRSRTSGSPGLQEFARDHYLEHPNRKPDGQSNLHVRCPKCNQHFCLDCDIYIHESLHNCPGCESQRSIAS

SEQ ID NO: 43831 - DNA, 756 bp, Zea mays
  misc_feature: Ceres CLONE 1445079-F
  misc_feature: Encodes the peptide sequence at SEQ ID NO. 43832
  misc_feature (447)..(447): n is a, c, t, g, unknown, or other
  misc_feature (454)..(454): n is a, c, t, g, unknown, or other
  misc_feature (560)..(560): n is a, c, t, g, unknown, or other
  misc_feature (576)..(576): n is a, c, t, g, unknown, or other
  misc_feature (582)..(582): n is a, c, t, g, unknown, or other
  misc_feature (591)..(591): n is a, c, t, g, unknown, or other
  misc_feature (597)..(597): n is a, c, t, g, unknown, or other
  misc_feature (661)..(661): n is a, c, t, g, unknown, or other
  misc_feature (684)..(684): n is a, c, t, g, unknown, or other
tggagctccccgcggtggcggccgctctagaactagtggatcccccgggctgcaggaattcgcacgagaccattacctagaacatcctaatcgaaaaaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgcgagcacgaagaagagcgcggacgaggtggagctcctgcggcggcggaacgcggagctggagcgggaggtggcggcgctgcggctggagctgggcgcggcgcggcgccgcgccgagancgcgaangaagccgaaggagcgctgtgcgtgcagctcggcgacgccgaggtgggagcgctcgagctcgcgcgcgcctaccaggcccacgtccacgagctcgccagggagctcngcgccgcgcgcgcggncccggnacgcccggncagatnagttctcgtgggctggtagtaagctactagtagctatagcgtggcgttcagcgggatggctgtngttcccgcgtttgggtggcgtcngacggcaccccgcgccgcggtgccatttatttgctcgccgcggcaaaaaaaaaaaaaaaagcttatcgatcc

SEQ ID NO: 43832 - protein, 112 aa, Zea mays
  misc_feature: Ceres CLONE 1445079-F
  misc_feature (57)..(57): Xaa is any aa, unknown, or other
  misc_feature (59)..(59): Xaa is any aa, unknown, or other
  misc_feature (95)..(95): Xaa is any aa, unknown, or other
  misc_feature (100)..(100): Xaa is any aa, unknown, or other
  misc_feature (102)..(102): Xaa is any aa, unknown, or other
  misc_feature (105)..(105): Xaa is any aa, unknown, or other
  misc_feature (107)..(107): Xaa is any aa, unknown, or other
MAPSISVGAAAPSRAAGASTKKSADEVELLRRRNAELEREVAALRLELGAARRRAEXAXEAEGALCVQLGDAEVGALELARAYQAHVHELARELXAARAXPXRPXRXVLVGW

SEQ ID NO: 43833 - DNA, 750 bp, Zea mays
  misc_feature: Ceres CLONE 1445080-F
  misc_feature: Translation starting site: 124
  misc_feature (392)..(392): n is a, c, t, g, unknown, or other
  misc_feature (418)..(418): n is a, c, t, g, unknown, or other
  misc_feature (551)..(551): n is a, c, t, g, unknown, or other
ctggagctccccgcggtggcggccgctctagaactagtggatcccccgggctgcaggaattcgcacgagaccattacctagaacatcctaatcgaaaaatcggttccaacaccagccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcncaaggacggtgtccacccccacttcnaagataatgctggagtgattgtgaatccaagggtgagatgaaaaggtctgcaatcactggacctatcggcaaggagtgtgctgacctttggcctaggatcgccagtgcagcaaatgccatcgtttgagagccngtttggaatgtgtttagacttgagtatgatcatctcaattgtgtgttgcaggtgttgtaaaggtgctattgaacttgatggctctttttatgtttgggcactcaattctgtagtgaacaaaaatttcctggttgccttcaaaaaaaaaaaaaaaaagctttatcgatacccgtcaacccccagggggggccccggtacc

SEQ ID NO: 43834 - DNA, 750 bp, Zea mays
  misc_feature: Ceres CLONE 1445081-F
  misc_feature: Encodes the peptide sequence at SEQ ID NO. 43835
  misc_feature (388)..(388): n is a, c, t, g, unknown, or other
  misc_feature (429)..(429): n is a, c, t, g, unknown, or other
ggagctccccgcggtggcggccgctctagaactagtggatcccccgggctgcaggaattcgcacgagaccattacctagaacatcctaatcgaaaaaaaactcctccacaaccctcgtcgccgccggctgctccacccccgccaccgccatgggtaaattccgcaagcttggccgcgattactcccaacgcatctgcatgctcaggacgatggtgtcgcagctggtgaagcacgagcgcatcgagaccaccgttgccaaggcgaaggaggttcggcggaaggcggatcagatggtgcagctagggaaggagggtactcagcatgcagcaagacgtgctgctgcctttgttcggggtgatgatgtcgttcatcagctatttactgagcntggccttttcgctacagagatcgagctggggggctacacangaatgttaagaccccagatacgtgttggtgatgctgctccaatggcatacatcgagttcgtgaatagggagaatgagcttcaagaagccaaacttgcacgcccgcgcctcctcaacgagtcccctctgatccatgggccaagtcacgtgctagcaaacagtgggcaggactaaaatcacaagagctcggaaacggacggctaatgagctagtatactaatgtccataaaaagttccgtattttgctaaaaaattttttatctaaaattctgcgatagaaaatcaaactttatggcatttgaagctccaattccgagggaag

SEQ ID NO: 43835 - protein, 150 aa, Zea mays
  misc_feature: Ceres CLONE 1445081-F
  misc_feature (17)..(114): Pfam Name: Ribosomal_L17 Pfam Description: Ribosomal protein L17
  misc_feature (80)..(80): Xaa is any aa, unknown, or other
  misc_feature (94)..(94): Xaa is any aa, unknown, or other
MGKFRKLGRDYSQRICMLRTMVSQLVKHERIETTVAKAKEVRRKADQMVQLGKEGTQHAARRAAAFVRGDDVVHQLFTEXGLFATEIELGGYTXMLRPQIRVGDAAPMAYIEFVNRENELQEAKLARPRLLNESPLIHGPSHVLANSGQD

SEQ ID NO: 43836 - DNA, 792 bp, Zea mays
  misc_feature: Ceres CLONE 1445084-F
  misc_feature: Encodes the peptide sequence at SEQ ID NO. 43837
  misc_feature (355)..(355): n is a, c, t, g, unknown, or other
  misc_feature (416)..(416): n is a, c, t, g, unknown, or other
  misc_feature (444)..(444): n is a, c, t, g, unknown, or other
  misc_feature (469)..(469): n is a, c, t, g, unknown, or other
ggagctccccgcggtggcggccgctctagaactagtggatcccccgggctgcaggaattcgcacgagaccattacctagaacatcctaatcgaaaaaccaaattggcacttccgtaccccgaccccggccaccgtgtggaaacagaaacagcaatggcggggaggctggtgccgagcacgaagaaggcgatggagcaccgggaggagaagcccaaggtgccgtcgagcgacccgggctccgaccccgacctggtgcagctggtggccgggcagcagcccgcccaacatctcggagatgaagccgctgacgcgggaggcgtacggcggcgggatgtacgcggccgaagaagaaggncgcccggcgaagggccccgcgcgcccccccgccaaccccacgcagagcgccgactggtccnacgagcagcgcgctggcgcgaagcccanccaccccgcgccgccgtccaccggngaacgcgacctcgacatcaccggccagtcctacatccagaaccccatgtgccggctgccaacccccccgcttggcctttgccattggcgttgtgggtttggcccccgtacaggacacaaaggacttggctagaaacttgggttggggacttgccaaaatggcctttggaccccttcccttttgttaaaatgggtaacgtacctgactaatttgcccacccaaaaaaaggtgttggctttggggcttttaaaaaaaaaaaaaaagaaaaagctttatctctattccgctcccaaccccgggaggggggggccccgcggacccct

SEQ ID NO: 43837 - protein, 101 aa, Zea mays
  misc_feature: Ceres CLONE 1445084-F
  misc_feature (41)..(41): Xaa is any aa, unknown, or other
  misc_feature (50)..(50): Xaa is any aa, unknown, or other
MKPLTREAYGGGMYAAEEEGRPAKGPARPPANPTQSADWSXEQRAGAKPXHPAPPSTGERDLDITGQSYIQNPMCRLPTPPLGLCHWRCGFGPRTGHKGLG

SEQ ID NO: 43838 - DNA, 757 bp, Zea mays
  misc_feature: Ceres CLONE 1445087-F
  misc_feature: Encodes the peptide sequence at SEQ ID NO. 43839
  misc_feature (452)..(452): n is a, c, t, g, unknown, or other
  misc_feature (504)..(504): n is a, c, t, g, unknown, or other
ggagctccccgcggtggcggccgctctagaactagtggatcccccgggctgcaggaattcgcacgagaccattacctagaacatcctaatcgaaaagcaaaccctcctaccccattccgccgcccgccccgcgaccccgaggaggaggcaagatgaagacgatcctggcgtcggagacgatggacatcccggagggcgtcacagtgacggtggcggccaagctggtgacggtggagggcccccgcgggaagctcacccggaacttcaagcacctcaacctcgacttccagctgcaggagggcggccgcaagctcaaggtggacgcatggttcggcacccgccgcaccatggccgccatccgcaccgccatctcccacgtccagaacctcatcaagggggtcaccaagggctaccgctacaagatgaggtttgtctacgcccatttccccatncacgcgtccattcaccactccaacaccgccatcgagataaggaacttcctcnggcgagagaaggtcagaaaggtggacatgcttgacggcgtgaccatcctccgctcccgagaggtcaaggacgagcttattctcgatgggcacgacgtcgagttagtctctcgctccgcgccctcatcaacagaaatgcatgtcaaagagaggtatcaggaagttttggatggtatcttgtgagcgacaaggtgtgatcgaagaggacagtgaggacatttagtgtatcgtttgagtgggaattatgtttggtt

SEQ ID NO: 43839 - protein, 177 aa, Zea mays
  misc_feature: Ceres CLONE 1445087-F
  misc_feature (12)..(86): Pfam Name: Ribosomal_L6 Pfam Description: Ribosomal protein L6
  misc_feature (100)..(100): Xaa is any aa, unknown, or other
  misc_feature (118)..(118): Xaa is any aa, unknown, or other
MKTILASETMDIPEGVTVTVAAKLVTVEGPRGKLTRNFKHLNLDFQLQEGGRKLKVDAWFGTRRTMAAIRTAISHVQNLIKGVTKGYRYKMRFVYAHFPXHASIHHSNTAIEIRNFLXREKVRKVDMLDGVTILRSREVKDELILDGHDVELVSRSAPSSTEMHVKERYQEVLDGIL

SEQ ID NO: 43840 - DNA, 737 bp, Zea mays
  misc_feature: Ceres CLONE 1445088-F
  misc_feature: Encodes the peptide sequence at SEQ ID NO. 43841
  misc_feature (393)..(393): n is a, c, t, g, unknown, or other
  misc_feature (394)..(394): n is a, c, t, g, unknown, or other
  misc_feature (408)..(408): n is a, c, t, g, unknown, or other
  misc_feature (414)..(414): n is a, c, t, g, unknown, or other
  misc_feature (415)..(415): n is a, c, t, g, unknown, or other
  misc_feature (438)..(438): n is a, c, t, g, unknown, or other
ctggagctccccgcggtggcggccgctctagaactagtggatcccccgggctgcaggaattcgcacgagaccattacctagaacatcctaatcgaaaaactcaccactagagttggtgccgcgactgcgaatccggcgcaatggccgcggcggcgatgggcctcgtgcgtgagctcctgcagccacagggaaccacgagcacccgccggctctgcagcacaggtgtgggcgtgggcgtggcggcgggcttcctcagcgccgggaccgtcgcgtcggcatccagcgcatgcccgactttaccgtggtcacaggacggggcgcgggggcgggcacaggtgttcatgcagcacgactgcgcggcgtgccactcgggcctggcgtacgctggcctcnncgacgaaggcctgncggccnngagcaaggtggaagccaaggcgnccgaaatcgtggtggtcatgaccccaaggagagggagccttaacaacggaaacaacttccggggggccctggcccccggacctctccccgtcccaaaatgctgaaggggtggcccccggaaccttgtaagggggaaaaaaataaaaaaaaatggcccgggtttcccggggggggggggttttcttcgcggagggggggttcccccgccccctaaaggcgcccatattctcctaaaaaaccccccccccccttttgggagggaaattttcgcggggggggccggggggttttttcttttg

SEQ ID NO: 43841 - protein, 133 aa, Zea mays
  misc_feature: Ceres CLONE 1445088-F
  misc_feature (85)..(85): Xaa is any aa, unknown, or other
  misc_feature (90)..(90): Xaa is any aa, unknown, or other
  misc_feature (92)..(92): Xaa is any aa, unknown, or other
  misc_feature (100)..(100): Xaa is any aa, unknown, or other
MAAAAMGLVRELLQPQGTTSTRRLCSTGVGVGVAAGFLSAGTVASASSACPTLPWSQDGARGRAQVFMQHDCAACHSGLAYAGLXDEGLXAXSKVEAKAXEIVVVMTPRRGSLNNGNNFRGALAPGPLPVPKC

SEQ ID NO: 43842 - DNA, 751 bp, Zea mays
  misc_feature: Ceres CLONE 1445091-F
  misc_feature: Encodes the peptide sequence at SEQ ID NO. 43843
  misc_feature (356)..(356): n is a, c, t, g, unknown, or other
  misc_feature (359)..(359): n is a, c, t, g, unknown, or other
  misc_feature (387)..(387): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
ggagctccccgcggtggcggccgctctagaactagtggatcccccgggctgcaggaattcgcacgagaccattacctagaacatcctaatcgaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttnccngacagctttctggcgggccgcgtggtgncgcgcacggaatgcagctccgggcattcccggtgcgacacccccaacgcagcgccgaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 43843 - protein, 103 aa, Zea mays
  misc_feature: Ceres CLONE 1445091-F
  misc_feature (72)..(72): Xaa is any aa, unknown, or other
  misc_feature (83)..(83): Xaa is any aa, unknown, or other
MAGTAKTPVLGFLLALALVATSTPAAATTLTLHNLCPYPVWPLVSPNTGFPAISENTGRLDGGGRGLVSFRXPDSFLAGRVVXRTECSSGHSRCDTPNAAPTP

SEQ ID NO: 43844 - DNA, 769 bp, Zea mays
  misc_feature: Ceres CLONE 1445092-F
  misc_feature: Encodes the peptide sequence at SEQ ID NO. 43845
  misc_feature (268)..(268): n is a, c, t, g, unknown, or other
  misc_feature (275)..(275): n is a, c, t, g, unknown, or other
  misc_feature (334)..(334): n is a, c, t, g, unknown, or other
aagctggagctccccgcggtggcggccgctctagaactagtggatcccccgggctgcaggaattcgcacgagaccattacctagaacatcctaatcgaaaaatgtacacaatttctcgcgctcctaccgccgcttcgttctctaaccttggctcccgctccctccgcaggagcatctcaacaccgccttgaggaccccccaactcgccggctgcagccatggtgaaatattcgacggagccaaccaacccccacaagtcaaccaaggncatgggncgtgacctacgtgttcactttcagaacacccgtgagacagcttttgcccttaggaagtngtcactcaccagggcaaaaagtactttgaagatgggattgcccaaaagcaggcatcccgttcccatgaattggggccccttgaactaacccctcagtaattctcctcctcaaaggggagggacgtggcccgggaaacggcaaaattttttcaacctttccaaaagctgaaacaaatcttaagaaaaggtttttccaaaccccctctggccccctttagggaaaacggtcaaaaaaggggggagagccccccccgtggggggaacaccactttatgcccccccggcgcaaaaaaatttttttaaaaaaaaaaacccccccaaaaaaaattctcttcctcccccccccgggggtgggaggggacacccccctctttgtgggaaaaatatatttttttttttcccccccccatttataaaaaaagtgggggggccccc

SEQ ID NO: 43845 - protein, 67 aa, Zea mays
  misc_feature: Ceres CLONE 1445092-F
  misc_feature (17)..(17): Xaa is any aa, unknown, or other
  misc_feature (39)..(39): Xaa is any aa, unknown, or other
MVKYSTEPTNPHKSTKXMGRDLRVHFQNTRETAFALRKXSLTRAKSTLKMGLPKSRHPVPMNWGPLN

SEQ ID NO: 43846 - DNA, 756 bp, Zea mays
  misc_feature: Ceres CLONE 1445094-F
  misc_feature: Encodes the peptide sequence at SEQ ID NO. 43847
  misc_feature (378)..(378): n is a, c, t, g, unknown, or other
  misc_feature (519)..(519): n is a, c, t, g, unknown, or other
  misc_feature (574)..(574): n is a, c, t, g, unknown, or other
  misc_feature (577)..(577): n is a, c, t, g, unknown, or other
ctggagctccccgcggtggcggccgctctagaactagtggatcccccgggctgcaggaattcgcacgagaccattacctagaacatcctaatcgaaaattcccagctccgcctccttttcctgccttcctcctcactagtcgctcccccgcggctcgcgcaggcgggcgacacaacgaggctaaatccctatcgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgancaggttatggaggtggagcaaaaatacagtgagatccgcagacctgtctatctcaagaggggtgacattatcaagaccatcccggacttttggctcacagcgtttatgagccatcctctattaagtgagcttctgactgangaggaccagaagaatattcagtacttagactccattgatgtggatgattctgatngtnaggcaggatactcccattcatctaacttctctgagaacccgtacttttgagacacaaagcttgcaaagacctatatctttgctgatgatggaacatatcgataccgtcgacctcgagggggggcccggtacccattccccctatagtgagtccgatacgcgcgctcactggccgtcgtt

SEQ ID NO: 43847 - protein, 133 aa, Zea mays
  misc_feature: Ceres CLONE 1445094-F
  misc_feature (32)..(134): Pfam Name: NAP Pfam Description: Nucleosome assembly protein (NAP)
  misc_feature (51)..(51): Xaa is any aa, unknown, or other
  misc_feature (98)..(98): Xaa is any aa, unknown, or other
  misc_feature (117)..(117): Xaa is any aa, unknown, or other
  misc_feature (118)..(118): Xaa is any aa, unknown, or other
MTAPADKGKKAKTDADGGEENEQIDGVLVLSIEKLQEIQDELEKVNEEASXQVMEVEQKYSEIRRPVYLKRGDIIKTIPDFWLTAFMSHPLLSELLTXEDQKNIQYLDSIDVDDSDXXAGYSHSSNFSENPYF

SEQ ID NO: 43848 - DNA, 773 bp, Zea mays
  misc_feature: Ceres CLONE 1445099-F
  misc_feature: Encodes the peptide sequence at SEQ ID NO. 43849
  misc_feature (546)..(546): n is a, c, t, g, unknown, or other
aaagctggagctccccgcggtggcggccgctctagaactagtggatcccccgggctgcaggaattcgcacgagaccattacctagaacatcctaatcgaaaaaattccattccaaatccgcagtccgcagacgagagtggaagcggggcacagacagagaagccaatggcgctgtccctctccctcgcgcgccccgcgcccctcgccgtttccgccggcgcaggagccaggaagctacccgcagccagcctcgcattcccggcgaaatccttcttcggcgcgccgctggccgccaccgcggcctccgtcgcgtcgccgctcccgcgcaagccggccacctccaccacctcgctcgaggtcgtcgcggcggggaagaagggctacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgancatgttacgggtgcactgccctacctcaaagtgaataggaaagcaaactgagagctacgtggtcttcaaaaaatcattaagtttcgttccaccaaattgtaattttgtgtaccctccactgtatttcccttctcaaaatactgaggcatcatttcaaaagcagcaaaaaacaactcctgggtatcacagtatagcgatatttcagaatgaggtgcactgcttgctaa

SEQ ID NO: 43849 - protein, 143 aa, Zea mays
  misc_feature: Ceres CLONE 1445099-F
  misc_feature (75)..(133): Pfam Name: Ribosomal_L35p Pfam Description: Ribosomal protein L35
  misc_feature (127)..(127): Xaa is any aa, unknown, or other
MALSLSLARPAPLAVSAGAGARKLPAASLAFPAKSFFGAPLAATAASVASPLPRKPATSTTSLEVVAAGKKGYKMKTHKASAKRFRVTGRGKIVRRCAGKQHLLAKKNTKRKKRLSKMVQVNKSDYXHVTGALPYLKVNRKAN

SEQ ID NO: 43850 - DNA, 764 bp, Zea mays
  misc_feature: Ceres CLONE 1445103-F
  misc_feature (444)..(444): n is a, c, t, g, unknown, or other
  misc_feature (453)..(453): n is a, c, t, g, unknown, or other
  misc_feature (535)..(535): n is a, c, t, g, unknown, or other
  misc_feature (536)..(536): n is a, c, t, g, unknown, or other
  misc_feature (563)..(563): n is a, c, t, g, unknown, or other
  misc_feature (704)..(704): n is a, c, t, g, unknown, or other
ctggagctccccgcggtggcggccgctctagaactagtggatcccccgggctgcaggaattcgcacgagaccattacctagaacatcctaatcgaaaaatcgaaaaatgccagtatcatctccgtctccgcttcgccttcaatctccgttcatccaccgtccaatcaatgccactccgtcttcttcccgttcactctccgcgaggaatctccgttcgccgtcgacgtcgtcttatccgcgaatcaaatcagaagtcgacacgaacacggtaatcgcaatctccgtaggtgtggcgagcgtcgcactgggaatcggaatccctgtgttctacgagacgcagatcgataacgccgctaagagagagaacactcagccttgttttccttgcaatggcactggagctcagaagtgcaggttgtgtgtgggaagtgggaacgtgacggntgagcttgntggaggaagagaagaagtgtcgacctgtattaactgcgatgggtgtggtcctttgactgcactacttgtcaaggctctggtnngtcacctcgataccttgaccgaagggnagttcaggatgatgactagatatctttgcatctgattacgatatgaaaagactcttctccctcccccatctcatagttattcattgtgtacaataactggatttttttggtcatcaaatggtgtaggaaatcatgaccttngtacagtcgaaggagtacttttactgcaaaaaaaaaaaaaaaaaagcttatcgataccgt

SEQ ID NO: 43851 - DNA, 755 bp, Zea mays
  misc_feature: Ceres CLONE 1445110-F
  misc_feature (505)..(505): n is a, c, t, g, unknown, or other
  misc_feature (698)..(698): n is a, c, t, g, unknown, or other
aaagctggagctccccgcggtggcggccgctctataactagtggatcccccgggctgcaggaattcgcacgagaccattacctagaacatcctaatcgaaaaatataaacgagcgcgcgcgcctttccgcctctgcaccacacccaaggcagccagtgagccagaaagaagaagaggccattcgaagctgccacgcacgccacgcggaaaccattcgagtccacgaggacgaggagcagcagcagaagaaagggcaaggaacatcctccggtggccgccgccatggccggctgctgcgtgttcctccggtggccgtcggcctcgccgtcgcgcatcggctaccgctccctcgtccacacggcggccgacgacggcgccccgccgtcgacggtgacggtcgtggtcgggaaggaccccccccgttcgcggtggaccgcctcgtgctcgactcctacccgctccggctgctcctggagacggcggcgcgcagggaggagcgcagggncgggggcggcgccatcttcgtggacgtcgacgccatcctcttcgagcacatcctctggctcgcctgcgacgcccgctccgtctcccagatcctgcacctcgacctcaagagatcatcgacttctacgctcaggacgcgtgactggtccaccactctcagctgcgcggctccggctccgggtcctcctcctccntggaacgtactcctcacacctgcgcgtttcttccatggatggatattcttttttttt

SEQ ID NO: 43852 - DNA, 797 bp, Zea mays
  misc_feature: Ceres CLONE 1445113-F
  misc_feature: Encodes the peptide sequence at SEQ ID NO. 43853
  misc_feature (486)..(486): n is a, c, t, g, unknown, or other
  misc_feature (797)..(797): n is a, c, t, g, unknown, or other
ccaagctggagctcaccgcggtggcggccgctctataactagtggatcccccgggctgcaggaattcgcacgagaccattacctagaacatcctaatcgaaaaaaatcttcgacgagtttatggcgcctgagatcacgagcgccagcgcgatgaccgaaaagatgtgaacagctgtcacttatctccggcgccgtggggctccccaaggatttccaagccagtgttgaagcattgccatctatgctgcatcggaactattcattactgccagagttggcaaaaagtttgcatggtgtgcaactagaaaatgagcagcgctgtggacatcaaatagaggacattgaacctggacttgaatctggaagtgtttaaaaccgacccatcgtaattgaaatttttggtaagaagaaaacccccccccttaaccctggagttaaaattgctgacaagaaggtggctttaacccccccacagtaataacttantttaattgttacttccaacatctgtatcagtttatgaagaagctttgataaatccggcaaggaaaatgaggcacctgcttgcctgttacttgaaggaactgctgttgtttcttcatgccactcccttcctggaatgcttggaacgaccacttgcgtaattgtaaaccaaagagctggcactttctggccaaaaagaggaaaacgggggtcgtaagaagggccaaggtatcccccggaaaattttagattgccaacgcctctgttcctcctgccccccatttggcctctaaatatccctggcggatccctan

SEQ ID NO: 43853 - protein, 43 aa, Zea mays
  misc_feature: Ceres CLONE 1445113-F
MLHRNYSLLPELAKSLHGVQLENEQRCGHQIEDIEPGLESGSV

SEQ ID NO: 43854 - DNA, 765 bp, Zea mays
  misc_feature: Ceres CLONE 1445117-F
  misc_feature (606)..(606): n is a, c, t, g, unknown, or other
  misc_feature (618)..(618): n is a, c, t, g, unknown, or other
aagctggagctccccgcggtggcggccgctctagaactagtggatcccccgggctgcaggaattcgcacgagaccattacctagaacatcctaatcgaaaagactgctgaatgcttataatgatgagtctgattacactgtactttcacatgtaacctctgtatgtttaagcatttctaaaataacagttgacgctactcctgacttgaacaaagatatcaaacagcttttgatcaaccttcttctcccagctgtcataaagttaggctgggaccccaaggatggtgagagtcatcttgatgtaatgcttagatcactgctcttgactgcgctggtcagacttggacataatgaaactataaatgaaggagttcggcgtttccacatcttctttgaagacggcaaaacttcccttcttccaccagatactagaaaggctgcatatcttgccgtgatgcgaactgttagcacctcaagcagatccggttttgatgctctccttaaatctacagagaagcatctgaaccacaggagaaatcacgtgtcttaagctccctgtcttcatcaccggatcaggatattgttttggaggcattgaactttatngttactgatgangtgcggaatcaagatcattttacatccttggtggcattagcttagaggacgagaaatgcatggacctggttgaaagaaaactggatcacgtgttgaagacatgaaatcgagtcactcatatcaaactcattgagtccattgcccacg

SEQ ID NO: 43855 - DNA, 758 bp, Zea mays
  misc_feature: Ceres CLONE 1445119-F
  misc_feature: Encodes the peptide sequence at SEQ ID NO. 43856
  misc_feature (745)..(745): n is a, c, t, g, unknown, or other
ctggagctccccgcggtggcggccgctctagaactagtggatcccccgggctgcaggaattcgcacgagaccattacctagaacatcctaatcgaaaaaccagtgtccttccagatcccgccgcgcgtctccttccgcgacacgctctcagtctcacgccacagctcgtcgcgttcgtcaacggtcgacccatcgcctatggaaggaaggcgcgagccggaggcggacggcggaaaggccgggggcctcccgccgtcggagccgccgcacctgcagggccagccgccgcaggagtacgggtacggcacgttccagggtcctcgacatcctcccgtcgggttcccgcagcctgccccgcctcccgggctcggcagcggcggctatcacaaccagcagcagccgtacgcgcctgcggagacgtactacgcccaggggtaccaggccgtaccaggctatggtcctgttgctgaaggaagacctgtgagaatgaggcgtctccccatgtgtggcctcggcttaggctggtgtcttttcataactgggtttttcttggctgccattccatgggtcattggagctttcgttcttatatgtgtgcgggtacatgacccacgagagaaacccagatacgttgcttgcacaattgctgccccgtgtgctgccgttgcctcctcctggggggtactaaggaacgcacgtgtgggtgattgcctccagagaaagcaatcatggtgatttgcggtgnatacctgtggggg

SEQ ID NO: 43856 - protein, 178 aa, Zea mays
  misc_feature: Ceres CLONE 1445119-F
MEGRREPEADGGKAGGLPPSEPPHLQGQPPQEYGYGTFQGPRHPPVGFPQPAPPPGLGSGGYHNQQQPYAPAETYYAQGYQAVPGYGPVAEGRPVRMRRLPMCGLGLGWCLFITGFFLAAIPWVIGAFVLICVRVHDPREKPRYVACTIAAPCAAVASSWGVLRNARVGDCLQRKQSW

SEQ ID NO: 43857 - DNA, 764 bp, Zea mays
  misc_feature: Ceres CLONE 1445123-F
  misc_feature: Encodes the peptide sequence at SEQ ID NO. 43858
  misc_feature (374)..(374): n is a, c, t, g, unknown, or other
  misc_feature (378)..(378): n is a, c, t, g, unknown, or other
atagctggagctccccgcggtggcggccgctctataactagtggatcccccgggctgcaggaattcgcacgagaccattacctagaacatcctaatcgaaaagcctatcttcctgcttcggacagttgtgagagagaggggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacgaccgcctctaccgcccctccggcgacaaccaccagtagatngccngcaagatccgtgactcggtcaagaagctggagccaactttaccaagcactggtgctgttgatgtttttacagttttgagctcataaggtcagccatgaccatattgtaatctgtgaccaggtagacttgcccactgctctgtccaactattgtcttgggaccctgtgttaatccttgctatatggatctgacagcgctcatgtaattcaggaatcctggactatcttttatgtgcttatttgagttggcaggtgcgttttccgtaaaaaaaaaaaaaaaaagcttatcattaccgtcgaactcgaggggggggcccggttcccaattttccccttatagggagccgtaataagggcggtccttggccctcgttttacaacgggggg

SEQ ID NO: 43858 - protein, 67 aa, Zea mays
  misc_feature: Ceres CLONE 1445123-F
MASGGKGLNATGEFFRRRDEWRRHPMAGNQLRHATPGLGIAIVAFGIYLVGEAAYDRLYRPSGDNHQ

SEQ ID NO: 43859 - DNA, 751 bp, Zea mays
  misc_feature: Ceres CLONE 1445124-F
  misc_feature: Encodes the peptide sequence at SEQ ID NO. 43860
  misc_feature (695)..(695): n is a, c, t, g, unknown, or other
ggagctccccgcggtggcggccgctctagaactagtggatcccccgggctgcaggaattcgcacgagaccattacctagaacatcctagtcgaaaactctctcgtcctcttgttccactgtttcccaccccaaaatactccaccaccgcacccactagggtttccgcaccgcattgcagaacctcgccgcctccacccgcaccacaccaccggcgatgtccacagcggcggcgcagggcggcagcgacaagccggcgctccggaggcccgtcttcaccaaggtcgaccagctcaggccgggcaccaacgggcacaccctcaccgtcaaggtcgtcagcgccacccccgtgcctgggcgcgcgcgcccaggcgcacccgccgccgccccatcccgcgcgccgcgcatcgccgagtgcctcgtcggggacgagaccggcgccatcgtcttcaccgcccgcaacgaccaagttgacttgctgaagcccaatgcgacagtgatcttgcgcaatgccaaaatagacatgtttcaagggatcatgaggcttgcagtggacaagtgggggcggattgaggctgtagagccagccagtttcacggtgaaggaagacacaacctgtctctatagagtatgaattggtaaatgtgctgagtaactgtcccatccagcgtttctgccccctttatttcgtgcatangaagggagtacccatgatgaacattataaagcctcttgaagcggaacgagtttatt

SEQ ID NO: 43860 - protein, 138 aa, Zea mays
  misc_feature: Ceres CLONE 1445124-F
MSTAAAQGGSDKPALRRPVFTKVDQLRPGTNGHTLTVKVVSATPVPGRARPGAPAAAPSRAPRIAECLVGDETGAIVFTARNDQVDLLKPNATVILRNAKIDMFQGIMRLAVDKWGRIEAVEPASFTVKEDTTCLYRV

SEQ ID NO: 43861 - DNA, 791 bp, Zea mays
  misc_feature: Ceres CLONE 1445128-F
  misc_feature: Encodes the peptide sequence at SEQ ID NO. 43862
  misc_feature (315)..(315): n is a, c, t, g, unknown, or other
  misc_feature (316)..(316): n is a, c, t, g, unknown, or other
  misc_feature (378)..(378): n is a, c, t, g, unknown, or other
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaaaaaaatctatccctccatttcctcgatctgagctccctctatccctccatttcctcggcgcccgttcccagctctccatggacgccagcagcaagcgcacaggtctgcacaggggcgtcatccttgtgcaggcctccctgccggatctctccctttggctgcggcgagttctacacatcccagccatggctggtcttgctctcatggctgaccnnactcatctctcaaagctcatccatggcgcctggtcatgctcaaaccaccgtgcgtgcgtgcngaaagtaaagacgaagaagaaagcatgtgaccgaaacaagatgatcgttgcagtgatgtggtgccaccacaaggtgcatttgttggacgacccaacgaggattggacctacccggggaatgctcgcaaaggaggcacttccccagaaaaccttatttaggggtaaattaaaggccccccctgattggaaagaaggggaaatttggcctaacccccccccccggaaaaagggccaaaaagggtttccgttctccccgaaaaaacccaagaaaatggggggccgggnttcaccaaaaaaccgtttttccccggaaaatttcccggggaaaaaaaatttgggtgttttttccaaaccccaaaagtggttcccgcgggaactttataaggggggggggcgcggttaaaaaaaaaaaa

SEQ ID NO: 43862 - protein, 200 aa, Zea mays
  misc_feature: Ceres CLONE 1445128-F
  misc_feature (46)..(46): Xaa is any aa, unknown, or other
  misc_feature (67)..(67): Xaa is any aa, unknown, or other
  misc_feature (162)..(162): Xaa is any aa, unknown, or other
MDASSKRTGLHRGVILVQASLPDLSLWLRRVLHIPAMAGLALMADXTHLSKLIHGAWSCSNHRACVXKVKTKKKACDRNKMIVAVMWCHHKVHLLDDPTRIGPTRGMLAKEALPQKTLFRGKLKAPPDWKEGEIWPNPPPRKKGQKGFPFSPKKPKKMGGRXSPKNRFSPENFPGKKNLGVFSKPQKWFPRELYKGGGRG

SEQ ID NO: 43863 - DNA, 765 bp, Zea mays
  misc_feature: Ceres CLONE 1445131-F
  misc_feature: Encodes the peptide sequence at SEQ ID NO. 43864
  misc_feature (601)..(601): n is a, c, t, g, unknown, or other
  misc_feature (744)..(744): n is a, c, t, g, unknown, or other
  misc_feature (752)..(752): n is a, c, t, g, unknown, or other
  misc_feature (754)..(754): n is a, c, t, g, unknown, or other
  misc_feature (765)..(765): n is a, c, t, g, unknown, or other
aaagctggagctccccgcggtggcggccgctctagaactagtggatcccccgggctgcaggaattcgcacgagcccattacctagaacatcctaatcgaaaaacgatccccaacttaacgccgatcggaggccggagagaccggctcagcctcgctccgccgccgccggcgaccatgtccctggcggctatcttcgtcttcctcatcgtgtccgcgctgcagctgctctaccgctacctcgacctcgccagaaagagcggaggacttagtgatgagcagatcaaagtgcggcttgaaatcaagcaacttctcaaggaggctgatcagttgtcaacgccgtccacatttgcacaagctgctaaactcaagcgcctggctgctgccaaggagaaggaactggcaaaaatgcaggaacatgaccttaaagggaagcaatccttatacgacaaatacacaaaatttttgttggttactaaggtcataatttatgctgtgctcgttctgtgcttttggagtactcctgtaactgcagttcccacacatcttctacagcccttcggaaaaatgttttcctggagaggtgttgatactgccaccggancatgtgtggttggaatactcccgtgggctgttttgacctcctcggtcagcaagatgctgtgccagaaaactggcttcgtgcttgtgcgtccgtagcgcctttcatgagaaaagtcagcagttgctgcaccctaacagactgcntactttgntncctctctatan

SEQ ID NO: 43864 - protein, 173 aa, Zea mays
  misc_feature: Ceres CLONE 1445131-F
  misc_feature (143)..(143): Xaa is any aa, unknown, or other
MSLAAIFVFLIVSALQLLYRYLDLARKSGGLSDEQIKVRLEIKQLLKEADQLSTPSTFAQAAKLKRLAAAKEKELAKMQEHDLKGKQSLYDKYTKFLLVTKVIIYAVLVLCFWSTPVTAVPTHLLQPFGKMFSWRGVDTATGXCVVGILPWAVLTSSVSKMLCQKTGFVLVRP

SEQ ID NO: 43865 - DNA, 748 bp, Zea mays
  misc_feature: Ceres CLONE 1445134-F
  misc_feature: Encodes the peptide sequence at SEQ ID NO. 43866
tggagctccccgcggtggcggccgctctagaattagtggatcccccgggctgcaggaattcgcacgagaccattacctagaacatcctaatcgaaaaaccaattccgcaaaccctagaaaaatctcgctccgcaaaaccatgagcgcccctatggagatctccttctctgcgcccccaccccctccggacgcagcgtctaccgccgccgcttccccgctgctggaacctgccgccgcgcagatgctgccccctgtcgccgcggtctcctcctcgcagccgatgcagcagacagctgcggctgcggccgtggttgctccttccccggccgacgataaggtcctcgtgtcagttgaggtactgttgcacgccacgagcgtagctcgccacgaggacgtccaggtggcggtcgagaggatgctcgaagctcgaagcttaagctatgttgatgggcctgtgccaattcctgccgataattcttttcttcttgaaatgtcaaaaggatacgaataagtgatactgatgagtgggttgagaatcacaaagttctcttattttggcagtcaagcctgtcgtgcatgtgttccagctgagtgaagatggtccaggtgaagaccaagcgaggatgatacactctctagctttaatgagtggccctacctgccaaagatttgatgtcctgtgggaaagttaatatatgaagtttggctcaagcaaaggttgctgaaaaatgctgcccggggtttgctt

SEQ ID NO: 43866 - protein, 123 aa, Zea mays
  misc_feature: Ceres CLONE 1445134-F
MSAPMEISFSAPPPPPDAASTAAASPLLEPAAAQMLPPVAAVSSSQPMQQTAAAAAVVAPSPADDKVLVSVEVLLHATSVARHEDVQVAVERMLEARSLSYVDGPVPIPADNSFLLEMSKGYE

SEQ ID NO: 43867 - DNA, 749 bp, Zea mays
  misc_feature: Ceres CLONE 1445135-F
  misc_feature: Encodes the peptide sequence at SEQ ID NO. 43868
  misc_feature (370)..(370): n is a, c, t, g, unknown, or other
ggagctccccgcggtggcggccgctctagaactagtggatcccccgggctgcaggaattcgcacgagaccattacctagaacatcctaatcgaaaaaagaacagagcagtactgcaggagagcgagtgagctgtccaaagcgtccggccaaacccgcgtgtgtccaccactcctcctgcacaagcaccgccacaatgcggccgcacaccctggcgctgctcctgctcctgctggccacgccggcggcgacgcgtctggcatcggccgcctgcgcgggcgagaagttccccgcggggcgggcgtacgcggcgtgcgaggacctcccgaagctgggcgcgtcgctgcactggacgtacgacgcgggaaaaancaccctgtccgtggcgttcgtggcggcgccggcccccccccggtgggtgggtgacgtgggggctaaaaccgacgggcaaaggcaaggccgacgcgcaagcgctgggtggagctggcggggtccgggtccggatccgcggaccccacccgtgcggacgtacaacaccacggggtacgtcccccttggggaacgtccccgaccccccggttttttccggccaacgaacctgcccgcgaaagccgccagcggggggcaggatccgggttggacgggatcccctacacctgcccaaaggggacaaagcctctttaaaaccagttagtggcaagttcgccagggtaaacccacgtccgggccccccccaaaaaataaccccatt

SEQ ID NO: 43868 - protein, 165 aa, Zea mays
  misc_feature: Ceres CLONE 1445135-F
  misc_feature (59)..(59): Xaa is any aa, unknown, or other
MRPHTLALLLLLLATPAATRLASAACAGEKFPAGRAYAACEDLPKLGASLHWTYDAGKXTLSVAFVAAPAPPRWVGDVGAKTDGQRQGRRASAGWSWRGPGPDPRTPPVRTYNTTGYVPLGERPRPPGFFRPTNLPAKAASGGQDPGWTGSPTPAQRGQSLFKTS

SEQ ID NO: 43869 - DNA, 768 bp, Zea mays
  misc_feature: Ceres CLONE 1445138-F
  misc_feature: Encodes the peptide sequence at SEQ ID NO. 43870
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
aaagctggagctccccgcggtggcggccgctctagaactagtggatcccccgggctgcaggaattcgcacgagaccattacctagaacatcctaatcgaaaaatagcttcgtctgtataccctatatctctatagccaacacacacacaaatactctccattccattccatctcaaaggatagaataatgggcggtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcacccggcggcgtgtgcaagggcctacnnncaccgctgctttctgcaccaccgactggctagtactggcttcggctcggcctcgcctcggctcgtgtcccggcgtgggcataaccgcaacggaacagtaaaacatgcctgcatgggttacgaaaaatttggcagtaccccccaggtaaggggatataaaaaaattggaatggaaaaaaaccccgtttttaaaacgggaaatcctaaaagccaacccccccccggtttttttggaaaaaaaaaaaaaaaaaaaatttattctacccccccccacccgggggggggccccggaacccaattcgccctatgaggaggaaaaaataaccccgcccctcggggccgtttttttaaacgggggagggggaaaaacccc

SEQ ID NO: 43870 - protein, 102 aa, Zea mays
  misc_feature: Ceres CLONE 1445138-F
  misc_feature (32)..(77): Pfam Name: Gamma-thionin Pfam Description: Gamma-thionin family
  misc_feature (70)..(70): Xaa is any aa, unknown, or other
MGGLSTKLFVVLLLLVCYTGTQGGPVTMVSARKCESQSFRFKGPCSRDANCANVCLTEGFTRRRVQGPTXTAAFCTTDWLVLASARPRLGSCPGVGITATEQ

SEQ ID NO: 43871 - DNA, 828 bp, Zea mays
  misc_feature: Ceres CLONE 1445139-F
  misc_feature: Encodes the peptide sequence at SEQ ID NO. 43872
  misc_feature (363)..(363): n is a, c, t, g, unknown, or other
  misc_feature (457)..(457): n is a, c, t, g, unknown, or other
  misc_feature (473)..(473): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (680)..(680): n is a, c, t, g, unknown, or other
ccccgcggtggcggccgctctttaactagtggatcccccgggctgcaggaattcgcacgagaccattacctagaacatcctaatcgaaaaccacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgcaatggccgccgcgctcgtggcgtccgccgcagccgccgaggccaccgccccggctcccgcgtccgacgccgcggccgccgtacccctcgccgcgggcttttttgaagngggcgccttttgttacctcttctggtagaatccgccctgacacccatgggttcctgctcccaaaaaatgcattcctctgggactggccgccccntaaactcccaaccccnggtgtcgtagggctgtcttttgcgataaagtgtatcgccaggccgggaggggcaatgtattgaaagtcagccttttagtgacggcgcgcgaaagaaagcgctcccactccgcccgcgcgggaacacggcccttccacccccctccctggttgggccgacggaaatccttccacaaccccctcctcccnnntcccccgctatttcccnggaaagggattgctctcgatctaaacaaacacacggaaataaatttgtattagttaaccgttgcagcgctcaagggggacacccaggaacccacatctcctcccccatcatcaaggtctgagggtggggccgcccccactccacaggg

SEQ ID NO: 43872 - protein, 57 aa, Zea mays
  misc_feature: Ceres CLONE 1445139-F
  misc_feature (49)..(49): Xaa is any aa, unknown, or other
MAGLRMKFVAVAAMAAALVASAAAAEATAPAPASDAAAAVPLAAGFFEXGAFCYLFW

SEQ ID NO: 43873 - DNA, 734 bp, Zea mays
  misc_feature: Ceres CLONE 1445141-F
  misc_feature: Encodes the peptide sequence at SEQ ID NO. 43874
  misc_feature (314)..(314): n is a, c, t, g, unknown, or other
  misc_feature (349)..(349): n is a, c, t, g, unknown, or other
  misc_feature (402)..(402): n is a, c, t, g, unknown, or other
  misc_feature (459)..(459): n is a, c, t, g, unknown, or other
  misc_feature (582)..(582): n is a, c, t, g, unknown, or other
  misc_feature (588)..(588): n is a, c, t, g, unknown, or other
  misc_feature (637)..(637): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccanggggcacgccgagggcgggttcgaggcggccgccngagctgagaacggcgggtgccagtgcggcgggcactgccagtgcgacccctgncactgcggcaagtgagctaggtgctccaccctgcaggccggccgggagaagctagcntattatttatagctaaataaagtatagcggcgtcgctgtgtgtgtttcgagtcagtcagtcagttagttgcgtgccatggctggcatgctctgagtctgaaatgatgatgatgcctgatggcngcctcntgtcctgtagtcttcccctgccccctcgggccgcttctgcggcaagcantgtgttgtgttggtgttgtgtgggtgcaccccgtancagggtaccctgtgccctgctgtgttgtgtcaccatcatccataaaaatcttatatctaaa

SEQ ID NO: 43874 - protein, 82 aa, Zea mays
  misc_feature: Ceres CLONE 1445141-F
  misc_feature (1)..(80): Pfam Name: Metallothio_2 Pfam Description: Metallothionein
  misc_feature (49)..(49): Xaa is any aa, unknown, or other
  misc_feature (61)..(61): Xaa is any aa, unknown, or other
  misc_feature (78)..(78): Xaa is any aa, unknown, or other
MSCCGGNCGCGSGCKCGNGCGGCSKMYPDMAEQVTTTTQALIMGVAPSXGHAEGGFEAAAXAENGGCQCGGHCQCDPXHCGK

SEQ ID NO: 43875 - DNA, 716 bp, Zea mays
  misc_feature: Ceres CLONE 1445142-F
  misc_feature: Encodes the peptide sequence at SEQ ID NO. 43876
tagctggagctccccgcggtggcggccgctctagaactagtggatcccccgggctgcaggaattcgcacgagaccattacctagaacatcctaatcgaaaaattcccaccggccagtcggccacccaccgtgcctcgtcgtcgccgcagcccgcacctgcagccgccatgtggaggggcggcgccaccaccgccttcgtcgctagggccctccgctcgcgcctcctcctcgaccccatccaccacccggtcacgtcgctcgctcctatttcttcggcgcgtacctcttcctcttccacctcgtccactgccgcggcgaacaccatcgtggaagaagcggcggtggcggcggctgtatccgtttcgcagataccgcacccccgcggagggggagggactatggaaaggctaccccacctctcaaagtccgcctcaggctcttgttgtgcacttccggggctgttatgtgcttggaatgcaacctctggaattggttgactttgttgaattggctggaacataagggtcgacaccccaaaaaccctaacagttttccaaaaaaaattgatttaaaggaaagaaattggacttccccgcctttggggcaaaacatccggaatggtagaagggggcacacattttgaaattcagaaaaccttttttgccggaaagttttgcaagtaaatgtttggcactggtttaaattctcaacttttg

SEQ ID NO: 43876 - protein, 109 aa, Zea mays
  misc_feature: Ceres CLONE 1445142-F
MWRGGATTAFVARALRSRLLLDPIHHPVTSLAPISSARTSSSSTSSTAAANTIVEEAAVAAAVSVSQIPHPRGGGGTMERLPHLSKSASGSCCALPGLLCAWNATSGIG

SEQ ID NO: 43877 - DNA, 752 bp, Zea mays
  misc_feature: Ceres CLONE 1445148-F
  misc_feature: Encodes the peptide sequence at SEQ ID NO. 43878
  misc_feature (578)..(578): n is a, c, t, g, unknown, or other
  misc_feature (581)..(581): n is a, c, t, g, unknown, or other
ctggagctccccgcggtggcggccgctctagaactagtggatcccccgggctgcaggaattcgcacgagaccattacctagaacatcctaatcgaaaagttgcaaaaatctctactccgacccccacctaaggcaccgactcgccggggacagagagagaccgacgcgccggcagatcccaagctcaccggagagggggaagagggcgaccgaaggcggcgatgggtttcatcatggacttcgcggagaatatgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgatgacctcatcgcccgccactctgggctcgcgccgtcttcctgaacacccgttccgatctttgcccagaaggtctacttgggcatcaataagaaactctttccccctcaactgatggtngtnccatcctcttctgtctgggaaatggtgtcaccaaactaccctatttcctgttccagtttgcatggaagtataatttgggacttctattcccaagtggtggctttggataagaaatgtttcaataatccggcagtttttgatgaaaaaaaaaaaaaaaaagcttatcggtcc

SEQ ID NO: 43878 - protein, 93 aa, Zea mays
  misc_feature: Ceres CLONE 1445148-F
MGFIMDFAENMILRLMEDPDKRDQVRREHVYKMKERCERTKAAWSLPLRPYGFWTFDRFNSQLSWDPQISQAAGRRDPYDDLIARHSGLAPSS

SEQ ID NO: 43879 - DNA, 759 bp, Zea mays
  misc_feature: Ceres CLONE 1445149-F
  misc_feature: Translation starting site: 159
tggagctccccgcggtggcggccgctctagaactagtggatcccccgggctgcaggaattcgcacgagaccattacctagaacatcctaatcgaaaaattccgtgccgtcccaactcacccgcggctccgtgccatccgtcgccgccggcgcaccgcgatggccgcctccgccccggccgtgaggcctctcgcccgggccgcaatccctatcccgctctctgcgcggccgcggaccgccagggtctccttgctccccctggctcctcttgctccggcccagcgcctcgctctcgggcggaccgggcaagcgcggctgccagcgcgcagccggtcggtgcggtgcctggcggcgctgagcccagagatgcgggagacgctggacaaggtcgtgggggtccagcaagggtgcgctattcatgaagggcaccaaggactttccgcagtgcggcttctccacaccgtcgtgcagatcctgcgctcgctcgacgtgcccttcgagacgctcgacgtgctcgctaacgagggcgctccggcaggggctcaaggagtactccagctggccccaccttcccgcagctctacatcgacggcgagttctttcggcgatgtgacatccccgtccaggcatacaagagtggagaactgcaggaaactctagaaaaagcaatgtgttcgtaaaaaaaaaatggacaataggccgatggcctacaattaatccaaatgttaaagtatttgctgaacaattccaggctggccac

SEQ ID NO: 43880 - DNA, 770 bp, Zea mays
  misc_feature: Ceres CLONE 1445153-F
  misc_feature: Encodes the peptide sequence at SEQ ID NO. 43881
  misc_feature (482)..(482): n is a, c, t, g, unknown, or other
  misc_feature (483)..(483): n is a, c, t, g, unknown, or other
ctggagctccccgcggtggcggccgctctagaactagtggatcccccgggctgcaggaattcgcacgagaccattacctagaacatcctaatcgaaaagcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaggggcgaggtcgctgaccgtgtcgtctccgtcgtcaagaacttccagaaggttgaaccctcaaaggtgacacctagtgctcattttcagaaggaccttggacttgatagcttggacactgtggagatcgtgatggcgtttgaggaagaattttcctttgagattcctgacaacgatgcagagaagattgactccatcaagacagcggnntgatttcattgcttcgcatcctcaagcaaaaataagaggatttctttttttttccgatttcaaagtgtgttttgcacttttgcattcagaaacttatgcgacacgggactagttttatctagcttgccccagaagataggaagtcatttctttacctttcggagtcgcggtgtaccaaacgattggttgggttcttggaaccccattggaacgctaattccaaaaatccttttggaaaaaaaaaaaaaaaaccaaaaaaaaaaaaaaaaggcttaccgatcccgccc

SEQ ID NO: 43881 - protein, 116 aa, Zea mays
  misc_feature: Ceres CLONE 1445153-F
  misc_feature (53)..(118): Pfam Name: PP-binding Pfam Description: Phosphopantetheine attachment site
MAMAAARRALLAHLRVPVVHPAAAAATIPAAGRLLSSTTETKGSFLDRGEVADRVVSVVKNFQKVEPSKVTPSAHFQKDLGLDSLDTVEIVMAFEEEFSFEIPDNDAEKIDSIKTA

SEQ ID NO: 43882 - DNA, 766 bp, Zea mays
  misc_feature: Ceres CLONE 1445156-F
  misc_feature: Encodes the peptide sequence at SEQ ID NO. 43883
  misc_feature (367)..(367): n is a, c, t, g, unknown, or other
  misc_feature (372)..(372): n is a, c, t, g, unknown, or other
aagctggagctccccgcggtggcggccgctctagaactagtggatcccccgggctgcaggaattcgcacgagaccattacctagaacatcctaatcgaaaacctgatcatggaagcacagaggtggtggagagtcaccttattggcttgtgcaaggaggtccttgaggtatacttgagcacagcaagaccttctcagccttccagtggcacacagccgctaggccattggcttatccctgttggttcatcgaagcgaagggaacttgcggcaagagcacctcttgttgtctcaaccctgcaagctatcagcggactaggtgactcagctttcgagaagaaccttcgccagttctttcctcttctcgntgggntcataagctgcgagcatggttctagtgaagtacaggtgcccccccaccatatgttcagaacttgggtttgcccactccgtcctcagtcctgctgatgctgaacatcatgttatacatagaagtatacctcccattgtggtccctccttcctccattatgttatgttaatcttttaacccctgggaattcatattgttgggctgaactgaatcatgcaaaccaaattttctttgacgttaaaaaaaaaaaaaaaaaaagttatccaatcccgcccgacctcgagggggggccccggaccccaatttccccctaaaggggagtcgatttagccgcccctccctggggccttctttttaacaacctcctgaactgggaaaaaccccggctttctccc

SEQ ID NO: 43883 - protein, 154 aa, Zea mays
  misc_feature: Ceres CLONE 1445156-F
  misc_feature (122)..(122): Xaa is any aa, unknown, or other
  misc_feature (124)..(124): Xaa is any aa, unknown, or other
AGAPRGGGRSRTSGSPGLQEFARDHYLEHPNRKPDHGSTEVVESHLIGLCKEVLEVYLSTARPSQPSSGTQPLGHWLIPVGSSKRRELAARAPLVVSTLQAISGLGDSAFEKNLRQFFPLLXGXISCEHGSSEVQVPPHHMFRTWVCPLRPQSC

SEQ ID NO: 43884 - DNA, 759 bp, Zea mays
  misc_feature: Ceres CLONE 1445158-F
  misc_feature: Encodes the peptide sequence at SEQ ID NO. 43885
  misc_feature (403)..(403): n is a, c, t, g, unknown, or other
  misc_feature (476)..(476): n is a, c, t, g, unknown, or other
  misc_feature (590)..(590): n is a, c, t, g, unknown, or other
ctggagctccccgcggtggcggccgctctagaactagtggatcccccgggctgcaggaattcgcacgagaccattacctagaacatcctaatcgaaaagtataataaaacctcaaatcgtctctctcccgtcctcccctccaccgccgcagccgccgccgtacctcctcctcccgcgcagtagccaccgccaccgccggaaatgaagaccatcctggccacggagacgatggacatccccgagggggtcacggtcacggtggcggccaagctggtgacggtggaggggccgcgcggtaagctcacccgcaactttcagcacctcaacctcgacttccagctgcaggacggcggtcgcaagctcaaggtcgacgcctggtttggcacccgccgaaccatggccngcatccccacccccatctcccacgtccagaacctcatcgcaggcgtcaccaagggttttccgctacagatgcngttcgtctacgctcactttccccatcacgcctccatcaccaacgccaaactcgccattgagatcagaaacttcctcggggagaagaaggtcaggaaggtttaatatgctggaangtgtgaccttcttgctttcagagaagtcaaggatgagctttgttcttgaaggcatgatgttaagcttatctctccctcgctgctctcataaaccaaaaatgcctgtcaagaagaaggattccgggaagttctggacggtttctatgtgagtgaaaaggcccccttcttt

SEQ ID NO: 43885 - protein, 125 aa, Zea mays
  misc_feature: Ceres CLONE 1445158-F
  misc_feature (12)..(86): Pfam Name: Ribosomal_L6 Pfam Description: Ribosomal protein L6
  misc_feature (68)..(68): Xaa is any aa, unknown, or other
  misc_feature (92)..(92): Xaa is any aa, unknown, or other
MKTILATETMDIPEGVTVTVAAKLVTVEGPRGKLTRNFQHLNLDFQLQDGGRKLKVDAWFGTRRTMAXIPTPISHVQNLIAGVTKGFPLQMXFVYAHFPHHASITNAKLAIEIRNFLGEKKVRKV

SEQ ID NO: 43886 - DNA, 784 bp, Zea mays
  misc_feature: Ceres CLONE 1445161-F
  misc_feature: Encodes the peptide sequence at SEQ ID NO. 43887
aagctggagctccccgcggtggcggccgctctatactagtggatcccccgggctgcaggaattcgcacgagaccattacctagaacatcctaatcgaaaagagtcccttgccccacccaagtacccaactcgagcggtggagccttgcgtgtgtctaaaaatagcgcccgaatcgcggcggcagccacatcgagtaatttatcgagtcaggtgagagggcggagcagatctcgccggccggggccatgggtgctgccggcgcgatccggcgggcggcggcgtcggtggtcgacagggcgtgcgcggggacgcggggcttccgccgcgcgctggcgcggttcgcgccccggccgtcggcgttcggtcctgccgcaaacccagaggccgcggcggtgcgcgccttgggaaaccccccccaccttccggttccactacgccgtcctgcagtgggtgctgctgctggcgtccctggcgccgcggcaccgggcctccgtcatcttcctcaatggcggagcccaagggcctcctcaatctacgggggcctcctaaaaccgttccccaactcggcgctgctccggaagctcctcgaaccgccgccttctggccgccgtgtttctccgcgcttgtggtccccgaacatcctctaccgggggcgcccgtccacaaccctcttggcccgcgctcggccggggagtgtccccgatatacctcctccacgcgttcctttccgcgttcccgcaagattttcaagggccccttctccggaaatccggtagtcggggcc

SEQ ID NO: 43887 - protein, 176 aa, Zea mays
  misc_feature: Ceres CLONE 1445161-F
MGAAGAIRRAAASVVDRACAGTRGFRRALARFAPRPSAFGPAANPEAAAVRALGNPPHLPVPLRRPAVGAAAGVPGAAAPGLRHLPQWRSPRASSIYGGLLKPFPNSALLRKLLEPPPSGRRVSPRLWSPNILYRGRPSTTLLARARPGSVPDIPPPRVPFRVPARFSRAPSPEIR

SEQ ID NO: 43888 - DNA, 765 bp, Zea mays
  misc_feature: Ceres CLONE 1445164-F
  misc_feature: Encodes the peptide sequence at SEQ ID NO. 43889
  misc_feature (337)..(337): n is a, c, t, g, unknown, or other
ggagctccccgcggtggcggccgctctataactagtggatcccccgggctgcaggaattcgcacgagaccattacctagaacatcctaatcgaaaactattctcccgtttgcgacgactgggtgggctacgccgccgccgctgccgctgccgctgctctacggtgctgagtcctttgccgatttcttccccggcgaagagcgccaccagtagatccgcccctgctgaaaacgcactcgatggcgtccgcgacggggggctcctcctcggagatggcggtggaccacgcgacggggctgggcaccgtggagaagccgcggtttgatgctctgatgccnagtgagatgagcggggcggagaccccagttccggaagtgaccgtgccgcagcaccggttcgcgccgctcacccacgctggatggaatctacacaccgtttaccagcatatgaagatcgacttacccatgaatcctcaggcgaggagggtggagctaaagacaagcaagacccaccgatgtcaccaaccttcaaaatggggcgaacttggcatgcttttatgcccgggtccaccttggttaagcgcccccccctcgccgccctctgagaacccggatgggggattcccttgaaatacagggacgtgaaaacctttgaggggggggcatctcttgcccgccctttttggcccctttttcgggggaaaaggggggaaaacccacccccccccttttggaaattccccccggggccccctttttgttttttt

SEQ ID NO: 43889 - protein, 129 aa, Zea mays
  misc_feature: Ceres CLONE 1445164-F
MASATGGSSSEMAVDHATGLGTVEKPRFDALMPSEMSGAETPVPEVTVPQHRFAPLTHAGWNLHTVYQHMKIDLPMNPQARRVELKTSKTHRCHQPSKWGELGMLLCPGPPWLSAPPSPPSENPDGGFP

SEQ ID NO: 43890 - DNA, 704 bp, Zea mays
  misc_feature: Ceres CLONE 1445165-F
  misc_feature: Encodes the peptide sequence at SEQ ID NO. 43891
agttccccgagaacattaccgagaacatcctaatcgaaaaattctcatcacacctctatcttagtttgcagaaagctagaagacacaagaacatggcgtctaaccgactcctcgtggtagtaactctcctgttcgccgccgttttccttgccgtctcaagagcagctaacgacgaccaagctccaaccgaggaaggacgacggctgctcagaacaaagccgacgtgcatgactactgtggccgctgcggccgctggcgaggtgggggaggctaccccggccgaggataaccaggagaaggcgggtaatttggtggaaatcgcagctggtaatgcagatgagggtgttgcaaccggcggcactatggaggctgacggtgctgctctcgagccgacgaagtaccggagcgcatgtaccggcaagattccatagaagttcacaagtgaagcagatccacacatctatctacaaagatgcatggaccaagactctcatcgtatctaattaataagaactacgtccaatgctgtccacaatatgggcctaccccaactatactaaacatcctcagcagaacatctggatttgatttcaataaaaaaatgcacctatgtttgtgaagtgtaatgtaccactctgtcttaaatacttgcgtggagatacgactcactaaattctacgagcttccagaggtcatctctggga

SEQ ID NO: 43891 - protein, 112 aa, Zea mays
  misc_feature: Ceres CLONE 1445165-F
MASNRLLVVVTLLFAAVFLAVSRAANDDQAPTEEGRRLLRTKPTCMTTVAAAAAGEVGEATPAEDNQEKAGNLVEIAAGNADEGVATGGTMEADGAALEPTKYRSACTGKIP

SEQ ID NO: 43892 - DNA, 754 bp, Zea mays
  misc_feature: Ceres CLONE 1445169-F
  misc_feature: Encodes the peptide sequence at SEQ ID NO. 43893
  misc_feature (655)..(655): n is a, c, t, g, unknown, or other
  misc_feature (720)..(720): n is a, c, t, g, unknown, or other
tggagctccccgcggtggcggccgctctagaactagtggatcccccgggctgcaggaattcgcacgagaccattacctagaacatcctaatcgaaaacttcctatcataccggcgggcggcgcggggcagctaatcggcaatccggcttcgcctcgtcgcagtccaatccgcactcaccgccgccctcccgcccctcacctgcccgcggcagtgtcggagtaaaccctaccggacctatcgtcacgcgactgcgggagttgcttgcttcttctgccgctctctcgctccgtcccttccgcccatggagacctcgctgcgcttgcgcagtggcggcggcctccgcatccacgccaaggagaagctgcccctcggccacagctcgctgctgcaggctcatgcggagctcgacctccacacaagccccgccggagttactaccccgagttatctcgctctctttgtcaggcacttctactcgcagctatcagccaatctcggagctggcgtccagttgcacaacggcgatgacctcgcctacagttttcgcgccaagaaggccgtcctggtcaaaccagataatgggttcctaggtctgaacttaaagggcgcctacttaccgataaagagttgaaccgacgagaacactggatccgntgaaactgcatggacatacttgacttgaacagggcccagacgtaaggctcaaagtggttacgaantgggtgacaagggcctatttcagctcagagagac

SEQ ID NO: 43893 - protein, 109 aa, Zea mays
  misc_feature: Ceres CLONE 1445169-F
METSLRLRSGGGLRIHAKEKLPLGHSSLLQAHAELDLHTSPAGVTTPSYLALFVRHFYSQLSANLGAGVQLHNGDDLAYSFRAKKAVLVKPDNGFLGLNLKGAYLPIKS

SEQ ID NO: 43894 - DNA, 776 bp, Zea mays
  misc_feature: Ceres CLONE 1445174-F
  misc_feature: Encodes the peptide sequence at SEQ ID NO. 43895
  misc_feature (460)..(460): n is a, c, t, g, unknown, or other
gctggagctccccgcggtggcggccgctctagaactagtggatcccccgggctgcaggaattcgcacgagaccattacctagaacatcctaatcgaaaaacaaggagaaacaaattcttctattttagctctagctcgctcgccatcccctgcccggctgctgcccccaacggaacgacggccagaggaagctaccagagtcgatcgatcgatcgagatcgagagagagagagagagagcatggctggcaggagtttcctgattcggtcccccaagggagaggagtccaacgccgccgtcagagaagctgtactgctgggagcaaagaacgccgcaatagctggtactgtggttgcagttcccacgttggttggctgccgtgtccttccctgggccaaggcgaatctcaactacactgcacaagcactcattatatctgcagcctgtaatgctggcctcntcatcactgctgaccaaaacattctacggaacgcacgacaaaccccatccgggaacttgacaagtcacttgatgcaaagatgttactgaacctgaaaaggtttcttgttcccccggccgatgaaagggtgtctattgcccatatgcaatggcaccatttctcttcgtggaaaataaattttttgggtgtttggccaatccaaaccaaaggtgggcctgaaaaggctttgtcaaactggagggcccaactttttggccccgttttcctcccaaaaaaaaaaaaaaaaaaagtttaccattcccccccccctcgcggg

SEQ ID NO: 43895 - protein, 102 aa, Zea mays
  misc_feature: Ceres CLONE 1445174-F
  misc_feature (11)..(89): Pfam Name: ENOD93 Pfam Description: Early nodulin 93 ENOD93 protein
  misc_feature (74)..(74): Xaa is any aa, unknown, or other
MAGRSFLIRSPKGEESNAAVREAVLLGAKNAAIAGTVVAVPTLVGCRVLPWAKANLNYTAQALIISAACNAGLXITADQNILRNARQTPSGNLTSHLMQRCY

SEQ ID NO: 43896 - DNA, 736 bp, Zea mays
  misc_feature: Ceres CLONE 1445178-F
  misc_feature: Encodes the peptide sequence at SEQ ID NO. 43897
  misc_feature (527)..(527): n is a, c, t, g, unknown, or other
  misc_feature (596)..(596): n is a, c, t, g, unknown, or other
  misc_feature (597)..(597): n is a, c, t, g, unknown, or other
  misc_feature (645)..(645): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaaaatgttggtgattctcgtgctgttatttcaaaagctggcaaagctatggcactttcagaagatcacaaacctaacaggattgatgagcgaaagagaatagaaaatgctggtggtattgtcatttgggctggtacttggagggtaggtggtgtattggcgatgtctcgtgcatttggcaatcgtttactgaagccatatgtggtggcggaacctgaaattcaggaagaacagttcagtgatgagctggaatgcctggttctcgctagtgacgggctttgggatgttgtggaaaatgaggaagccgtttcccttggcaaatcagaggacacgccagagtctgcagctcggaaattgacagagatcgcttattctcgtggcagcgctgacaatatcacgtgtatcgtggttcaattcaccatgacaaanccggatgagccatgtggcggccatttcagttgtaccctgcttcagggctatatatcctgcaggccgggnntgtggggctctctcagattatcgctcttgtagcacttccaagactcgnccccatgatctttttgtgcctgaggaaactttgntcccacagtggaatagatatttcatgggttaattctaataaactatgttacaaaaaa

SEQ ID NO: 43897 - protein, 208 aa, Zea mays
  misc_feature: Ceres CLONE 1445178-F
  misc_feature (1)..(164): Pfam Name: PP2C Pfam Description: Protein phosphatase 2C
  misc_feature: SWISSPROT Homolog: EC 3.1.3.16 Phosphoprotein phosphatase
  misc_feature (175)..(175): Xaa is any aa, unknown, or other
  misc_feature (199)..(199): Xaa is any aa, unknown, or other
AGAPRGGGRSRTSGSPGLQEFARDHYLEHPNRKNVGDSRAVISKAGKAMALSEDHKPNRIDERKRIENAGGIVIWAGTWRVGGVLAMSRAFGNRLLKPYVVAEPEIQEEQFSDELECLVLASDGLWDVVENEEAVSLGKSEDTPESAARKLTEIAYSRGSADNITCIVVQFTMTXPDEPCGGHFSCTLLQGYISCRPGXWGSLRLSLL

SEQ ID NO: 43898 - DNA, 758 bp, Zea mays
  misc_feature: Ceres CLONE 1445180-F
  misc_feature: Translation starting site: 346
  misc_feature (397)..(397): n is a, c, t, g, unknown, or other
  misc_feature (554)..(554): n is a, c, t, g, unknown, or other
  misc_feature (557)..(557): n is a, c, t, g, unknown, or other
aaagctggagctccccgcggtggcggccgctctagaactagtggatcccccgggctgcaggaattcgcacgagaccattacctagaacatcctaatcgaaaaaacggtctccgtcgtcccgtccgcgtgataaagcgccggcgcctcttctcgcgtggcctcccgaaggttctaggctcgattgaacaaattggagcggcactacactcctccacgcctccacctccagcctcccactgatctggcctctctcgagttaatcctagatcaatatgagaaggggctacagttacagtccttcaccaccaaggggctacaggagaagggcgcgcagtccaagtcctcatgatcattatggtggtcgtggtagggatctcccaaccagtcttctggtcangaatctccgtcgggactgcaggccaaaagaccctcgtcgcccatttggacagttttgtcgagttaaagatatatatcttccaagagatttatacactggggatccccgagggtttgggtttgtccagtattatgatcctgctgatgctgctgatgcnaantactatatggatgggcaggtagttcttggtaggcaaataacagttgtttttgcagagagaacagaaagaagccttcagagatgagaactaggggacagaatcgggggtcattcttatgatgacagaaggtatctcgctctagggccctccgttataaaggggcccgctctccttccggagccaaagctactcgaggccccc

SEQ ID NO: 43899 - DNA, 948 bp, Zea mays
  misc_feature: Ceres CLONE 1445185
  misc_feature: Encodes the peptide sequence at SEQ ID NO. 43900
accattgcagcaccttgccttctcttccccatttcaagagaaaaaagaagcttcacaacttcagcttccattcaaagacatggcttgccaccttaggtccgcgagtgtgccttccagccctcgttccaacaaagccaacatcgatgaacagctgcagagcctgaaggcaaccatctcctcaccttcagtggccattgaaaccatggttgacggtctcaacaagatggtgggcatctacagctgcattgacgagctcacatccttggccggcaaccaacgtcagcagaggaaggcagtggaggaggagctcgatcgctcccttgtcctgcttgacctctgcaacgccatgcaagagaactttgcagagctcagggtcagcgtccaggagatgcagctggctctcaagagaggagacgacgtgtctcttcaggccaaggttcagtcttacgctcgcttggccaagaaggcacagaagcagttcaagaagatcagcagcaaggctgcctctgacattgaaggatgcaagatagtcaggctgttggctgaagcaagggagattgctgtgtcgatgctcgaatcgacatcacatctcctctcgaagaagatcacgttgcccagcgctagcaagtggtctcttgtgtccaaggcatttgagaagaagaaattcgtgtgcaaggaggagcaattgcaggcgttggagttggacattgttgatcttgagagcggagttgcgactttgttcaggacgctgatccagagcagagtctctcttctgaacactctcactttgtagatagatcatacaacaactctagtgcctgcgattagcatccgtgttttagaggatctgctgatcatcgaaacaattttgatgtatatatatgagagtgtacagaaatatactcaactggaaatcgaagttttgggtctaaaaaaaaaaaaaaaaaa

SEQ ID NO: 43900 - protein, 237 aa, Zea mays
  misc_feature: Ceres CLONE 1445185
  misc_feature (44)..(234): Pfam Name: DUF241 Pfam Description: Arabidopsis protein of unknown function
MACHLRSASVPSSPRSNKANIDEQLQSLKATISSPSVAIETMVDGLNKMVGIYSCIDELTSLAGNQRQQRKAVEEELDRSLVLLDLCNAMQENFAELRVSVQEMQLALKRGDDVSLQAKVQSYARLAKKAQKQFKKISSKAASDIEGCKIVRLLAEAREIAVSMLESTSHLLSKKITLPSASKWSLVSKAFEKKKFVCKEEQLQALELDIVDLESGVATLFRTLIQSRVSLLNTLTL

SEQ ID NO: 43901 - DNA, 785 bp, Zea mays
  misc_feature: Ceres CLONE 1445187-F
  misc_feature: Encodes the peptide sequence at SEQ ID NO. 43902
  misc_feature (246)..(246): n is a, c, t, g, unknown, or other
  misc_feature (271)..(271): n is a, c, t, g, unknown, or other
  misc_feature (403)..(403): n is a, c, t, g, unknown, or other
  misc_feature (405)..(405): n is a, c, t, g, unknown, or other
  misc_feature (410)..(410): n is a, c, t, g, unknown, or other
  misc_feature (411)..(411): n is a, c, t, g, unknown, or other
  misc_feature (659)..(659): n is a, c, t, g, unknown, or other
caaagctggagctccccgcggtggcggccgctctagaactagtggatcccccgggctgcaggaattcgcacgagaccattacctagaacatcctaatcgaaaaaaaagtctgcgtacagtccgccgcggctaggcgaccgcatccgcatctccccaacgtcttctcgccggtcgcgcacgggcaaagcagcgatggctacagcgacggcagttggcggacccgacagggtggagactgcggcgtcntccgcggcggcagtgctgggcgtcnccgttgcctcgcagaggttgctaggcctgctcgctcttgcggttcaaactgtaatggttggatcaaaaatatttaataaagatcggcggggaaaattattatttattaccccccaagaggggggggggggancnccccnnaaaaaaacccccccccttttggagggtgatgaatgatgaatgagaaggaaaaaatggacgatgaaggccgccccaccaccaccaagcacgccgaggaagaaatttctctggagaaaaaaaaagggggggacagccccatgaagaacgaaatgtatcctgaggctaacgggagaaaacggacaagaccgagccgcttagttagtttcaaacaaacaccaccacgacgaccgccaccccacaccaccgcnagtattcaacaccacgacgcaggcggaccatgaaccaagaagacaaaaacaccctcaccgaactgcatccctctttcctgccctcctagcgtaccacttcgcattattgtcgcgctaatgatgtgc

SEQ ID NO: 43902 - protein, 84 aa, Zea mays
  misc_feature: Ceres CLONE 1445187-F
  misc_feature (27)..(27): Xaa is any aa, unknown, or other
  misc_feature (71)..(71): Xaa is any aa, unknown, or other
  misc_feature (73)..(73): Xaa is any aa, unknown, or other
MATATAVGGPDRVETAASSAAAVLGVXVASQRLLGLLALAVQTVMVGSKIFNKDRRGKLLFITPQEGGGGXPXKKTPPLLEGDE

SEQ ID NO: 43903 - DNA, 735 bp, Zea mays
  misc_feature: Ceres CLONE 1445189-F
  misc_feature: Encodes the peptide sequence at SEQ ID NO. 43904
  misc_feature (508)..(508): n is a, c, t, g, unknown, or other
  misc_feature (527)..(527): n is a, c, t, g, unknown, or other
  misc_feature (540)..(540): n is a, c, t, g, unknown, or other
  misc_feature (673)..(673): n is a, c, t, g, unknown, or other
  misc_feature (676)..(676): n is a, c, t, g, unknown, or other
  misc_feature (695)..(695): n is a, c, t, g, unknown, or other
ggagctccccgcggtggcggccgctctagaactagtggatcccccgggctgcaggaattcgcacgagaccattacctagaacatcctaatcgaaaaatctattcgatcgacaagccgtgtgttgagtcgtttaaaaacaaccagagaaacacatggccaacatccccaagtgtcgttggacccaaaaccccttaatccttctatcttacgctgctgtagtgctggcagtactttctactctgacactgccactgcttgcttcatcagatctagatgctgtaaatttcaagaaattctgccttgttttgaagaaccaatacctatgtctaggtcaaaatgccgaaccacgcgcgaggaacgctatggcgctcctgcttaacagtgagggtatatctgggccacttcccacggccttgggcgccttctccaacttgagttacctcgccctcgccaacaacaagctcaccgggccaatccccacatcagtcgggcacctgcaccactcccntcgcgagattgtcctcctncacaaccagctcntcggctgcctccccggcgagctagggatgctcagcaaggcggtcgtcatcgacgccggcatgaatcagctcaccggccaaatccctccgctcttttccttgctcagcagagtcgagcagctcaacctggcggnaancggctctatggccatgttnccgacgctctcctgcagctcgcggggccggctggccccct

SEQ ID NO: 43904 - protein, 194 aa, Zea mays
  misc_feature: Ceres CLONE 1445189-F
  misc_feature: SWISSPROT Homolog: EC 2.7.11.1 Non-specific serine/threonine protein kinase
  misc_feature (119)..(119): Xaa is any aa, unknown, or other
  misc_feature (130)..(130): Xaa is any aa, unknown, or other
  misc_feature (174)..(174): Xaa is any aa, unknown, or other
  misc_feature (175)..(175): Xaa is any aa, unknown, or other
  misc_feature (181)..(181): Xaa is any aa, unknown, or other
MANIPKCRWTQNPLILLSYAAVVLAVLSTLTLPLLASSDLDAVNFKKFCLVLKNQYLCLGQNAEPRARNAMALLLNSEGISGPLPTALGAFSNLSYLALANNKLTGPIPTSVGHLHHSXREIVLLHNQLXGCLPGELGMLSKAVVIDAGMNQLTGQIPPLFSLLSRVEQLNLAXXGSMAMXPTLSCSSRGRLAP

SEQ ID NO: 43905 - DNA, 725 bp, Zea mays
  misc_feature: Ceres CLONE 1445218-F
  misc_feature: Encodes the peptide sequence at SEQ ID NO. 43906
ggagctccccgcggtggcggccgctctagaactagtggatcccccgggctgcaggaattcgcacgagaccattacctagaacatcctaatcgaaaaatgcccagttctccctgtccaccggccgccgcacttgctcgaccgccgccgccgccgtgcgcttaatcttacccctgtctgtctcctcatccagtgcaaggaacgcccaccgctgcctgtgtcgtttggtcaccggagatggatggggatgaggagaacgtcgggccgttccgccggactagcgcgcgcacgcgccgcatggccacgcgcatggcgtccgcgctcgccagctcggacaatcgcgcccaggtaacggctgcattagctcgccttgaagctcttgagagcgataatggtggggtcgaggtggtagatcttaatgatgatgagtacggatccacggatgaagaagaccctgttctcatgcaaaaaaagcagtccaagatcatgaaacgtaaaacaaggcaagggaaagctttggagaagagggcagcaagatcactcatggatgtgctacaagaagcaaatttggagtccgttcctcctcatgtgccaacatattcaagggctgctgtgggtccaccgagcacttcatctcgacgccactactgctcagtttgcggtagctctgcaacctacacatgcgtgaggtgtgggacacggttctgttcatgccgctgtcaagtcat

SEQ ID NO: 43906 - protein, 163 aa, Zea mays
  misc_feature: Ceres CLONE 1445218-F
  misc_feature (134)..(163): Pfam Name: zf-HIT Pfam Description: HIT zinc finger
MDGDEENVGPFRRTSARTRRMATRMASALASSDNRAQVTAALARLEALESDNGGVEVVDLNDDEYGSTDEEDPVLMQKKQSKIMKRKTRQGKALEKRAARSLMDVLQEANLESVPPHVPTYSRAAVGPPSTSSRRHYCSVCGSSATYTCVRCGTRFCSCRCQV

SEQ ID NO: 43907 - DNA, 727 bp, Zea mays
  misc_feature: Ceres CLONE 1445225-F
  misc_feature: Encodes the peptide sequence at SEQ ID NO. 43908
  misc_feature (468)..(468): n is a, c, t, g, unknown, or other
  misc_feature (469)..(469): n is a, c, t, g, unknown, or other
  misc_feature (562)..(562): n is a, c, t, g, unknown, or other
  misc_feature (578)..(578): n is a, c, t, g, unknown, or other
  misc_feature (620)..(620): n is a, c, t, g, unknown, or other
ctggagctccccgcggtggcggccgctctagaactagtggatcccccgggctgcaggaattcgcacgagaccattacctagaacatcctaatcgaaaaccgaaacgctagacctatcctcttcttcccgtggcacggccaattttgcttccggctgccgctcttctccgccgccgccccgatccccttcctccccaagcccttcaactatccactcccgcgtccccggagaagcggcgagatgtacggcatcctgacctccccctgccctcgagccccgcttctccgcgctctcccgagcccatccgcccgcgcattccccagaacactagccttccccgcgaggcccctcccccgcggtctccgcctgacccctccgcacgccgccgcggaggcatcggcggcagccacggcgttgggcgggcttctggcgtcgccgctctcgactctggaggccgccctgcggggnnctcaactcgcgccccttcgcgcccccgtggcggcggcgatgtcggcggcccgtgcgtggctgggagtgtaccgggaagtgctgcttcgtcgcntgctgctctcctgggntccccacatcccctgggaacgccagccttttctcgccctggncgacctctgggaccctttcctcgccttggggcgggaggcatgccccccggggtcggggcaaagttcaccccacccccctgggggggattcgggcaattggaaccccc

SEQ ID NO: 43908 - protein, 73 aa, Zea mays
  misc_feature: Ceres CLONE 1445225-F
  misc_feature (19)..(19): Xaa is any aa, unknown, or other
  misc_feature (24)..(24): Xaa is any aa, unknown, or other
  misc_feature (38)..(38): Xaa is any aa, unknown, or other
MSAARAWLGVYREVLLRRXLLSWXPHIPWERQPFLALXDLWDPFLALGREACPPGSGQSSPHPPGGDSGNWNP

SEQ ID NO: 43909 - DNA, 667 bp, Zea mays
  misc_feature: Ceres CLONE 1445236-F
  misc_feature: Translation starting site: 207
  misc_feature: Pfam Name: PBP Pfam Description: Phosphatidylethanolamine-binding protein
  misc_feature (503)..(503): n is a, c, t, g, unknown, or other
ctggagctccccgcggtggcggccgctctagaactagtggatcccccgggctgcaggaattcgcacgagaccattacctagaacatcctaatcgaaaaacagcaagctcgacggaactgactagaactagtacgtagatccaacactcgggacgaaattaaaagagacgacgcacatcaaccagcaggcatcgcacggtcaccaccatggcggcgcaggagggcggcatgaggctggtgtcgcacccgatcgcggcgcacgacgggcggctgccgcggcagtacacggcggaggggcagggcgccaagaaggacatgtcgccgccgctggagtggtacggcgtgcccgagggcgcgcggtcgctggcgctgctggtgcaggacatcgacgccgaccccagcgtgccgtggacgcactgggtggtggccaacatcccgcccgccaccaggggcctccccgaggggttctccggcgcccggggcggggggcccgggggcggcccnctaccagctcggcggcctgcaggagggggtcaacgactggaagcagcccggctggcgcgggcccgtgccgccctcccacggccaccgcatccagttcaagctctacgcgctcgacgacgaggtgcacctcggcaacaaggtgaccagggataagctcatggagg

SEQ ID NO: 43910 - DNA, 729 bp, Zea mays
  misc_feature: Ceres CLONE 1445238-F
  misc_feature: Translation starting site: 102
ggagctccccgcggtggcggccgctctagaactagtggatcccccgggctgcaggaattcgcacgagaccattacctagaacatcctaatcgaaaagcagtatggctcgccgactctgccgtctccctcgcctctttcccctcgtctcgtctgcatccgcctccgccgccccaagacctcatcacctccccttcgccgtgaaccctaaccccgcgcccctcgccccctccttctcgtcgtcatcgccgcccgcttttccgggcccccatcgcctcttctcttccacgagtggttcaagcatggtggtcgtgggctccgcggactccttcacagcatcttttccagggtgcagatgaaaagctaccagctgtcttttactacacggcggtgtgttgtggaacatgtagggcgatcgcacctttagtaatcaaactgagcagcccgtatcccaagatcccggtgaccaagttgactttgaattggaaggactggggaaacaacctccgggatctaaaaatatgttcaggggccaacttcccctttttttccaagggggaaaaaaattattgaaactctgggggggcaaggcaaaaaaaatttaattttccttggaaagccccccacaacccccctaaaaatttttaaaaaaaaaccctccaccctcaccaaaggagggggtttaacccccccctaggaaaaggggggccaaatttgggaccggggttgttt

SEQ ID NO: 43911 - DNA, 613 bp, Zea mays
  misc_feature: Ceres CLONE 1445240-F
  misc_feature: Encodes the peptide sequence at SEQ ID NO. 43912
tggagctccccgcggtggcggccgctctagaactagtggatcccccgggctgcaggaattcgcacgagaccattacctagaacatcctaatcgaaaaagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgcggcggcggcgggcgcggaggcgccgcgcccgagccgctacgagtcgcagaagcggcgggactggcacacgttcgggcagtacctgcgcaaccaccggccgccgctggagctggcgcggtgcagcggcgcgcacgtgctcgagttcctgcgctacctcgaccagttcggcaagaccaaggtccacgcgcccggggtgcccttcctccgggcaccccgtcgccgccccgggccgggccccgggccccccttcgggagggcctgggggaaac

SEQ ID NO: 43912 - protein, 103 aa, Zea mays
  misc_feature: Ceres CLONE 1445240-F
  misc_feature (8)..(103): Pfam Name: DUF640 Pfam Description: Protein of unknown function (DUF640)
MQVGGGAADSPGAAAAAGAEAPRPSRYESQKRRDWHTFGQYLRNHRPPLELARCSGAHVLEFLRYLDQFGKTKVHAPGVPFLRAPRRRPGPGPGPPFGRAWGK

SEQ ID NO: 43913 - DNA, 745 bp, Zea mays
  misc_feature: Ceres CLONE 1445249-F
  misc_feature: Encodes the peptide sequence at SEQ ID NO. 43914
  misc_feature (229)..(229): n is a, c, t, g, unknown, or other
  misc_feature (230)..(230): n is a, c, t, g, unknown, or other
  misc_feature (254)..(254): n is a, c, t, g, unknown, or other
  misc_feature (269)..(269): n is a, c, t, g, unknown, or other
  misc_feature (279)..(279): n is a, c, t, g, unknown, or other
  misc_feature (288)..(288): n is a, c, t, g, unknown, or other
  misc_feature (290)..(290): n is a, c, t, g, unknown, or other
  misc_feature (291)..(291): n is a, c, t, g, unknown, or other
  misc_feature (308)..(308): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (718)..(718): n is a, c, t, g, unknown, or other
  misc_feature (719)..(719): n is a, c, t, g, unknown, or other
tggagctccccgcggtggcggccgctctagaactagtggatcccccgggctgcaggaattcgcacgagaccattacctagaacatcctaatcgaaaaagcaatcagcaataatctcgccgtctcatcgcaaaacccagcgccccaaagcgaccccaccgaagcgtcccagcccgaccggaatggcgatggcaccgtgcgcacccgcctccgtctcctccttccccgccnngccagtgcgggccccttccgctgntccggcgcgcgccgncgcgaatcgngccactgcngnncgcgcggaaggtggcanggtgtgggcgccgctgctggggtggtccgggaaggcaactaccttgagccccggcccccggtgccggggggctcaagaatacaaacggccgcggcccccaaaattttggggggggtttaacaaaaaaaaacccccccatttcggggccgatggggaaaaagagtttctttccaaagcctggggaaatcccgcatttccctaggcctgccgcgtccccaaaaaaggggggggggggggcaaaatgtgcccccccaaaaaaaaaaaacccccccccctttttgaaagaagggccccccccttttttgggagggtgttttttatacccaccccattggccccccccnnnnaaaaaaaagggggggggaccttttttttttttaaaacccccccctccccccttttattttatnnggggggttctttttttttattttttt

SEQ ID NO: 43914 - protein, 109 aa, Zea mays
  misc_feature: Ceres CLONE 1445249-F
  misc_feature (17)..(17): Xaa is any aa, unknown, or other
  misc_feature (25)..(25): Xaa is any aa, unknown, or other
  misc_feature (30)..(30): Xaa is any aa, unknown, or other
  misc_feature (37)..(37): Xaa is any aa, unknown, or other
  misc_feature (43)..(43): Xaa is any aa, unknown, or other
MAMAPCAPASVSSFPAXPVRAPSAXPARAXANRATAXRAEGGXVWAPLLGWSGKATTLSPGPRCRGAQEYKRPRPPKFWGGFNKKKPPHFGADGEKEFLSKAWGNPAFP

SEQ ID NO: 43915 - DNA, 776 bp, Zea mays
  misc_feature: Ceres CLONE 1445251-F
  misc_feature: Encodes the peptide sequence at SEQ ID NO. 43916
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaaaattttctgattgctgggaaagacacaactgggaacacactctcctggttcttatacatgctttgtaagaatcctatagtgcaggataaagttgccctcgaaattaaggagtccgttgagtgggcggaggaagataacaacagagaagacttcactgcaagattgaatgacagagcaattgacaaaatgcactacctccacgctgcgatctctgagacactacggctgtatccagctgttccagtggatggtaagatggcagaagacgatgatgtactacctaatggctataaagtgataaaaggagatggcatcaactacatgatttatgcaatggggaggatgacatacctctggggtgaagatgctgaagatttcaggccagaaagatggattgcaaatggagtcttccagcaagagagtccttacaagtttgtgtccttcaatgcgggacctcgcacatgcttggggaaggattttgcatataggcagatgaagatcatggcagccaccctgatacacttcttcaggttcaaactgacagatgaatccaaggatgctacatacaaaacaatgtttacccttcacatggataaagggctcaagctgtatgcgtacccacgttcaacttgaatngaccaaacagtttttttaatcatttgttactgttggaga

SEQ ID NO: 43916 - protein, 243 aa, Zea mays
  misc_feature: Ceres CLONE 1445251-F
  misc_feature: SWISSPROT Homolog: EC 1.14.14.1 Unspecific monooxygenase
AGAPRGGGRSRTSGSPGLQEFARDHYLEHPNRKNFLIAGKDTTGNTLSWFLYMLCKNPIVQDKVALEIKESVEWAEEDNNREDFTARLNDRAIDKMHYLHAAISETLRLYPAVPVDGKMAEDDDVLPNGYKVIKGDGINYMIYAMGRMTYLWGEDAEDFRPERWIANGVFQQESPYKFVSFNAGPRTCLGKDFAYRQMKIMAATLIHFFRFKLTDESKDATYKTMFTLHMDKGLKLYAYPRST

SEQ ID NO: 43917 - DNA, 762 bp, Zea mays
  misc_feature: Ceres CLONE 1445259-F
  misc_feature: SWISSPROT Homolog: EC 2.4.1.12 Cellulose synthase (UDP-forming)
  misc_feature (321)..(321): n is a, c, t, g, unknown, or other
  misc_feature (388)..(388): n is a, c, t, g, unknown, or other
  misc_feature (422)..(422): n is a, c, t, g, unknown, or other
  misc_feature (468)..(468): n is a, c, t, g, unknown, or other
  misc_feature (481)..(481): n is a, c, t, g, unknown, or other
tggagctccccgcggtggcggccgctctagaactagtggatcccccgggctgcaggaattcgcacgagaccattacctagaacatcctaatcgaaaactatctcttctctctcactcccatctcttccaccaggacgaagccgccgccgcctctgccagcgcacccgcctcgcccccgctcgctgcggccgcctctgccagcgcacccgccccgcccccacccgccgcggccgccctcgcccgttgctctcgccgacgcggccacctccggccccgcccgccgtggccgccctgctgtacggctacaagaacaacaacctncagtggctggagcgcttcgcctacatcaacaccaccatctaccccttcgccttgctcccactgctcngctactgtaccctggcagccgtctgcctcctcancggaaaagtcatatgccgtcccaagaaatctgaagtgagaattggnaagaggaaatggntcttgaaaatttgaaaagggagaaaatttgctgaaccagtttagggattttccggaagcaaaccaagagcccttggttaggtcctcaacccgaagggaccaaaagtccgggattccccaaaacctttttccccggaaacctggaaaaaaactggttggagcaaaacccccaaaaaggggggaaaattttgggggggcgcccccccattttgggggggaaatagcggttggggaaacaaacaaaaaatattttttcccaaatggggttttttgtgaggggga

SEQ ID NO: 43918 - DNA, 789 bp, Zea mays
  misc_feature: Ceres CLONE 1445260-F
  misc_feature: Translation starting site: 224
  misc_feature (420)..(420): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (484)..(484): n is a, c, t, g, unknown, or other
  misc_feature (486)..(486): n is a, c, t, g, unknown, or other
  misc_feature (570)..(570): n is a, c, t, g, unknown, or other
  misc_feature (668)..(668): n is a, c, t, g, unknown, or other
aagctggagctccccgcggtggcggccgctctagaactagtggatcccccgggctgcaggaattcgcacgagaccattacctagaacatcctaatcgaaaagcattccctctgagcgccgccactccctgacatcgagaccggctgcccgaccccggtccggcgatccctctgcacccctttctttgcgctgccagccccaatctctcgcatccctgtcaaccatggcggcgtcagcaggcggaggcgcggtgcgcgcgctgtcccagaaggagcaggacatacagatgatgctcgcggccgacgtccacctcggcaccaagaactgcgatttccagatggagcggtatgtctttaagcgtcgcaccgacggcatcttcatcatcaacctgggcaagacatgggataagctccagctcgncgcgaggggtattgnnntgcatgagaacccacagacatcatcgtccagtcgacccgcccctacngncagcgtgctgtcctcaaggtcgcgcagtacactggcgcccatgccatcgctggaaggcaacaccctggtaccttcaccaatcanctccagacctctttcaaggaggctcgcctggttcatcctttataacccagggactgacccttcgccaatccagggaatctggctcgggggaacatccngaaaaatgtgcttttgggaaactgaaatcccccatgggggaggggaaattccggccccccccccccaacaagggggagaacaccttttgggcccctgtcccggtttttgccaaaaagatgt

SEQ ID NO: 43919 - DNA, 806 bp, Zea mays
  misc_feature: Ceres CLONE 1445274-F
  misc_feature (20)..(20): n is a, c, t, g, unknown, or other
  misc_feature (21)..(21): n is a, c, t, g, unknown, or other
  misc_feature (39)..(39): n is a, c, t, g, unknown, or other
  misc_feature (292)..(292): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (331)..(331): n is a, c, t, g, unknown, or other
  misc_feature (347)..(347): n is a, c, t, g, unknown, or other
  misc_feature (350)..(350): n is a, c, t, g, unknown, or other
  misc_feature (351)..(351): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (362)..(362): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (368)..(368): n is a, c, t, g, unknown, or other
  misc_feature (378)..(378): n is a, c, t, g, unknown, or other
  misc_feature (382)..(382): n is a, c, t, g, unknown, or other
  misc_feature (383)..(383): n is a, c, t, g, unknown, or other
  misc_feature (457)..(457): n is a, c, t, g, unknown, or other
  misc_feature (458)..(458): n is a, c, t, g, unknown, or other
  misc_feature (499)..(499): n is a, c, t, g, unknown, or other
  misc_feature (510)..(510): n is a, c, t, g, unknown, or other
  misc_feature (518)..(518): n is a, c, t, g, unknown, or other
  misc_feature (519)..(519): n is a, c, t, g, unknown, or other
  misc_feature (523)..(523): n is a, c, t, g, unknown, or other
  misc_feature (543)..(543): n is a, c, t, g, unknown, or other
  misc_feature (582)..(582): n is a, c, t, g, unknown, or other
  misc_feature (658)..(658): n is a, c, t, g, unknown, or other
  misc_feature (676)..(676): n is a, c, t, g, unknown, or other
  misc_feature (691)..(691): n is a, c, t, g, unknown, or other
  misc_feature (716)..(716): n is a, c, t, g, unknown, or other
ttgggccgtctggggggggnncatggagggaggggggcnccgacgaaggtgcgaggcatacgtggtgctcaccgcggtggcggccgctctaaaatagtggatcccccgggctgcaggaattcgcacgagaccattacctagaacatcctaatcgaaaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggaccccntgtccgggaaggagaggatgtgtttggggggnnnncacntctttgcttccttttntgnnccgcttnnntncnnntncgggatttgnctgnnaaggggaaaatctggggtggggattgggggtggggtttgaaggtgtaagggtggagggtgggcgaggggggaanntttatgggtggtgtgtgtttgttgggtttgtgggccccccncgaacaggaantggaagcnnaccntggaagttgcgtgggactgnaccacaaacgctaaccgaccccccgacgatgccaataantaccaaaaagcccaccgagtagcctagcacgccagaggtgtgcaccgtagaggcaacatagcatccacacccggancgaaaaagcgagacccanttaaagagacgtaancactctggtcccacctcgcgaaatncgcgtcccaatataggagcgcaagcagtcagtagaaacgaagcgtcggaaacgacttatccacttttccactcgcaccttctgccgactc

SEQ ID NO: 43920 - DNA, 611 bp, Zea mays
  misc_feature: Ceres CLONE 1445279-F
ggagctccccgcggtggcggccgctcttcaactagtggatcccccgggctgcaggaattcgcacgagaccattacctagaacatcctaatcgaaaaaccttctccccattccgctgttccgccctctcgcgtcgcgtgcctccaggtccctcctctgcgtaactgggtggccgccgatccgccgccaccgccctgcgtcaggtgttccggtgaacagcgtccacctgtgcccggcctcgggcggctgcactgcgcccccccgggaaaccagaaagccccttttcccaccaaagggaaaccggggccgccttttaaaaaattgggaaaaaccaaaaaccccaatttggggggggaaaaccataaactctaaaggggaaaaagcggggtaaaaaaaaaaaggggggggggaggggaaaaaaaaaaaaaaaaaaattttaaaccccccccccgggggggggaggccccccccaaatatatgcccccaaaaaataatccccccccccccaagggggggggggagaaaaaaaaaaaacccccacccttttttttcttccccccaaaaaaaatcaatggggtgggggggggttttgttttcctcacccccacaacca

SEQ ID NO: 43921 - DNA, 773 bp, Zea mays
  misc_feature: Ceres CLONE 1445281-F
  misc_feature: Encodes the peptide sequence at SEQ ID NO. 43922
  misc_feature (381)..(381): n is a, c, t, g, unknown, or other
  misc_feature (454)..(454): n is a, c, t, g, unknown, or other
  misc_feature (517)..(517): n is a, c, t, g, unknown, or other
ggagctccccgcggtggcggccgctctagaactagtggatcccccgggctgcaggaattcgcacgagaccattacctagaacatcctaatcgaaaaagactctcccagtcccttcctctcctgctgcctttctctcttctcggtgaagcgtgtgttcatttcactgttttggtttcatctcccgctctttctttaccccgtgctccggccaagtgctggaaccaagaaagcctcatggggcggccggccgacgggcggtagagaggcggagatgggctgggcgcctaggtggctgcgcgggctgctcggcggcggcaggaaggccgccgtgacgaagccggcgaaagagaagaagctctggggattcgggaagtccttccngggaaaaagacccgctgcagcgccggaaacgcctcggaacgccttcggtgcagcccacggcgacgcctccccnggtggtttgctgcggcccgtgatgaagcgaacgaacagcaaaaccagcgtgctaatcctgtgnccccgggcaaccgcggcggtggaaaaagccccccttcttttttgccaagggggccccccccctggggggtttaaaaaatcccggcgggtgccccacccgggccccccaaaaaggggaagagagggggggttttttaaaaacaagccctttcccggggcaaccggggtgggatcccaaaaaaccccccccttgaaataaaaaatttttttgttggacccccaaaaaaaaaaaaaatttttttaaaccccggtggggc

SEQ ID NO: 43922 - protein, 147 aa, Zea mays
  misc_feature: Ceres CLONE 1445281-F
  misc_feature (37)..(37): Xaa is any aa, unknown, or other
  misc_feature (82)..(82): Xaa is any aa, unknown, or other
MGWAPRWLRGLLGGGRKAAVTKPAKEKKLWGFGKSFXGKRPAAAPETPRNAFGAAHGDASPGGLLRPVMKRTNSKTSVLILXPRATAAVEKAPLLFCQGGPPPGGFKKSRRVPHPGPPKRGREGGFFKNKPFPGATGVGSQKTPPLK

SEQ ID NO: 43923 - DNA, 736 bp, Zea mays
  misc_feature: Ceres CLONE 1445285-F
  misc_feature: Encodes the peptide sequence at SEQ ID NO. 43924
tggagctccccgcggtggcggccgctctagaactagtggatcccccgggctgcaggaattcgcacgagaccattacctagaacatcctaatcgaaaatcctgggtcctggcttctccttccactccggagatcgacggctgcttgccgcactcgcgctcgctcccacggccggcaaccatggccgccgccgctgccgcggtgccagccaccttcctctcgggcctcccctctccacggaccccgtctcctgtgctccactcgcccgtacagagagcccatcccgtcgccgctcctctcttcctctccgccaagcgccgcgcctatgcctgcgccgccacgggctccggctccttctattcctccaactcaggaaatcaaacctcactgatgccgtcgttcagctttgcatttgacgaaggttcttctagttccaaaaggctatatagatggaagagggtattgcttaaagtaagtggagaagctcttgccggcgaccacacagaaaacatcgacccaaagattacaatggctattgcaagagaggttgcttctgtcaccaagctaggtgtagaggttgctattgttgttggcggtggcaatatctttcgtggggcctcttgggctggatgtagtggtcttgaccgctcatctgcagattacatcggcatgttggccactgtgatgaatgctatatttcttcaagcaacaatggagagcatcggaataccgacccgg

SEQ ID NO: 43924 - protein, 186 aa, Zea mays
  misc_feature: Ceres CLONE 1445285-F
MAAAAAAVPATFLSGLPSPRTPSPVLHSPVQRAHPVAAPLFLSAKRRAYACAATGSGSFYSSNSGNQTSLMPSFSFAFDEGSSSSKRLYRWKRVLLKVSGEALAGDHTENIDPKITMAIAREVASVTKLGVEVAIVVGGGNIFRGASWAGCSGLDRSSADYIGMLATVMNAIFLQATMESIGIPTR

SEQ ID NO: 43925 - DNA, 719 bp, Zea mays
  misc_feature: Ceres CLONE 1445290-F
  misc_feature: Encodes the peptide sequence at SEQ ID NO. 43926
  misc_feature (604)..(604): n is a, c, t, g, unknown, or other
  misc_feature (707)..(707): n is a, c, t, g, unknown, or other
actgctggagctccccgcggtggcggccgctctagaatagtggatcccccgggctgcaggaattcgcacgagaccattacctagaacatcctaatcgaaaactccgttccccgttccctcctctaccactggccccggcaccgcgggagcgccgaccgcctgctcgtctcgccgcagcccgtccctgtcggaaccctagcggccgccattgcccacgcgctgcgcgcccgatggacggcgggggctccgggccggcgcccaacgccgcgcacaccgcggaagaggtcttccgcgactacaaagcccgccgcgccggcatgatcaaggcactcaccaccgatgtggagaggttcttcaagctctgtgaccccgaaaaggagaacttgtgcctctatggctatcccgatgagacatgggaggttaccttgccagctgaggaagtgcccccagagatccctgaaccagcattaggaatcaactttgctagggatggcatgaatgagaaggactggctggcgctagttgcagtccacagtgattcctggttactatctgtcgcattctactttggtgcacggtttggatttgacagagaagctaagangcggctctttagcctgataaacaacatgcccacgatatttgaggtggtgacgggagcagtcaacagcaccatggcaaggagaataacctaacagtagcaccangagcaccagcct

SEQ ID NO: 43926 - protein, 154 aa, Zea mays
  misc_feature: Ceres CLONE 1445290-F
  misc_feature (125)..(125): Xaa is any aa, unknown, or other
MDGGGSGPAPNAAHTAEEVFRDYKARRAGMIKALTTDVERFFKLCDPEKENLCLYGYPDETWEVTLPAEEVPPEIPEPALGINFARDGMNEKDWLALVAVHSDSWLLSVAFYFGARFGFDREAKXRLFSLINNMPTIFEVVTGAVNSTMARRIT

SEQ ID NO: 43927 - DNA, 633 bp, Zea mays
  misc_feature: Ceres CLONE 1445295-F
  misc_feature (267)..(267): n is a, c, t, g, unknown, or other
acccgcggtggcggccgctctagaactagtggatcccccgggctgcaggaattcgcacgagaccattacctagaacatcctaatcgaaaagcgggcgtggcggcggccgtgaccggcgctggagatcttggacgcgcgcgacatcctggtctccgctctgtgcctctggtctccgaaggcgccgccaccctattttttttaaaaaaaaatcctaagaatagtttcttcagtccgacaccgcttctagcttcccctcggcgatctgtngaagctatgaaagccacccctctcgagaggaaaccccgaactaaaaaaaggggccccccctccgggggggggggggggggaaaaaacccccattttttaccccccccaaaaaaaaccaaaagagggggcccgggggaatttctccaaaaaaggggccaccgggggagaggccctcccccttaaagaaggggggggtcttcctttcttaaaaaaaggggttttttttttggggggggggtggttttcccccccccccgaaaaatattctcccggggtggggggggggcccccccccccccccccaaaaaaaaggggggggggggggggggaaaaaaaacccccctggggggggggagaggagatatt

SEQ ID NO: 43928 - DNA, 760 bp, Zea mays
  misc_feature: Ceres CLONE 1445305-F
  misc_feature: Encodes the peptide sequence at SEQ ID NO. 43929
  misc_feature (335)..(335): n is a, c, t, g, unknown, or other
  misc_feature (346)..(346): n is a, c, t, g, unknown, or other
tggagctccccgcggtggcggccgctctagaactagtggatcccccgggctgcaggaattcgcacgagaccattacctagaacatcctaatcgaaaaatcgcgcctgcaccgcacgcccacaggcccacagcaagcaccaaacaagccagcacgatggcgctcctggtgttgcgcgcgcctgcagccgtccacgaggcctcccggctgctccctccgccgccgcggtggcggcggcggctcgtggccgtcgcctcagcggcgtcctccgcgccgtccggcgaggtgtcgtcccagcacggcggcggctcggaatacctcggggccggccccaaancaacgccgtcncgcccgacaccaagtccaccgtcgtcaagaccaccgtcgagagggttatcttctatttccgggccccaccactcctcgccgtcgcggggtcactcgccggctccctcctgtgcttcctcaatggctgtgtcttcatcacagaggcataccaagtttactgatcgagctgcgtcaagggggtccatacgggacagatggtcctcaaagtcgtcgaggccatcgatgtgtatcttgctggaacggtcatgttgatatttgggatgggtctctacgggcactacgtcagcaacgcttacgagggtgctcgttctgaatccggacgtgcactgaacggatcatccctgttcgggatttcccttagaaggaacgccccaggtgaatgaagatcacctgcctcgactaagtgacaaaaaa

SEQ ID NO: 43929 - protein, 62 aa, Zea mays
  misc_feature: Ceres CLONE 1445305-F
MVLKVVEAIDVYLAGTVMLIFGMGLYGHYVSNAYEGARSESGRALNGSSLFGISLRRNAPGE

SEQ ID NO: 43930 - DNA, 732 bp, Zea mays
  misc_feature: Ceres CLONE 1445316-F
  misc_feature: Encodes the peptide sequence at SEQ ID NO. 43931
  misc_feature (416)..(416): n is a, c, t, g, unknown, or other
ggagctccccgcggtggcggccgctcttaactagtggatcccccgggctgcaggaattcgcacgagaccattacctagaacatcctaatcgaaaaacagcgaaggacacaaaaacacaggtagggttaggcgacgcggcggcgagagcgcgagagtaggaggaggcgtcggccatgacggggaaggcgaagccgaagaagcacacggcgaaggagatcgccgcgaagatcgacgcggcgacgacgaaccggggcggcggcaaggtcgggcaggcggatcggctagggcaggacaagggcgggcacgcgaagctggcgtgcccgctctgccgcaccccggcgcccgacatcaagtccatgcagatccaccacgaggcgcgccatcccaagctcccttttgtgtcccacacacctcgncaacctgcactcctccacccccgccgccgccgaggccaccacctccaagcccaagcccggggtccgcggcagcctcaagaagtagctggctggcttgcctgcctgactgcctggggtaattcccttcgatttcaatcccatccaccgacccgatctacaatcaatcaaagtaccgcccgcccctccggcctgcggtgtactggttagtctgctggttgccggctttttatccgtggtacattggcggaacctggtctcgcgtgataggatgggccaactaatttatccgtcttcggccgctgggattttttggtag

SEQ ID NO: 43931 - protein, 149 aa, Zea mays
  misc_feature: Ceres CLONE 1445316-F
MTGKAKPKKHTAKEIAAKIDAATTNRGGGKVGQADRLGQDKGGHAKLACPLCRTPAPDIKSMQIHHEARHPKLPFVSHTPRQPALLHPRRRRGHHLQAQARGPRQPQEVAGWLACLTAWGNSLRFQSHPPTRSTINQSTARPSGLRCTG

SEQ ID NO: 43932 - DNA, 779 bp, Zea mays
  misc_feature: Ceres CLONE 1445318-F
  misc_feature: Encodes the peptide sequence at SEQ ID NO. 43933
  misc_feature (436)..(436): n is a, c, t, g, unknown, or other
  misc_feature (559)..(559): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcgaaaacccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccgtcggtggactgtatctcccaggccgccagcctgatcgactgcatcgactacgtccagaaggggagcagcgcgcgccgtccgtccgctgcctgctgcggcgaggtcaagaccgcagtggccagccccgtcatcgtgggctgcctctgctccctcgncggctccaactccagtaacctgggctttcccatcgacatgaagcgcgtgctggcgctccccggcgcgtggcggggcgtccacgcccgcttcagcaagtgcaacatttccgcgcctttcccaancgaangacctgcaccgtcggcgccggggggtcatcaaaggtgggccggggggattttaccgggggcccggggggggaagtcccccccaaagaagggaaccgcctgggggctccggggggggccccggtcccccaaaaaggggggaaccctttaaggggttctttgggggggtgggccccttggggagagccccttttttttggggagcatccccaaactt

SEQ ID NO: 43933 - protein, 178 aa, Zea mays
  misc_feature: Ceres CLONE 1445318-F
  misc_feature (87)..(87): Xaa is any aa, unknown, or other
  misc_feature (128)..(128): Xaa is any aa, unknown, or other
  misc_feature (130)..(130): Xaa is any aa, unknown, or other
MALASRAAAAAVACVLLALAASAAGAGSNSPAPAPSVDCISQAASLIDCIDYVQKGSSARRPSAACCGEVKTAVASPVIVGCLCSLXGSNSSNLGFPIDMKRVLALPGAWRGVHARFSKCNISAPFPXEXPAPSAPGGHQRWAGGILPGARGGKSPPKKGTAWGLRGGPRSPKKGGTL

SEQ ID NO: 43934 - DNA, 724 bp, Zea mays
  misc_feature: Ceres CLONE 1445320-F
  misc_feature: Encodes the peptide sequence at SEQ ID NO. 43935
  misc_feature (372)..(372): n is a, c, t, g, unknown, or other
  misc_feature (398)..(398): n is a, c, t, g, unknown, or other
ggagctccccgcggtggcggccgctctagaactagtggatcccccgggctgcaggaattcgcacgagaccattacctagaacatcctaatcgaaaaatcacctcagtatttgtcagaagctcaaatactgatctcactgatccagtatggctatggcaaaggcaggcgcgccgagggtctcggcggcccagctggtgactctcgggctatcactcctctgcgctgtcgccggcccggccgccgcgcagaactgcggctgccagccaaacgtatgctgcagcaagtttggctactgcggcacgaccgacgagtactgcggcgacgggtgccagtcgggcccgtgcccgctcggcgggcgcggcaaccatggcngcggtggtgcaaagtggttagggtcntcaccggtccctttttaaagggttaaaaacccaagccgggaccgggccaaaggcaaaaaattctcaccccggaacccgtttcctaacccccccaaggggtacccgggtttccccccatggggggcccccgggggggggaaaaagaaaaataacccctcttttttttcgcccccccaaaaaaaacggggttttttttcttttccgggaaaaaaaaaaaaaaccccctccccccccccccaaaaaaaaatgtgcccccccccccccaaaaaaaaaaaaaaggggcgcgcccccccttttttttggaaaaaaaaccacacccccgcggg

SEQ ID NO: 43935 - protein, 89 aa, Zea mays
  misc_feature: Ceres CLONE 1445320-F
  misc_feature (33)..(66): Pfam Name: Chitin_bind_1 Pfam Description: Chitin recognition protein
  misc_feature: SWISSPROT Homolog: EC 3.2.1.14 Chitinase
  misc_feature (76)..(76): Xaa is any aa, unknown, or other
MAMAKAGAPRVSAAQLVTLGLSLLCAVAGPAAAQNCGCQPNVCCSKFGYCGTTDEYCGDGCQSGPCPLGGRGNHGXGGAKWLGSSPVPF

SEQ ID NO: 43936 - DNA, 624 bp, Zea mays
  misc_feature: Ceres CLONE 1445326-F
  misc_feature (308)..(308): n is a, c, t, g, unknown, or other
  misc_feature (345)..(345): n is a, c, t, g, unknown, or other
  misc_feature (472)..(472): n is a, c, t, g, unknown, or other
ggagctccccgcggtggcggccgctctagaactagtggatcccccgggctgcaggaattcgcacgagaccattacctagaacatcctaatcgaaaaatcgaatagtcccgtcctttcggttctacctttccctcccgcgccgccgcagccgcctccagggccgcggaaaccctagccacctcgtcagtgccgcgcgccgggtgtctcgccgccgcccgtcactgccgctgacaccgccggagcgatcggatctcgagaccgtcaggagacacgatggagggatggggatctgaagatttccagcccgntgcctctggtgtgaaagtccagccactaaaaaatcanggggctgatgaaaatgcccatgcccacaacctaaaaaaatcctgggggggaaaaaagggaaagggaaaaccttcccccggggctggggcaaaaaaaggggaaaaaccaagcgtaagggctctcggtnaaaaggggaaaaccggggctttccaagggggcggaggaaacaaaaaaactttttttgccccccctttaaaaaaatatctccacaacaagggtttgggaaaaacaattttttttttgcccccaacaactttttttttggaaaaaaagagggga

SEQ ID NO: 43937 - DNA, 726 bp, Zea mays
  misc_feature: Ceres CLONE 1445327-F
  misc_feature (455)..(455): n is a, c, t, g, unknown, or other
  misc_feature (464)..(464): n is a, c, t, g, unknown, or other
  misc_feature (465)..(465): n is a, c, t, g, unknown, or other
  misc_feature (489)..(489): n is a, c, t, g, unknown, or other
  misc_feature (517)..(517): n is a, c, t, g, unknown, or other
  misc_feature (519)..(519): n is a, c, t, g, unknown, or other
  misc_feature (520)..(520): n is a, c, t, g, unknown, or other
  misc_feature (528)..(528): n is a, c, t, g, unknown, or other
  misc_feature (530)..(530): n is a, c, t, g, unknown, or other
  misc_feature (531)..(531): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaacatttggttctctcgcgaactcgacaccctaccttggcggaatactcctggtgattgtccttgcatggctgggtgctgtaaggtccctcgacctgcagttctcttccctggcgaagcaagagctcggcagagagaagctgctgaaaacgcaggccgtcgaaacggtcgccgaagtagtcggcactggaaacggttctctccaagaaactctagctagcgagccgtctgcaaatggcgcggccaccaaacagtcgcaagaacctgagagcacagcctcagagaaatcaggccagcagtctcaataagttctccccccccagaaatttagctagcacgagcctttggaagaaccngaaagttcnntatctgagctactgaagaaagcangaatcatgccagaaaatagaaggcctgntnnctctctgntnngtgaggggtttttgttttaaactcgccgtatctgtagctgtttgttncttccataggatgaactggttatgttcgtattaaattttgagagctgcttcatcgtaaaaaaaaaaaaagttatcgatccgtcaccccagggggggccggacccattcccatataggaccaataacccgccccgggcccgtttaaaac

SEQ ID NO: 43938 - DNA, 749 bp, Zea mays
  misc_feature: Ceres CLONE 1445328-F
  misc_feature: Encodes the peptide sequence at SEQ ID NO. 43939
  misc_feature (340)..(340): n is a, c, t, g, unknown, or other
  misc_feature (349)..(349): n is a, c, t, g, unknown, or other
  misc_feature (352)..(352): n is a, c, t, g, unknown, or other
  misc_feature (361)..(361): n is a, c, t, g, unknown, or other
ctggagctccccgcggtggcggccgctctataactagtggatcccccgggctgcaggaattcgcacgagaccattacctagaacatcctaatcgaaaaacatcccattcccctcgtctcatctcatctcaagagcgacaagagagagaggaagagaacaagcgataagctcatctcgcacgcaagatgcgggctccaaggggcggaggcggctgccgcggcggcggccaggagcatgtggaactgatccctggcatccccgacgacgtggccgtggactgcctggcgcgcgtcccccacgcctcccaccgcgcgatgcgccgggtctgccgcggctggcngagcgccgnccngcgcgcggncttcgcgtcggcgcgcgccgcggcgggcgcaacgaggacctctgaacctgatgcatttccggaccccttggggaaaaaagggcccagagagggaaaaaaggcccgggaaaccccgggggaaagggggggggggaaacacggtgaacacgggaagggggggggggaggggcgccccccccccggggggcggggtcccccaaggcggggggggggacaccccctcggcccttggggggggggcacaccccccccttcccccccgggggaagtttttgtgttgccccccccccgggtggtattaaccaccaacccccggggggggggggggccccccccccccccccaggaagaaaaacacccccccccgccgcgggtgttataaaaaagg

SEQ ID NO: 43939 - protein, 185 aa, Zea mays
  misc_feature: Ceres CLONE 1445328-F
  misc_feature (52)..(52): Xaa is any aa, unknown, or other
  misc_feature (55)..(55): Xaa is any aa, unknown, or other
  misc_feature (56)..(56): Xaa is any aa, unknown, or other
  misc_feature (59)..(59): Xaa is any aa, unknown, or other
MRAPRGGGGCRGGGQEHVELIPGIPDDVAVDCLARVPHASHRAMRRVCRGWXSAXXRAXFASARAAAGATRTSEPDAFPDPLGKKGPREGKKARETPGERGGGKHGEHGKGGGEGRPPPGGRGPPRRGGGHPLGPWGGGTPPPSPPGEVFVLPPPRVVLTTNPRGGGGPPPPPQEEKHPPPPRVL

SEQ ID NO: 43940 - DNA, 771 bp, Zea mays
  misc_feature: Ceres CLONE 1445330-F
  misc_feature: Encodes the peptide sequence at SEQ ID NO. 43941
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (36)..(36): n is a, c, t, g, unknown, or other
  misc_feature (37)..(37): n is a, c, t, g, unknown, or other
  misc_feature (48)..(48): n is a, c, t, g, unknown, or other
  misc_feature (384)..(384): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (479)..(479): n is a, c, t, g, unknown, or other
  misc_feature (482)..(482): n is a, c, t, g, unknown, or other
  misc_feature (484)..(484): n is a, c, t, g, unknown, or other
  misc_feature (485)..(485): n is a, c, t, g, unknown, or other
  misc_feature (493)..(493): n is a, c, t, g, unknown, or other
  misc_feature (495)..(495): n is a, c, t, g, unknown, or other
  misc_feature (496)..(496): n is a, c, t, g, unknown, or other
  misc_feature (504)..(504): n is a, c, t, g, unknown, or other
  misc_feature (510)..(510): n is a, c, t, g, unknown, or other
  misc_feature (518)..(518): n is a, c, t, g, unknown, or other
  misc_feature (524)..(524): n is a, c, t, g, unknown, or other
  misc_feature (533)..(533): n is a, c, t, g, unknown, or other
  misc_feature (534)..(534): n is a, c, t, g, unknown, or other
  misc_feature (592)..(592): n is a, c, t, g, unknown, or other
  misc_feature (598)..(598): n is a, c, t, g, unknown, or other
tttcccccccgnnnnntatttaatgagtagagaaanngggggggggtnggcatagctggagctccccgcggtggcggccgctctattactagtggatcccccgggctgcaggaattcgcacgagaccattacctagaacatcctaatcgaaaaatgacaaaagagcagctttttgatatgacatgcatgacattaggtggccgtgctgcacaggacgttttgatgggcaaaatctcaactggcgctcagaatgacctggggaaagttaccagaatgacttatgcacaggtcggcgtgtatggttgtagcgaccaggttgggcttcggtccttcccccagaaagatgggggggttgatttgaggaagccgtacgggagtgggatngtatccgtcatcgagaaggaggtgggggaatgggttggcaaggtcttcnnnaaaaacgttgaattgttgagggggtggtgttgtccccccccccncanannccaaaatngnngctccggnaggaanttctaagngggganatctacccnnggaactaggaagaaggtcctttcaagggtttggccgccaaccaagtgcaacctccctnaacaangtttccgaggttggtggttcacaaccgtccaaagcaccagcggaaaactacccaccttgcctgattgattcaaacaccacccagttggggggctggtattaacgaaagaaacgatggtgtgctcgcccatagcgtcaaacatttacaacaaatgaaggagcaccgcaccaacg

SEQ ID NO: 43941 - protein, 120 aa, Zea mays
  misc_feature: Ceres CLONE 1445330-F
  misc_feature (1)..(101): Pfam Name: Peptidase_M41 Pfam Description: Peptidase family M41
  misc_feature (77)..(77): Xaa is any aa, unknown, or other
  misc_feature (94)..(94): Xaa is any aa, unknown, or other
  misc_feature (109)..(109): Xaa is any aa, unknown, or other
  misc_feature (110)..(110): Xaa is any aa, unknown, or other
  misc_feature (111)..(111): Xaa is any aa, unknown, or other
  misc_feature (114)..(114): Xaa is any aa, unknown, or other
  misc_feature (115)..(115): Xaa is any aa, unknown, or other
  misc_feature (119)..(119): Xaa is any aa, unknown, or other
MTKEQLFDMTCMTLGGRAAQDVLMGKISTGAQNDLGKVTRMTYAQVGVYGCSDQVGLRSFPQKDGGVDLRKPYGSGXVSVIEKEVGEWVGKVFXKNVELLRGWCCPPPXXXQNXXSGRXF

SEQ ID NO: 43942 - DNA, 710 bp, Zea mays
  misc_feature: Ceres CLONE 1445334-F
  misc_feature: Encodes the peptide sequence at SEQ ID NO. 43943
  misc_feature (710)..(710): n is a, c, t, g, unknown, or other
aagctggagctccccgcggtggcggccgctctagaactagtggatcccccgggctgcaggaattcgcacgagaccatacctagaacatcctaatcgaaaaaaaaatttcccgacccctctagaacgaccgcccctgccgaggagccgaccgacgggcgaagcgggagggaggcgatggcggcggcttgggggcagaaggccctgggggctctgccgcagctggtgaagtcgctgcggagtgatcccgtctccggcagcgcacgacacaggcgccttccgtctctcaggaggaccttctcgttgtacgatcagatcaacctcatcgacagcgtcccggaagacgagctcggattccagtcgtatgatgacactggattcaaatttaacatgtaaaatatgaggccgggtttggattggaaaaaacagataatgactggggccccaaaacgttcccaaagataaccccggaagtttttaaaccttccaaggtgggcccccctccccaaaaatttttttttttggggggggaaaaaacccccagcttgggcaccctcagactggggagttttttttcgcggcaccgggagagaaactaaaaaccttttttccaggaaaagcctctcccccctttttttcccccacaaaggaggggggcgggggggggacccccactctctcctccagggggcccctctttgtggtttttcccn

SEQ ID NO: 43943 - protein, 72 aa, Zea mays
  misc_feature: Ceres CLONE 1445334-F
MAAAWGQKALGALPQLVKSLRSDPVSGSARHRRLPSLRRTFSLYDQINLIDSVPEDELGFQSYDDTGFKFNM

SEQ ID NO: 43944 - DNA, 652 bp, Zea mays
  misc_feature: Ceres CLONE 1445341-F
  misc_feature: Encodes the peptide sequence at SEQ ID NO. 43945
ggagctccccgcggtggcggccgctctagaactagtggatcccccgggctgcaggaattcgcacgagaccattacctagaacatcctaatcggaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggacgtggagggcgacggcgaagtgcaggagctcggccggttctccgtcgccgagtacaaccggcagctccgagaaagtggcggcggcggcggcaggctcgagttcggcagggtggtggcggcgcaccggcaggtggtgtccgggctcaagtactacctccccttcctggccctggaggagggcggccggggaacggcggccagcgcgtgttcaaccccgtccttcgtcgtcaagccctggttcgactcgcgcacccggcttaagtttcggcccgggggcccgcaa

SEQ ID NO: 43945 - protein, 150 aa, Zea mays
  misc_feature: Ceres CLONE 1445341-F
MARALGACVLLAVLLGALAPAAAARAHDDQGSGAGIRQPSGEYRGRKVGARTEVRDVEGDGEVQELGRFSVAEYNRQLRESGGGGGRLEFGRVVAAHRQVVSGLKYYLPFLALEEGGRGTAASACSTPSFVVKPWFDSRTRLKFRPGGPQ

SEQ ID NO: 43946 - DNA, 1011 bp, Zea mays
  misc_feature: Ceres CLONE 1445355
  misc_feature: Encodes the peptide sequence at SEQ ID NO. 43947
gatccgctcggttggtcgtcgtgtcgactggttcgtctccatccgcctctcgtccccttctgctccatcgaaggtccctcgcgatctcgcctcgagtagctagtgcctcgcgcgccgggggcgactgcgcgcgcggtcagtcagtcttcggcgtgcggggcgcgcgcgagatctcctcagaggtaggggagaaaatcggtgagggtcggcgggcctgatgggcggggcggtctccggtggcgcggcggttggggatgcggcgggggcggcaacttacccggtggttctcaacgtgtacgacctgacgccggtcaacaactacctccactggggcgggcttggcatcttccactctgccgtcgaagttcatggatcggagtacagttttggagcacatgatcacccatcgagtggagtttttgaggtggaaccaaagagctgcccagggttcatatacagatgtacggttttcataggccacacaactctgaattccttggaatttcgagaattcattcagaggatggcctcagaataccatggagatacctaccacctcatttccaagaactgtaaccactttacagatgatcttagcaccagattaacaggaaaatcaattcctggttgggtcaatcgacttgcaaggctaggcgccttttgcaattgccttctaccagaaggcttgcggcttgagtcaactgaaacaaagcatcttggagactgtcgttyctcagatggttccaataccaccagcaacgataactctgacgaagatgaattggaagataaacacctgcttccgactacttctgttggtgaagacacaattgtaaaagaaattcacagatgaatttctggtgaagccttgcagtgatttctctatgtattctaaaatgtaatgggtttcaatactcattgtgcagcttgtcgttcattatgtatattgtcattgtattttaaaatgtcatgtgctctttctgttgtgctccgaaaaaaaaaaaaaaaaaa

SEQ ID NO: 43947 - protein, 211 aa, Zea mays
  misc_feature: Ceres CLONE 1445355
  misc_feature (20)..(157): Pfam Name: DUF862 Pfam Description: PPPDE putative peptidase domain
  misc_feature (172)..(172): Xaa is any aa, unknown, or other
MGGAVSGGAAVGDAAGAATYPVVLNVYDLTPVNNYLHWGGLGIFHSAVEVHGSEYSFGAHDHPSSGVFEVEPKSCPGFIYRCTVFIGHTTLNSLEFREFIQRMASEYHGDTYHLISKNCNHFTDDLSTRLTGKSIPGWVNRLARLGAFCNCLLPEGLRLESTETKHLGDCRXSDGSNTTSNDNSDEDELEDKHLLPTTSVGEDTIVKEIHR

SEQ ID NO: 43948 - DNA, 687 bp, Zea mays
  misc_feature: Ceres CLONE 1445360-F
  misc_feature: Encodes the peptide sequence at SEQ ID NO. 43949
  misc_feature (469)..(469): n is a, c, t, g, unknown, or other
  misc_feature (486)..(486): n is a, c, t, g, unknown, or other
  misc_feature (597)..(597): n is a, c, t, g, unknown, or other
tccccgcggtggcggccgctctagtctagtggatcccccgggctgcaggaattcgcacgagaccattacctagaacatcctaatcgaaaaggaagcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttagcggtcaatgatgagactgttaagtttgaaatctgggatactgccgggcaggagagggaccccaccttggctcccctgtactataggggtgcagctgctgccattgttgtctattacattcanaaatccggcctccttcncccgtgccaagaaattggggttcaagaacttcaagctcaaggacatcagaataccatagtggcttcttgttggaaacaaggctaatatgctataatgcaaggcaggtgccntcttaaggaagcaacgcctactgctcaggaaaacgggctcttctccatggagacatctgcgtaaactgggatacatggggaatgaaataa

SEQ ID NO: 43949 - protein, 127 aa, Zea mays
  misc_feature: Ceres CLONE 1445360-F
  misc_feature (13)..(125): Pfam Name: Ras Pfam Description: Ras family
  misc_feature (94)..(94): Xaa is any aa, unknown, or other
  misc_feature (100)..(100): Xaa is any aa, unknown, or other
MAANAGNKIRNAKLVLLGDVGAGKSSLVLRFVKGQFVEFQESTIGAAFFSQTLAVNDETVKFEIWDTAGQERDPTLAPLYYRGAAAAIVVYYIXKSGLLXPCQEIGVQELQAQGHQNTIVASCWKQG

SEQ ID NO: 43950 - DNA, 731 bp, Zea mays
  misc_feature: Ceres CLONE 1445364-R
  misc_feature: Encodes the peptide sequence at SEQ ID NO. 43951
gcggacgattggccaagttcaacgactccatttctagttatttgacctccaaattattacatcaaatgaactcatcagcatcactccagctctttgaccttcttcttgaggttagacagcatgatttccactaaatctgccaagagggcatctccagaatgcacgacgaagatcagattgtctgtattacccaatggctcatgaagatacgcgtttgaagaactatcactgctcttggaactcgaaggaatggcgtatctcccacctgcttgccgtgtgagacctatgcgcacaaacagcagttcctccatctccatcagccagtgggtgctggcgctttccctgtgttgcatctccggcagtgacaccataatagtcagcataaagcttgtattgattcgccccctcgcgtccaagtatgagtttctcaatcttacgtcgatcaaacaagtccttgaagaagcttgaatagtgtaacaatggtcttcactgacctctttcccttgatccattacaacattgtgtatgggcccaactgaaagccggcgcataccagtgggtgaacttttcattgccggatctccccttggtctaacctttcctgaaatggggcctcctaaacgactgggtcggggattcatgagtggcttttaaggttcagaaaaacccctcaatgaacacccttgtaacattggggcccttagtgggaaatttcttggcagcaccggagg

SEQ ID NO: 43951 - protein, 72 aa, Zea mays
  misc_feature: Ceres CLONE 1445364-R
MAYLPPACRVRPMRTNSSSSISISQWVLALSLCCISGSDTIIVSIKLVLIRPLASKYEFLNLTSIKQVLEEA

SEQ ID NO: 43952 - DNA, 670 bp, Zea mays
  misc_feature: Ceres CLONE 1445378-F
  misc_feature: Encodes the peptide sequence at SEQ ID NO. 43953
tggagctccccgcggtggcggccgctctattctagtggatcccccgggctgcaggaattcgcacgagaccattacctagaacatcctaatcgaaaacactcgcatcagagcggcgccggcctacaaccgttttcgtgctcacacacccaaaccttagtcgcgatcaggccccaaggactcgagatgaagtcgagggcacggtccaccgccggcgactccaggctctcgatgaggaagaccaaggcagagaaggacccaaacaagcccaagaggcctccgagcgcgttcttcgtcttcatggaggagttcaggaaggactacaaggagaagcaccccaatgtgaagcaagtctccgtgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgagggtgacgagtgatgtatgacggatgaaactctgtccaagtgtttgcagtcagggaaaaaaatcttcgtcgttggcggcctaaccgggctttctcgaaggactttctagatgcagtagattagtgccgtcttctctgaaa

SEQ ID NO: 43953 - protein, 119 aa, Zea mays
  misc_feature: Ceres CLONE 1445378-F
  misc_feature (28)..(97): Pfam Name: HMG_box Pfam Description: HMG (high mobility group) box
MKSRARSTAGDSRLSMRKTKAEKDPNKPKRPPSAFFVFMEEFRKDYKEKHPNVKQVSVIGKAGGDKWKSLSDAEKAPYVSKAEKLKAEYTKKIDAYNNKQSGDPTASGDSDKSKSEGDE

SEQ ID NO: 43954 - DNA, 858 bp, Zea mays
  misc_feature: Ceres CLONE 1445380-F
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ggggcgcctctcccccctctttttcnnnnnnnnnnnnncagtctattnnnnttaaagctggtgctccaccgcgtggcggccgctctagaatagtggatcccccgggctgcaggaattcgcacgagaccattacctagaacatcctaatcaaaaaaaaagaagctccataattaattattgccctttcagttcgccatcggcagccgagcaccatgaggtccacaggggggggggacgatggcgccaaaaagtctgggccggaagggggtcgggctcaccctggaaaaacgccagaagggggatccttggggaaaaagccccgacgtccgaccgcgtccccgctgccctctttttcccccacaggaggaagagaggaatttccgcccccccctttttttcctcatgtctatacaaactcccttggggaaaataaattttttttttccccccccccagaggggggggggggggggggccccaccccccatttcgcccttttttcccccccccccccacgcccacaaaaaacaaaaatattttcgaagcttgcccacccaggagctacagggtgttccctcccctccggcctgccttcgcgggggggtgggggatacaataaggtggggcgggccaacgcccgcgcagcccgccgagctaatggcgttgtgtccgtcagtctgcctgcgcgacgggatcgatagtgcgggtcggtgaggcggcggctcaggctcccgcttattggcgcaccggcgtgtgcgcgtgagcgtgggtgcgaccttgttgtggggccgtccccccattaccttgtatgtgccgaatagggagagttattctctactcccttgtctggttctttcc

SEQ ID NO: 43955 - DNA, 804 bp, Zea mays
  misc_feature: Ceres CLONE 1445390-F
  misc_feature: Translation starting site: 193
  misc_feature (377)..(377): n is a, c, t, g, unknown, or other
  misc_feature (427)..(427): n is a, c, t, g, unknown, or other
  misc_feature (565)..(565): n is a, c, t, g, unknown, or other
aaagctggagctccccgcggtggcggccgctctataactagtggatcccccgggctgcaggaattcgcacgagaccattacctagaacatcctaatcgaaaaaaccctagccgcctgcatctcctcctccaaaactagtcaccaccggccaccgccaccctcgatcacgccgtccgtggaggtaatgtcagcatggtgagcgtcagtgtgctcaacgatgcgctcacttccatgtacaacgctcagaagatcggccagaggcatgatcatgatcaggccgtcatccaaggacatcatctagttcctgactgtcatgcatcgccacgaggacattgcagagttcgagcacgttgatgcccaccgatgtggtgaagacncagactacctcaacaggtaggcttaataagtgccccacccttgtcccccngctttgtaattgccgctgaaaaaaattgacgggaaggaattgaaagggtggctcccggcccagggagaagggaaaacaaactcctgacaaacttttggggggcgcctttggacacccatgggagcccccttgtggaangacccaagggggcaaaggttctgggttttttcttcttggaaaaaggttgaaaacttcttttatgggccgggggctccttgttttacttctccccaaaaaagggagggccggggtttttattttaacatggggcccctcgaagaaggacgcgcccctttttttccctcttatttaggggcgggggtggggggttacctctttaacatcctaaatatattttgttgtaaaaaaaaaaaaca

SEQ ID NO: 43956 - DNA, 867 bp, Zea mays
  misc_feature: Ceres CLONE 1445397-F
  misc_feature: Encodes the peptide sequence at SEQ ID NO. 43957
  misc_feature (373)..(373): n is a, c, t, g, unknown, or other
  misc_feature (375)..(375): n is a, c, t, g, unknown, or other
  misc_feature (382)..(382): n is a, c, t, g, unknown, or other
ctggagctccccgcggtggcggccgctctagaactagtggatcccccgggctgcaggaattcgcacgagaccattacctaaaacatcctaatcgaaaaagagaaacacctctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcagagaaggagaangncctccantggtccaacagcccctgagggtaaattccaccccccccccctgcccgggccttccctggttttatttaggttctggttccccaaagaaaaaaccctcgggtgcccccccagtgcaaaaaagccccggtttccccttgaacttttcggcgggggacacccaccaacccgtaaagaaccacccctttaataaataccccccccgaaggaacaccgggagggggataaaaaaatttttgggtccctaggggggcgcccccccttttagcaaaaaaaaattttttttgagagcccctgggcccccaaaaactcctctatttcgccacgacactttctcttcggggggagcggtggagaaaactccctcttcaaaaaagggggaagcagcgcccccccccctccgtgagcacacaattttttggagtatccacccaaacaccgcggtggggggggcggaatttcttaacccgcggggcgtccctccctgt

SEQ ID NO: 43957 - protein, 56 aa, Zea mays
  misc_feature: Ceres CLONE 1445397-F
  misc_feature (48)..(48): Xaa is any aa, unknown, or other
  misc_feature (49)..(49): Xaa is any aa, unknown, or other
  misc_feature (51)..(51): Xaa is any aa, unknown, or other
MSRSNRKSSRGLDLKLNLSLPATGDSSRRAMADEESSPSSCLSSEKEXXLXWSNSP

SEQ ID NO: 43958 - DNA, 721 bp, Zea mays
  misc_feature: Ceres CLONE 1445400-F
  misc_feature: Encodes the peptide sequence at SEQ ID NO. 43959
aaagctggagctccccgcggtggcggccgctctagaactagtggatcccccgggctgcaggaattcgcacgagaccattacctagaacatcctaatcgaaaaaataaaaaaaatccgtcttcttgtggtcttctccaaaccctagcgcccccggccccggtctccgcccccccgccttcgccgtcgcggtcgcgccccatggcggggaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcggccatttcatggttccaaggaggttttcctctctgaccactatgatgtacaaagtgctgacaccattgaggggaaatgcaatgtccacagcttccgtagctatacaaagcttgattctgtcaatgctgaggatttcttctgccgcttcgagtataaatcagctactggcagctttgtaccagatcgtatagcagtgtaagaacacagcaagacttgcaatttcattattttggatttgcattcatgttgcaaaaaaaaaaaaaaaagcttatcgataccgtcgacctcgaggg

SEQ ID NO: 43959 - protein, 142 aa, Zea mays
  misc_feature: Ceres CLONE 1445400-F
  misc_feature (22)..(139): Pfam Name: BAH Pfam Description: BAH domain
MAGKSRPPKRILESYTIKGSDRVIKPGDCVLMRASDASKPPYVARVEAIEAAGSRGTNVRVRVRWYYRPEESIGGRRPFHGSKEVFLSDHYDVQSADTIEGKCNVHSFRSYTKLDSVNAEDFFCRFEYKSATGSFVPDRIAV

SEQ ID NO: 43960 - DNA, 753 bp, Zea mays
  misc_feature: Ceres CLONE 1445403-F
  misc_feature: Encodes the peptide sequence at SEQ ID NO. 43961
  misc_feature (294)..(294): n is a, c, t, g, unknown, or other
  misc_feature (361)..(361): n is a, c, t, g, unknown, or other
  misc_feature (425)..(425): n is a, c, t, g, unknown, or other
aagctggagctccccgcggtggcggccgctctagaactagtggatcccccgggctgcaggaattcgcacgagaccattacctagaacatcctaatcgaaaacttttacagccgccgccgacgccgacgccgacgcatctcccagcctccccgcactcgcttccgtcgccgccgccgccacttcgcagccatgggtaaggtgcacggatcgctggcccgcgccgggaaggtccgcgggcagacgcccaaggtggcgaagcaggacaagaagaagaagccccgcggccgcgcgtancagaggatgcagtacaaccgccgcttcgtcaccgccgtcgtcggcttcggcaagaagcgcgggcccnactcgtccgaagagtaggcgcgacgccgttgggctcccatgcctatgcctatgctcctgctcanggttcagctaggcgctaggcggaatctaagcggtgacccattgcctagcgcctagccgggagtactcggcttaggcgcctccaggggttttcctggggttttgcaataacccccaaatttaataatattttggggataaacccatttacccccctttttgggccaattgggcccccgtagtttaaaaaaaaaggggcgggaaaaattttttaatcctttaaaaaaaaaaaaaaaaatttttttttcccccccccccccggggggggggcccggggccaaaatttcccctaagggggggagaataaccggcgcccctcgggcggctttt

SEQ ID NO: 43961 - protein, 62 aa, Zea mays
  misc_feature: Ceres CLONE 1445403-F
  misc_feature (3)..(61): Pfam Name: Ribosomal_S30 Pfam Description: Ribosomal protein S30
  misc_feature (35)..(35): Xaa is any aa, unknown, or other
  misc_feature (58)..(58): Xaa is any aa, unknown, or other
MGKVHGSLARAGKVRGQTPKVAKQDKKKKPRGRAXQRMQYNRRFVTAVVGFGKKRGPXSSEE

SEQ ID NO: 43962 - DNA, 773 bp, Zea mays
  misc_feature: Ceres CLONE 1445404-F
  misc_feature (218)..(218): n is a, c, t, g, unknown, or other
  misc_feature (238)..(238): n is a, c, t, g, unknown, or other
  misc_feature (239)..(239): n is a, c, t, g, unknown, or other
  misc_feature (244)..(244): n is a, c, t, g, unknown, or other
  misc_feature (245)..(245): n is a, c, t, g, unknown, or other
  misc_feature (251)..(251): n is a, c, t, g, unknown, or other
  misc_feature (275)..(275): n is a, c, t, g, unknown, or other
  misc_feature (284)..(284): n is a, c, t, g, unknown, or other
  misc_feature (733)..(733): n is a, c, t, g, unknown, or other
acccgcggtggcggccgctctagaactagtggatcccccgggctgcaggaattcgcacgagaccattacctagaacatcctaatcgaaaactctctctccgtgcggtgactgactgggcaaccgccaccgccctccccctccgtcgggtcttcgccggcgccaccagcgacgactgggcggtctgtgtccctctttcgcggagacgatcacccaccangtggatgtcgattttttggnntgacnnagtganggtacgaactactttgatcctgangtgaagaangtatgatcccggcccagcttcaggaactccgcaaatttgataaccataatctagaggttctcccgaaaccttttatggaaacctgattccaaaccgggccccccggggacctttggccgggaggaaaattcaacaacaattcccccttaaaaatgggagaatttcgggttgggaaggccccccccccttttacccttggaaaaatcccgggagggtataaattttttttaaagagagtttaaaatttttttaaagaaccgggggggttaaaaaaaaaaacctcctcccccaagggggggccccccccaaaaaataggggggtcctttaaaaaaaaaaaaaaaaaaaatttttttttgaaaaccaccccgcgggggtgggggaaaaaaccctcccccccccccccccccaccaagagagagggggggggggtcttccctttttttttggnggggggggggggaggaaaagaccccccccccccccccaca

SEQ ID NO: 43963 - DNA, 779 bp, Zea mays
  misc_feature: Ceres CLONE 1445408-F
  misc_feature: Encodes the peptide sequence at SEQ ID NO. 43964
  misc_feature (317)..(317): n is a, c, t, g, unknown, or other
  misc_feature (387)..(387): n is a, c, t, g, unknown, or other
  misc_feature (407)..(407): n is a, c, t, g, unknown, or other
  misc_feature (408)..(408): n is a, c, t, g, unknown, or other
  misc_feature (410)..(410): n is a, c, t, g, unknown, or other
  misc_feature (411)..(411): n is a, c, t, g, unknown, or other
  misc_feature (454)..(454): n is a, c, t, g, unknown, or other
ggagctccccgcggtggcggccgctctagaactagtggatcccccgggctgcaggaattcgcacgagaccattacctagaacatcctaatcgaaaaatatcctgggagacaacccgatgaagcttagctaccttgtgggatatgggagcagctacccaaagcaagtacaccacagaggggcgtcgatccccgcggatgcgaaaacaggctgcaaagggttcgagtatctccactcacccagcccgaacccaaacgtggctacgggcgccctggtgggtgggccgttccagaacgacaccttcgtggactcccgtgancacgccgtgcagacggagtccagcaccctacacagtggcaccctggtcggtctcctctccggcctcgtcnacacttcctccgtggtacanncnntcacctagaggggctcctcctatgtctgggctggagcgatgcntgtcgagtacgattgcagtttttttgctggccttggctaatggggatgcccaatctgggactggaagaaagaaagctgggttgccacccttccgttccaaacggatggattatgcgggatgccaccgtattttaagaggggccccccctttcctttcggttggttgggaaaaggagacgggctggcccccggagggaactttattttttccccccgcgcccccattctggtttccggggcgcccctagggggtgccccccccaaaaaggtttacaacactttgggggcggttttcttttgtccactctggggggggaaggaaacc

SEQ ID NO: 43964 - protein, 100 aa, Zea mays
  misc_feature: Ceres CLONE 1445408-F
  misc_feature: SWISSPROT Homolog: EC 3.2.1.4 Cellulase
  misc_feature (67)..(67): Xaa is any aa, unknown, or other
  misc_feature (91)..(91): Xaa is any aa, unknown, or other
  misc_feature (97)..(97): Xaa is any aa, unknown, or other
  misc_feature (98)..(98): Xaa is any aa, unknown, or other
  misc_feature (99)..(99): Xaa is any aa, unknown, or other
MKLSYLVGYGSSYPKQVHHRGASIPADAKTGCKGFEYLHSPSPNPNVATGALVGGPFQNDTFVDSRXHAVQTESSTLHSGTLVGLLSGLVXTSSVVXXXT

SEQ ID NO: 43965 - DNA, 763 bp, Zea mays
  misc_feature: Ceres CLONE 1445410-F
  misc_feature: Encodes the peptide sequence at SEQ ID NO. 43966
aagctggagctccccgcggtggcggccgctctagaactagtggatcccccgggctgcaggaattcgcacgagaccattacctagaacatcctaatcgaaaagctactgggcattggctactggcctactgccaactacccgtggggtcccgtggaagagaagagagcatcgccggagttggggtcggcgcgccgacgaggaacaaaagaagacggcggtggggcggagatggggagtcctctgggcgggtggccgtcttacaacccgcacaacttcagccagctcgtcccggccgacccatccgcacagccctcgaatgtcacaccagccacttatgttgcgacccacaggactgatccgccacccaatcaagtgataacaacggagtcgaggaacatcctgctgaggcacttctaccagaaatccgagaagctgaggcccaagagacctgccccggacaacctcgctccggagaacaacaacagcaacaacaagcagcccaggggaccggtcggcgacgtcggggcagtcgtcgagcgcgagaagctgaagccacagctggtggccgtccactcctccccctgcctgcttgtttctcatctctgggtttcgtcatgcagaggcagaggcagatgcagccctgtgttgtcctcttcgctcctcacgtctgtacgtacgacccaaagagctactaacctaatctgaaagtagggttacatacatggatatcggaatagatgggtgtacataagcaccctgagaa

SEQ ID NO: 43966 - protein, 158 aa, Zea mays
  misc_feature: Ceres CLONE 1445410-F
MGSPLGGWPSYNPHNFSQLVPADPSAQPSNVTPATYVATHRTDPPPNQVITTESRNILLRHFYQKSEKLRPKRPAPDNLAPENNNSNNKQPRGPVGDVGAVVEREKLKPQLVAVHSSPCLLVSHLWVSSCRGRGRCSPVLSSSLLTSVRTTQRATNLI

SEQ ID NO: 43967 - DNA, 706 bp, Zea mays
  misc_feature: Ceres CLONE 1445414-F
  misc_feature: Encodes the peptide sequence at SEQ ID NO. 43968
  misc_feature (683)..(683): n is a, c, t, g, unknown, or other
ggagctccccgcggtggcggccgctctagaactagtggatcccccgggctgcaggaattcgcacgagaccattacctagaacatcctaatcgaaaaacctcacctcgtcctcctccgactctccgaccacccgcagcagcaacagcccaacaggcaaagctttgcttagctcctgctcctccactgctcaaggcatcaggccgtccttcctagcctagccagtaagccaggaggaacaacagccacacccaggcctatacgcgcgcgcaatggcctccgccttcttcttcgacgccgagccggactgcgagcccagcctgctgcccacgctggacgcctgcgcgctctgcgccaagccgctgggacgcgactgcgacatcttcatgtacagaggggacacgcccttctgcagcgaggagtgccgcgacgagcagatgcagctcgacgccatccgcgccaggcagcaggccgccaggtccgccgcacggaggcagcagcagcactcctccagaacggagtccaggcaccaggagtccatgaaggtatctgtggcgacctgaacggagtcctgatgactagtacaagacatcctcttgtgcagttgtgtgtcaacaagatttctgcacatgaagaaacgtcgatggagcccggcggacacaggacttcgatttctccgtcgctgntgtcctgcctgagcaccgccgat

SEQ ID NO: 43968 - protein, 96 aa, Zea mays; identical to SEQ ID NO: 8448
  misc_feature: Ceres CLONE 1445414-F
  misc_feature (8)..(63): Pfam Name: DUF581 Pfam Description: Protein of unknown function (DUF581)

SEQ ID NO: 43969 - DNA, 762 bp, Zea mays
  misc_feature: Ceres CLONE 1445424-F
  misc_feature: Encodes the peptide sequence at SEQ ID NO. 43970
  misc_feature (623)..(623): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaagtccaccttttcctcctctccgactccaccgccgtcacgccatctcgccgggggcggaaccccgaccgcgagtatggggaacatcttcgtgaagaagcccaagatcactgacgtcgatagggccatcctcaccctcaagacgcagcgccgcaagctcgcccagtttcaacagcagcttgagaaggtaatcgaagcagaaaaggaagctgcacggcagttggttcaacagaagaagagagacagagctttgattgctctgaagaagaagaaagctcacgaagagctgttgaaacaagttgacacatggcaaatgaatgttgaacaacagctggcagatattgaactagcaagtaaacaaaaggctgtatttgaaagcctgaaggctggaaatgctgccctgaagtctatacagaatgagataaacattgatgatgtccaaaagctgatggatgacacagccgaagctaaggcttatcaagatgaaataaatgctgtttctggcgagcagctttcagctgangatgaagaagctgtcatggccgantttgaaaatttggagctcaacttggcggttgagtctttcacaacgctcctgctaccgagtagggctgaagagaaacgaaagctccgctgacacagaactgctcctgagacatcat

SEQ ID NO: 43970 - protein, 186 aa, Zea mays
  misc_feature: Ceres CLONE 1445424-F
  misc_feature (16)..(183): Pfam Name: Snf7 Pfam Description: Snf7
  misc_feature (149)..(149): Xaa is any aa, unknown, or other
  misc_feature (157)..(157): Xaa is any aa, unknown, or other
MGNIFVKKPKITDVDRAILTLKTQRRKLAQFQQQLEKVIEAEKEAARQLVQQKKRDRALIALKKKKAHEELLKQVDTWQMNVEQQLADIELASKQKAVFESLKAGNAALKSIQNEINIDDVQKLMDDTAEAKAYQDEINAVSGEQLSAXDEEAVMAXFENLELNLAVESFTTLLLPSRAEEKRKLR

SEQ ID NO: 43971 - DNA, 756 bp, Zea mays
  misc_feature: Ceres CLONE 1445430-F
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaagacgatgtatgtgtagtgctgcttgtggcctctgcgcccacgctcggtcgccgtgccgacgacgcacacagcgcaaataggagcctgcgctcgcaggggccgcgcgccgagcatgcgcgccgtcgcgccggagctaacgctcgtcgtgcccgcacgcgccagggccgccggggtcggccagccagtgcgtccggggccacagcgccacgctgtggagaatcgcgtctgccgccggtgctggggctggggccgcgtccgccgcggggcatggctgtgctcgccgtggccgctgcacccgcgcccacccgcgtcgggccgtcgggggctgaaccccaagccaccgggagggccacgcccgtgcagcccgcgccgctggggccacgtgcccgcgccggggtcactcgaccacgccgtcgtggctgggtggcaagcccgagccggcggagccgacggccgtcgcgcgccatggncgggccgccgcgcccgcgcctcggccgggaaggcgcaaacgccgtgtgccatggaatgttgccgcgcctgccctgccggggtgccttgcacgcgttacgccaaggcgccctctgggggcctaaccgcttcttgggccgccaaccccaagcaccagtgggggctcggacccccccaccgggatggc

SEQ ID NO: 43972 - DNA, 750 bp, Zea mays
  misc_feature: Ceres CLONE 1445435-F
aaagctggagctccccgcggtggcggccgctctagaactagtggatcccccgggctgcaggaattcgcacgagaccattacctagaacatcctaatcgaaaagtcttctccgttcagcctccgccctccgctctgcctctgcgtcttccaccctttgccatttgcttgcaatgtctaatacctgagtgagagagcttcctcagtccatggaggtgtcgtcgaggctccaaagcctcctcagacccttcctactctgccgctcccgcgccgcagggatgaccctccaaaccctagctctttgctccccgccgcctcctccgcgcatcccatcttccttcctcctccgaacgcgccgtctacctcctccctttccccatggcggcccatcccgtcttcttttccacagcaccttcgcctccgtctccccggcccccgcccctgctccagggagggaccacctcaactccaaggaacagggacccccgcccgcgcccttgcctccgccaccgccagaggagctcgcctccgaagacgagtcctactaccacgagcaccttctcgaagtggcgcaggagaaccagtcacgggtcgtccccgtcaaggcattctttctatgcaccaggtattggttgttgagtgttagaccccctccctctctctctgctaatctgctttcttttggtggtgatgaactaacctctcgcagcatcgacctgcggagcctgcagtcccagaattcccttcatgtca

SEQ ID NO: 43973 - DNA, 699 bp, Zea mays
  misc_feature: Ceres CLONE 1445437-F
  misc_feature: Encodes the peptide sequence at SEQ ID NO. 43974
tggagctccccgcggtggcggccgctctataactagtggatcccccgggctgcaggaattcgcacgagaccattacctagaacatcctgatcgaaaaatcgagccgccgccgccgccgccgcagttgtcttcggtcttccgtgctcaccttcgagagatcaagttgctgctgcggtagtccccaaccatcatcatgcagaacgaggagggtaagacggtggacctctacgtccccaggaagtgctcggccacgaataggatcatcactgccaaggatcatgcctctgtccagatcaacattggccacttggatgcgaatggcctgtacgatggtcacttcaccacgtttgctctctctgggtttgtccgtgctcagggtgatgctgacagttcgttggacaggctgtggcagaagaagaaagctgagatcaagcagtaggtctttgcacgtagttccaccggtaatggactcttgagggatactgctctagctattggctttagctgggggggggggggagtgattctgatgtttggggctgttcgtttgttggatgaccaggttttagtttgtctggccatgctttgggtcgcagcaatctgtgccacgatgaatatcatttttgtcacctaatcttctcacatatttgggccgctaagtaattactaaaaaaaaaaaaaaaaagcttatcgataccg

SEQ ID NO: 43974 - protein, 81 aa, Zea mays
  misc_feature: Ceres CLONE 1445437-F
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVRAQGDADSSLDRLWQKKKAEIKQ

SEQ ID NO: 43975 - DNA, 774 bp, Zea mays
  misc_feature: Ceres CLONE 1445440-F
  misc_feature: Encodes the peptide sequence at SEQ ID NO. 43976
  misc_feature (455)..(455): n is a, c, t, g, unknown, or other
  misc_feature (472)..(472): n is a, c, t, g, unknown, or other
  misc_feature (474)..(474): n is a, c, t, g, unknown, or other
tggagctccccgcggtggcggccgctctagaactagtggatcccccgggctgcaggaattcgcacgagaccattacctagaacatcctaatcgaaaaacaaaacattgtaacaaactacatatactaaagtttagtacattgagagcttgtctagctagtccatggccactcaaagtccccatgttctcgttgtggatcattcccgtgttgattgccttgttgcatcgattgtcctcaatagtttcaacattcgagtaactgttgcgggaggtgccatggaagcattggaattcttagatgcgaacaacagtcatgtggaccttattttgactgactactgcatgcctgatatgactggctatgatttgctttagggaagtgaagaatccgcaagactaagcacattccaggggtgattacatgcactgatgtcataccagaaagaatctttganttgctttgagggaggancnaaggatccttgataaagcctttccaagttttctgacgggccctcgaattctaactaacttgggaggcctttggggggaaaacccaataaaagggaatggcggctaaaaacggcttttgggtaaagttttttaaaaaaacccgaaaaaccccgagggggggggccgagacccatttcccccaaaaaggggcaaaaaaatccgccccccccggggggcgctttttaaaaacccggggggtggaaaaaaccgggggttacccaaataattgtctgtgggaaaaacccctctttttgcgggggg

SEQ ID NO: 43976 - protein, 70 aa, Zea mays
  misc_feature: Ceres CLONE 1445440-F
  misc_feature: SWISSPROT Homolog: EC 2.7.13.3 Histidine kinase
  misc_feature: The sequence is a functional homolog of SEQ ID NO 932 in the 10/666,642 US patent application
MATQSPHVLVVDHSRVDCLVASIVLNSFNIRVTVAGGAMEALEFLDANNSHVDLILTDYCMPDMTGYDLL

SEQ ID NO: 43977 - DNA, 831 bp, Zea mays
  misc_feature: Ceres CLONE 1445443-F
  misc_feature (412)..(412): n is a, c, t, g, unknown, or other
  misc_feature (428)..(428): n is a, c, t, g, unknown, or other
  misc_feature (461)..(461): n is a, c, t, g, unknown, or other
  misc_feature (680)..(680): n is a, c, t, g, unknown, or other
  misc_feature (687)..(687): n is a, c, t, g, unknown, or other
aagctggagctccccgcggtggcggccgctctataactagtggatcccccgggctgcaggaattcgcacgagaccattacctagaacatcctaatcgaaaaataccttgtccgctcactgcattgctcccctaactgttcggcctggatacagcggacagggaatagatggagggcgggttcttcagcatctccaaattcctggatccagtggacgaaagattcggctgagagagggcgccctcggtcgtcgcgggcggcaccacctcctacttctccaggacgtgagcctcggagcggtgcaccatccacgcctgcgcatcgcgctcgccgtctccaccaacttgggcgttgggaaccagggggggggggtcccccccgggaattggggggatatttggggaagagggcanccttttccctccattnaaaggattggtgggcgggggattccaagggacnttaatcccccccttgccccacccagggctagatgtgtttggttagggcccagcattttggaagcccaggaggcgttgtccccacgggggaatccaaaaacttttttagaaccccccttgatggtttgttctaaactatacgaacagggacatttttcaagggtcctgcaagattcgcgcttcctcgccaacacaaaaatatgtgctttctttttctccntagacanaaaaggtgttgcctctcttgcccccgggcggtaataggggaagtgtctctgtcaccacccgcgctctgtgggagggatatctgcttttcccggtgaggaggctgtctgtctttctatcgtgtcgcaatagtggggctctctgtg

SEQ ID NO: 43978 - DNA, 739 bp, Zea mays
  misc_feature: Ceres CLONE 1445446-F
  misc_feature: Encodes the peptide sequence at SEQ ID NO. 43979
  misc_feature (308)..(308): n is a, c, t, g, unknown, or other
  misc_feature (378)..(378): n is a, c, t, g, unknown, or other
  misc_feature (391)..(391): n is a, c, t, g, unknown, or other
  misc_feature (394)..(394): n is a, c, t, g, unknown, or other
  misc_feature (398)..(398): n is a, c, t, g, unknown, or other
  misc_feature (416)..(416): n is a, c, t, g, unknown, or other
tggagctccccgcggtggcggccgctctagaactagtggatcccccgggctgcaggaattcgcacgagaccattacctagaacatcataatcgaaaaagaaatccccatcccaagcgagggttttgctgctgctccagccggacccaggacgagaagaagcggcgcgatggcggtgggcgacctggcgttcaaggcgctgacggctgggctgggcgtcgccacgctctacctcgccgccaccttctccgtcaacgtctaccgcggcctctcgtggcactccgagcagtccaagctagaaaaggcgaanaccgaagattgaaaaagaccagcaagcagttttagagagcagatgaaaggcgggcatttttggtgatgtnctatctttcgggncantggngtttttgctggtccccgnagaccttttcagatatctggagtgtatctttcagtatgtgatttatatatttccgattccagaacctgcctgggatgatttttcctctttccggaccctcccgggtttgaatctttaataccaccttcccaaatgttttggggaaaaaaaaaaaaaaaaaggttttctttccccccccccccgggggggggcccgggacccaattcccccctaaaggagggccaataaacccgccccccggggcccttttttaaaccgcgggggggggagaaacccgggggatacccaaaaaatccccgggggaggaccccccctctttccgc

SEQ ID NO: 43979 - protein, 50 aa, Zea mays
  misc_feature: Ceres CLONE 1445446-F
  misc_feature (47)..(47): Xaa is any aa, unknown, or other
MAVGDLAFKALTAGLGVATLYLAATFSVNVYRGLSWHSEQSKLEKAXTED

SEQ ID NO: 43980 - DNA, 775 bp, Zea mays
  misc_feature: Ceres CLONE 1445452-F
  misc_feature: Encodes the peptide sequence at SEQ ID NO. 43981
  misc_feature (334)..(334): n is a, c, t, g, unknown, or other
  misc_feature (337)..(337): n is a, c, t, g, unknown, or other
  misc_feature (365)..(365): n is a, c, t, g, unknown, or other
  misc_feature (385)..(385): n is a, c, t, g, unknown, or other
ggagctccccgcggtggcggccgctctagaactagtggatcccccgggctgcaggaattcgcacgagaccattacctagaacatcctaatcgaaaaactcacgaacgcacgaattcaccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaacaagccgaagtgccctctgaagacgtcgtcgaggtggtggtgagtccgcctttcgtttttctgcancangtccgggggctgctgcggctggacttcnccgtcccagcgcaaactgcntggtggcgcagggcggccccttccccggcgagtcagggctaaaatgctggaaacctgcaggggcttgggcattttggaacttctaaccccaaacttggttggggaaaaccggagttttgtgccgaaaaattggaattcccctcccccaggcccccgggaattttttttttttgaaacccctttccaaagagagggcggaaacaatggggtttttgtggccaaaaaaaggtgtttgtgaaaaaaaataaaagagaaaaaattgggggggtaaaaaaaactttgtgttttttgcccaacaaaaactctccccctctcccccccgggtttttttgtaaaaaaaaacccccccccccaccccccccccctataaaaaaaaaaaaaatagggggg

SEQ ID NO: 43981 - protein, 42 aa, Zea mays
  misc_feature: Ceres CLONE 1445452-F
  misc_feature: SWISSPROT Homolog: EC 5.3.1.1 Triose-phosphate isomerase
MASRKFFVGGNWKCNGTGEDVKKIVTVLNKPKCPLKTSSRWW

SEQ ID NO: 43982 - DNA, 722 bp, Zea mays
  misc_feature: Ceres CLONE 1445456-F
  misc_feature: Encodes the peptide sequence at SEQ ID NO. 43983
  misc_feature (482)..(482): n is a, c, t, g, unknown, or other
  misc_feature (502)..(502): n is a, c, t, g, unknown, or other
  misc_feature (527)..(527): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (559)..(559): n is a, c, t, g, unknown, or other
tggagctccccgcggtggcggccgctctagaactagtggatcccccgggctgcaggaattcgcacgagaccattacctagaacatcctaatcgaaaaaccagacttgcagctccacaccagcaacagcgcgacgatagctagctagtagtagaagcaggcagcggctctagttgtcgagcgttccacaggtcatcaagcaccggcgtttaattagccatccgctccgatcgtcccctcccctattcccatggccagtttcgctgctcaggtcatggacatgttcttcgtgctcgtcgagcgcgtcaccggctacggcggccacgctgaggacgaccagaaggacgcttcaggtgcacatgagcccaccaagctgctgacatcgtctggcgtttctgaaaccgaacaaggaaaagaagaggtggtcgttgcggtgcagaatgttcagataagagcaagagggggcggcgaaccctttgtgcanggtggctcgatgcctcaggntaattagcactgcatgcatgcgggntttgtagaggtnnnatagtgccgctgcctcangtgatcgagcttcgcagacgatgatgcgtttaatttgcagccagggtttttaccctttttcatgcaaggatgtgtgggtgtgtggttgtccggatcgtggtttccccgtttcctttcttctgattgaattaagagtatgtcttgtccaggtctattcaagttg

SEQ ID NO: 43983 - protein, 86 aa, Zea mays
  misc_feature: Ceres CLONE 1445456-F
  misc_feature (78)..(78): Xaa is any aa, unknown, or other
  misc_feature (85)..(85): Xaa is any aa, unknown, or other
MASFAAQVMDMFFVLVERVTGYGGHAEDDQKDASGAHEPTKLLTSSGVSETEQGKEEVVVAVQNVQIRARGGGEPFVXGGSMPQXN

SEQ ID NO: 43984 - DNA, 738 bp, Zea mays
  misc_feature: Ceres CLONE 1445463-F
  misc_feature: Encodes the peptide sequence at SEQ ID NO. 43985
  misc_feature (293)..(293): n is a, c, t, g, unknown, or other
tggagctccccgcggtggcggccgctctatcaactagtggatcccccgggctgcaggaattcgcacgagaccattacctagaacatcctaatcgaaaagttcccttcgttgcgtcttgaaaggggagagagagagagagaagagagagagaagagagagagagagagaggagtgggagacccgcgagaggctgccgtgtagggaccgtagactcagcgactgcgaaggagggataaggggatggccgggatcggaccgatcatgcaggactgggagccggtcgttgtgcggangagggcacccaccgccgccgccaagaaggatgagaaggccgtcaacgccgcgcgccgcgccggtgcggaaatcaataccaggaaaaatacaacgctggtacaaaaaggggggccccccccgtaaattcccttcaaaccaagggcgccgaaccaaaaacccgaaaaccccctcccgggagggtgttccagtggttttgaaaaaaatacttcttgaaccaggggcctaataaagtgtggaccggggccactcttgtcaaatagaaaagggaaaccccccgggggttccgaggagggacgctaggaggcggtttcccccaccttaaaaatctccatctccttttaggggcctgggacccctctttgtggtgtcacaaatcacctcccccaaaatttttctttcgccgccctacttggggggataaagtcgggggcggccctcccatgt

SEQ ID NO: 43985 - protein, 58 aa, Zea mays
  misc_feature: Ceres CLONE 1445463-F
  misc_feature (18)..(18): Xaa is any aa, unknown, or other
MAGIGPIMQDWEPVVVRXRAPTAAAKKDEKAVNAARRAGAEINTRKNTTLVQKGGPPP

SEQ ID NO: 43986 - DNA, 758 bp, Zea mays
  misc_feature: Ceres CLONE 1445467-F
  misc_feature: Encodes the peptide sequence at SEQ ID NO. 43987
  misc_feature (426)..(426): n is a, c, t, g, unknown, or other
atagctggagctccccgcggtggcggccgctctagatttagtggatcccccgggctgcaggaattctcacgagaccattacctacaacatcctaatcgaaaaatccccctccctcgccccctcactgctctcgctttcgctcgccatccgccgtcccgctccgcacaccggccctgcccgatgccttcgcccgccgcggccgcggcggcgcctttccaccgcatcgcatgcgcgcgtcagcacctccctcaaacccgtctcttcttcctcccatcccgcgcgctgctcaaatccgaccgcctcaccgtcccggctccgctgcgcgtccacgcgctgaggctgcctccgacggtgccacgggcggtaagccacgatgccgccacgggcgtgagatcacccacatctggcggccatatcccccccccncatcccgccgcacccgctcataaagcattgggtctccgtgctgcgcaacgaacagacaccctgcgtcatcttcaagagtgccatggcagagcttggtcggctgctcatatacgaagcatccagagattggttgcctacaatcacaggagagattgagacacctgtacctgtagctagcgtagaatttattgatccaagagagcctgttctggttattccaatactgagagctggtcttgcactagctgaacttgcttcatcagttctggcagccacaagacttaccacttcggctttcctagggatgaaagaacgcttcaaccttcaatatc

SEQ ID NO: 43987 - protein, 83 aa, Zea mays
  misc_feature: Ceres CLONE 1445467-F
  misc_feature: SWISSPROT Homolog: EC 2.4.2.9 Uracil phosphoribosyltransferase
MAELGRLLIYEASRDWLPTITGEIETPVPVASVEFIDPREPVLVIPILRAGLALAELASSVLAATRLTTSAFLGMKERFNLQY

SEQ ID NO: 43988 - DNA, 697 bp, Zea mays
  misc_feature: Ceres CLONE 1445469-F
  misc_feature: Encodes the peptide sequence at SEQ ID NO. 43989
aaagctggagctccccgcggtggcggccgctctagaactagtggatcccccgggctgcaggaattcgcacgagaccattacctagaacatcctaatcaaaaaaacccagacgcggcgggctcggccgcggcgtgggctggtcctcagtcctcttccgttcttcctcctcgctcccgccccctcgcgcccctcgcctttcagttttggatgccacggaggcctgccagtggtgggccaccgccgtacgcgcgcgacgatgccggtgaagcgttcggcgtccgcgctggcgctcccgccggtcggccgccgcgcgcgggcccgcctctgcatccgcctcgccgcgccgctctccttcctgctcctcttcgtggcgctgttccacgcccagccgctcctgggcgttccgcccgctgcgcagccgccctccgcggggcccggtaaggtcgccttccttttcctcgtccgcgcgggggtgccgctcgacttcctctgggacgccttcttccgcaacggcgaggaggggaagttctcggtgtacgtgcactccgcgccggggttccagctcgaccgcaccaccacgggatccccatacttctatgggcggcaacttgcgaggagcgtcaaggtggtgtggggcgaggccaccatggtggaagcagagaggatgttgtttgcccgcgcgcttcaggatcccgcg

SEQ ID NO: 43989 - protein, 147 aa, Zea mays
  misc_feature: Ceres CLONE 1445469-F
  misc_feature (32)..(147): Pfam Name: DUF266 Pfam Description: Arabidopsis protein of unknown function, DUF266
MPVKRSASALALPPVGRRARARLCIRLAAPLSFLLLFVALFHAQPLLGVPPAAQPPSAGPGKVAFLFLVRAGVPLDFLWDAFFRNGEEGKFSVYVHSAPGFQLDRTTTGSPYFYGRQLARSVKVVWGEATMVEAERMLFARALQDPA

SEQ ID NO: 43990 - DNA, 718 bp, Zea mays
  misc_feature: Ceres CLONE 1445470
  misc_feature: Encodes the peptide sequence at SEQ ID NO. 43991
aagccaagctagcacatccatccaggtcatccatcagctcttccctctgctcacaactcacaagcaacagttctgttggagcttatcaatctctcgattcccaggaggaacggaaccaaaggtctgctggtcgcgcgcgtgccactagtcaggagacgggatgggcaaccttgtctcgcagtgcgtcgggaacggtgccggcgcgcggcctctggtcatcggggcgacggacggcagccgaacgatggtcgaggagaacaccgtggtcgcggagctgatgatcgacgcgccggggcacgtggttgctcgcgccacggacgtggcgagggagcgacggttgcgggcgatggcggccgacgaggtcctgcgcgctggcgtggtgtacctcctcgtgccggcaggccgggccggtgcgcggctaggcggccgtgaggtcgaggccatcgggcggctggtctctgggaagaagggttcgaggaagagcaggacccgcggcggcaggagggtctttccggacgtcagcgccgaggaggacgcggctgaaagaaaggaggttgtgtgtgctgttaaacgggcccatgatcatggatttgggcccaggcaatggaggcccgccctggataccatctatgaggcctagattttttcttcttattagagagaataggaaaccccattctttggtttatatgtttaggaactaaaaaaaaaaaaaaaa

SEQ ID NO: 43991 - protein, 159 aa, Zea mays
  misc_feature: Ceres CLONE 1445470
MGNLVSQCVGNGAGARPLVIGATDGSRTMVEENTVVAELMIDAPGHVVARATDVARERRLRAMAADEVLRAGVVYLLVPAGRAGARLGGREVEAIGRLVSGKKGSRKSRTRGGRRVFPDVSAEEDAAERKEVVCAVKRAHDHGFGPRQWRPALDTIYEA

SEQ ID NO: 43992 - DNA, 709 bp, Zea mays
  misc_feature: Ceres CLONE 1445473-F
  misc_feature: Encodes the peptide sequence at SEQ ID NO. 43993
aagctggagctccccgcggtggcggccgctctagaactagtggatcccccgggctgcaggaattcgcacgagaccattacctagaacatcctaatcgaaaatttgcactttgcagtcgatctcagccagccatcctcctgcagtcctgctatcgtcaccctgcaggctctttcttgattccgaggtctggataaatcttggatctggagcccagactcgctctcatgaactcagactacaccaccaacaagggcgccaacgggcggccgcatggcaagaagaatcaagcgttggctcggcccaaggcgacgccgtccaagtgggacgacgcgcagaaatggcttgtgggcatgtcgaacggccacgcggacggaacccacggtgccagagtcaagcctaggagctctaacgccgacgacaggcgcctcctcggctcggcctcgcagaacggccgcgtgtcctgcagcagcgtggatggcgccttggagtacagcatggtggtggccgcgccctcgacaccgccgcaggccgccgagggcggcggcgacatggaggaaaccaagaagatcgactgcatggtgcagctgcatgactcgccccaagcggtgatgcggtccgtgtgcctgcgggacatggggacggaaatgacccccatcgccagcaaggagccgtccagaacacccacgccccggcgcgcctgcacgcccgt

SEQ ID NO: 43993 - protein, 161 aa, Zea mays
  misc_feature: Ceres CLONE 1445473-F
MNSDYTTNKGANGRPHGKKNQALARPKATPSKWDDAQKWLVGMSNGHADGTHGARVKPRSSNADDRRLLGSASQNGRVSCSSVDGALEYSMVVAAPSTPPQAAEGGGDMEETKKIDCMVQLHDSPQAVMRSVCLRDMGTEMTPIASKEPSRTPTPRRACTP

SEQ ID NO: 43994 - DNA, 705 bp, Zea mays
  misc_feature: Ceres CLONE 1445480-F
  misc_feature: Encodes the peptide sequence at SEQ ID NO. 43995
  misc_feature (354)..(354): n is a, c, t, g, unknown, or other
  misc_feature (451)..(451): n is a, c, t, g, unknown, or other
acccgcggtggcggccgctctagaactagtggatcccccgggctgcaggaattcgcacgagaccattacctagaacatcctaatcgaaaaatccttatcccccacgattccttctctcctctcttgcgccgccgctggcccagcgcggccgccgtgctccttctccactcgtgcttcccaagctgcttcgccggaagcaatgcgagggccctgccccggtggaggcgtctcggcgtcttttgccccgagcttcaacggctcccgcgccatgatctggccggcaacagtaaattgcacgagacggatccgcatttcattcatccaaacagccaaaacgggggccgttccgcgcangcgacagggctacgggaagaaattgctatgctagccaggcggttgaatttgctgccactttgtaccctgaaatcgtggttcgagacgcacggctcgnagaactgctggaaagtgctgaaactcctgcagctcggtctttccttggtaacaattcccggtggaacctgtccccggaatgaacgtaacattgccctcctcccggaattttcagttccccccgttggataaaaattgccttggggccctcaaatcaaatctggaaaaagaattcccacccccgggggggaaatgcccaaaggcacctttaaaaaaaacacctcaaaaaagccccccaaaggggatttttacctt

SEQ ID NO: 43995 - protein, 62 aa, Zea mays
  misc_feature: Ceres CLONE 1445480-F
  misc_feature (52)..(52): Xaa is any aa, unknown, or other
MRGPCPGGGVSASFAPSFNGSRAMIWPATVNCTRRIRISFIQTAKTGAVPRXRQGYGKKLLC

SEQ ID NO: 43996 - DNA, 722 bp, Zea mays
  misc_feature: Ceres CLONE 1445481-F
acccgcggtggcggccgctctagaactagtggatcccccgggctgcaggaattcgcacgagaccattacctagaacatcctaatcgaaaattttttccacctttccctccctcccctgaaccttctcaatctcccctccccacgtggagtatatcacccatacgcagacgccacacgcgcaagcacatgaaccaccaccatcccggcggctcccacttgctcttgctccccttcctctcctcgctctgatcctcctccagtgcactgctcccgtccgggcgactcgctgccggcccgggcgctcccggggcaggcgggctgtcatagggagtggcctgcgtgtatggtgattggtagctggcaggccacaataatatcttctctctggggctatttcccccatttgtcatcagctcttgaaatccaaagcgtgtcaaaggctggaaaaaaatccctccagggtgaaaaaatcaccaaaaaccccttggggccttggttttcttcgcaaaagggaaatcccaagggctgcttaatttcgggccccccgggggaaggttttacaaaacccttaaacaccccgggaaagagaaaacctttttttttggggaggcccccttttgggggttttcgccgctcccaaaaaaaaaggggcaaaaaattttctcccccccccaaaaaggggggggcccccgggggggggcaaaaaaaaagggagtttgtgg

SEQ ID NO: 43997 - DNA, 724 bp, Zea mays
  misc_feature: Ceres CLONE 1445482-F
  misc_feature: Encodes the peptide sequence at SEQ ID NO. 43998
tggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctttctgtaggggactactttgcttgtgtcttgttagtactgaaaaccagagcactcctacctttttgcatcagtagccactaaatgtggcagat

SEQ ID NO: 43998 - protein, 133 aa, Zea mays; identical to SEQ ID NO: 13146
  misc_feature: Ceres CLONE 1445482-F
  misc_feature (14)..(123): Pfam Name: Ribosomal_L32e Pfam Description: Ribosomal protein L32

SEQ ID NO: 43999 - DNA, 737 bp, Zea mays
  misc_feature: Ceres CLONE 1445483-F
  misc_feature: Encodes the peptide sequence at SEQ ID NO. 44000
  misc_feature (351)..(351): n is a, c, t, g, unknown, or other
  misc_feature (352)..(352): n is a, c, t, g, unknown, or other
  misc_feature (364)..(364): n is a, c, t, g, unknown, or other
  misc_feature (385)..(385): n is a, c, t, g, unknown, or other
  misc_feature (387)..(387): n is a, c, t, g, unknown, or other
  misc_feature (434)..(434): n is a, c, t, g, unknown, or other
aagctggagctccccgcggtggcggccgctctagaactagtggatcccccgggctgcaggaattcgcacgagaccattacctagaacatcctaatagaaaacctctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctcccacatctcccgcgtctccgtcaccgttggctaccctctcgggatcnnagcggggatccngggcccgtcaatggtcacggncngcctcatcggggtcatggaaggggttatgtacccctaccaaactccngccggcggcctaaggggattcttccccaacgaagcaaaggttgcggctcaaaccaaactttattggggaaccgttcctttccgcctcttttttcaaacctttcccggggtcctttccgaaaccggggaaaattagaattttttggggggcctttggggcctggaaaaaaaaaagggtttttttgtcccccttaaaaaaaataaaaaaaaacacccccctcctttgtttttgggggaaaaacccccccccccgggggaaaaatataaaaaagaggatttttccttcaaaaaaaaaaaaaaaatt

SEQ ID NO: 44000 - protein, 125 aa, Zea mays
  misc_feature: Ceres CLONE 1445483-F
  misc_feature (54)..(54): Xaa is any aa, unknown, or other
  misc_feature (58)..(58): Xaa is any aa, unknown, or other
  misc_feature (65)..(65): Xaa is any aa, unknown, or other
  misc_feature (66)..(66): Xaa is any aa, unknown, or other
MNTDITASTKPEYPVVDRNPAFTKVVGNFSALDYMRLSHISRVSVTVGYPLGIXAGIXGPSMVTXXLIGVMEGVMYPYQTPAGGLRGFFPNEAKVAAQTKLYWGTVPFRLFFQTFPGVLSETGEN

SEQ ID NO: 44001 - DNA, 794 bp, Zea mays
  misc_feature: Ceres CLONE 1445487-F
  misc_feature: Translation starting site: 155
  misc_feature: SWISSPROT Homolog: EC 5.2.1.8 Peptidylprolyl isomerase
  misc_feature (268)..(268): n is a, c, t, g, unknown, or other
  misc_feature (321)..(321): n is a, c, t, g, unknown, or other
tggagctccccgcggtggcggccgctttataactagtggatcccccgggctgcaggaattcgcacgagaccattacctagaacatcctaatcgaaaagaggaaggaaggttccagcgaccgcggtcgtggagtaggactgtaggagaaagcgcgatggggaagaagcggcagcttatctgcctcgcagccgccgtcgccgccgcggccatcctcctgacagcgtcggccaagaagtccagcgacgtcaccgagcttcagatcggcgtncagtacaaacctgagtcatgtatccctgcagcacacaaaggagacaaaattanggtcattatcgtggggcactcactgacggatcagtttttgattctagctttgacagaggtggacccgtttgatttacctcttgaaaatgccaaagtgataaaaggttggaaccaaggattgctaaggattggcccccggggaaaagcggaaccctaaataccttgcaaaaagggttatggggaagggaggctccccccccaaaaaatcccgggggaagacatttgggtttcccaccgggattttatcccccccaaggggaaaaccttgggggggggggacccccaacaagggagggggccttttaacccccgtttgtgggggagggttctcctccccgggggaaaaaaaaaaaacccccttttttttttttgggcccaaaaaagagtgtttttttgttctcccttcccgggcggggttttttttttataagaaaatatcccgcgggggggtttcttttttttttgtgtgggga

SEQ ID NO: 44002 - DNA, 772 bp, Zea mays
  misc_feature: Ceres CLONE 1445488-F
  misc_feature: Encodes the peptide sequence at SEQ ID NO. 44003
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (334)..(334): n is a, c, t, g, unknown, or other
  misc_feature (353)..(353): n is a, c, t, g, unknown, or other
  misc_feature (377)..(377): n is a, c, t, g, unknown, or other
  misc_feature (406)..(406): n is a, c, t, g, unknown, or other
aagctggagctccccgcggtggcggccgctctagaactagtggatcccccgggctgcaggaattcgcacgagaccattacctagaacatcctaatcgaaaaatttgcattcggatctggtttagacgggatgagcaacccgggggcaccggacaccgtcactgagtcagcggagctggtcctgccgttgttgccgccgcaggacctcgcggccgcggcatcggcctgccgcgccctccgcgcggctgtgactgctgtcactgcgcgccgcgccggggacgtcgcacgtggcctaaagccgctcccccatccgnnntcgcactacgtcgattccnagcccctatgctactttcntgtatacccccctctccctcaccnggttgggtcccgggggcttccgcccccanggccaaaccggggggggccccctgaaaccgggcccccccccccaatgggcccccccccaacctccaggggttacaatcccccggtaaaggggccctgggcccccccccaaaaagtgggggaccccccgggcccggccccacatggaaaccaaaaaaaccgcttcttcttttttgggcggggggggggcccccccccggggggggggattttccccggggggcccccctttgggagacccacagccacacccccgctttttttgggggttgttttcccccccccccacacaagaggggggggggggggttcttaaaagaaaccccctctgggggggtgttgggtgggcaccccaccccatattatta

SEQ ID NO: 44003 - protein, 75 aa, Zea mays
  misc_feature: Ceres CLONE 1445488-F
METKKTASSFLGGGGAPPRGGGFSPGGPPLGDPQPHPRFFWGLFSPPPTQEGGGGVLKRNPLWGGVGWAPHPILL

SEQ ID NO: 44004 - DNA, 647 bp, Zea mays
  misc_feature: Ceres CLONE 1445496-F
  misc_feature: Encodes the peptide sequence at SEQ ID NO. 44005
tccccgcggtggcggccgctctagaactagtggatcccccgggctgcaggaattcgcacgagaccattacctagaacatcctaatcgaaaaacaggtcgcaacaaccccccaccgtgagggacgcgaccaaacacacgcccctcttcgcacctcccaccaaccccgacgagcggcgatgaccggcacggtgtccaagctggcggcgccccgtccggcggcaccgccgctccggccggcgtccctccgcaccgccgccctcgccttcgccccttccccgcgccgagtccgcgtttccgtcgccgggcgagccaggagccccatcattgcgatggcttcggccaaggaaggaagcggtgcaccgaccaagaggactgcgcttcatgatctctacgagctccagggcctgtccccgtggtacgacaacctatgccgccctgtcacagacttgctgcccattatcgccagcggcgtccgtggagtcaccagcaacccaacgattttccaaaaggccatttcatcgtccagcgcatatgatgatcagttcaagcagctcatttcggcaggaaaggatgcggagagcgcttactgggaactcgttataaaggatatccaagatgcgtgcaaactttttgagcccatctacgac

SEQ ID NO: 44005 - protein, 106 aa, Zea mays
  misc_feature: Ceres CLONE 1445496-F
  misc_feature: SWISSPROT Homolog: EC 2.2.1.2 Transaldolase
MASAKEGSGAPTKRTALHDLYELQGLSPWYDNLCRPVTDLLPIIASGVRGVTSNPTIFQKAISSSSAYDDQFKQLISAGKDAESAYWELVIKDIQDACKLFEPIYD

SEQ ID NO: 44006 - DNA, 728 bp, Zea mays
  misc_feature: Ceres CLONE 1445504-F
  misc_feature: Encodes the peptide sequence at SEQ ID NO. 44007
tccccgcggtggcggccgctctaattcaataagatcccccgggctgcaggaattcccacgagaccattacctagaacatcctaatcaaaaaaccaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgccaccactacagaaaagggaattggatcaaaagtggtggatatgtacaaaggaggcttttgaaagcatcgaggatcccgaagtacgtcgacacagttactccccagtacaagccaaagtttgatgccggtgattgctgaattaagggaggctgagaaagagcctctaaagggggtccgaaagggttgagaaaggaccttgcctaaaatgggggaattggggaaaaagttccttcccatggcccgccaaggattttctttggaaaggccccttgaccccggaaaaaattttgccgaaaaaaccccaacccaaaaccggaggaatt

SEQ ID NO: 44007 - protein, 111 aa, Zea mays
  misc_feature: Ceres CLONE 1445504-F
MSGNGAKKVVDAAVKAGRTIIDWDGMAKLLVTDEARKEFAALRRAFDDVNHQLQTKFSQEPQPIDCHHYRKGNWIKSGGYVQRRLLKASRIPKYVDTVTPQYKPKFDAGDC

SEQ ID NO: 44008 - DNA, 1177 bp, Zea mays
  misc_feature: Ceres CLONE 1445511
  misc_feature: Encodes the peptide sequence at SEQ ID NO. 44009
atattatattcgcgcaccatcgcagcaacttgcacgggcgccgatgactagttgcgccagatgcactgcatctgctcggcgtggtgcctccaacgtccaacccctcttcctcttgtctctcgtctacctctcttctgcccctctgcgtccgtgtctccatcgtcgtcgctgcgtgaggttgacgacgaccagtcacaggatctgttcgttcctcatgcgacccagctagctaaaactggcatgcatggacatgctacgctgctgcgtcaatccatctcaccagtgctagctagctagatctggcctgattcgccgatcgagcggtggtgagacggagtgcttcagctcaaagactgctagtggtaggctggtagctagctgtgtgcctgtgtgcagtgtgcactgccactgcatgcgcggcgccttggacttaagacggcagcacacgcacgcgaggaggcgtcggctgaagcgagcgctccggcggctccgcttcgctcatcaggttcttgagccccggaaacgatgagcacgacccggccggaggacacccagcaactgatcaacagtgccgccgctagccccaaccgcagcgcaccgtccgccgcgcccagcgatatggagaggggcagcggaaccgccgcgtcctcgtcgcgcgcttcgacgacgtctcactcccaccagagggccacccacagggtggtggaggaggaggaggaggaggagcctagtagcagccgtggcggcggcagcctctgctccgggtacctgtcgctcccggctctgctgctcgtcggcgtcaccgcgtcgctggtgatcctcccgctcgtcctgcccccgctgccgccgccgccgtcgatgctgatgctggtccccgtggcaatgctgctcctgctgctcgtgctggcgttcatgcccacgtcgtccaccggcggccgcggtggaaccggaccgacctacatgtagataatcacatcggttttttttttcctttctttctcttgtcgtcctttcgtttggattttgtgacagagggaggtcttgcgatggatcagttagtcctcagcttctgctcttctcgatcgtacgatgtctctgttcggctaattaatttgcataggggtatatatatgctgcctagatcttaaaagtatttaacccaaaaaaaaaaaaaaaa

SEQ ID NO: 44009 - protein, 146 aa, Zea mays
  misc_feature: Ceres CLONE 1445511
MSTTRPEDTQQLINSAAASPNRSAPSAAPSDMERGSGTAASSSRASTTSHSHQRATHRVVEEEEEEEPSSSRGGGSLCSGYLSLPALLLVGVTASLVILPLVLPPLPPPPSMLMLVPVAMLLLLLVLAFMPTSSTGGRGGTGPTYM

SEQ ID NO: 44010 - DNA, 723 bp, Zea mays
  misc_feature: Ceres CLONE 1445513-F
  misc_feature: Encodes the peptide sequence at SEQ ID NO. 44011
  misc_feature (413)..(413): n is a, c, t, g, unknown, or other
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaaacatcgcactctcctccagcctccaggcttggcaagcgtgcttcaacatgaccacatccatgtcgaacagcgccgctagcgagaagcaagcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggctcnncccacctcccccagttcagggcgttccacgcgctccgcggccgccgccttggacgacgacgccaaactccgggccgccttccacctctacaacgtccacggcgacggccgcctcacgtctgccaagcttgggcaaggggtccgcgtcccttggggaagggccgatgccacctcctaagaaggccaaccggatgggtcgccgggctcaaagccaaacggcttccaccgggttcgcaggattttcaaaaaaaagaatggtgcccccacctcaaagccaaaacccgggggcccccgggggcggaaaaaggaa

SEQ ID NO: 44011 - protein, 187 aa, Zea mays
  misc_feature: Ceres CLONE 1445513-F
  misc_feature (29)..(57): Pfam Name: efhand Pfam Description: EF hand
  misc_feature (85)..(85): Xaa is any aa, unknown, or other
MSNSAASEKQAQQAGHRQRPPAASAADAEMQRVFCRIDADGDGRISASELAAVTRAISPPASSSHGRREVAAMMDELDTDRDGSXHLPQFRAFHALRGRRLGRRRQTPGRLPPLQRPRRRPPHVCQAWARGPRPLGKGRCHLLRRPTGWVAGLKAKRLPPGSQDFQKKEWCPHLKAKTRGPPGAEKG

SEQ ID NO: 44012 - DNA, 676 bp, Zea mays
  misc_feature: Ceres CLONE 1445518-F
aaagctggagctccccgcggtggcggccgctctagaactagtggatcccccgggctgcaggaattcgcacgagaccattacctagaacatcctaatcgaaaactcgatccctctacctctcgcatccggtgcctggctgccagccccagcgctcgccaacctcatcttccccggcgtttcctcccagctccctccaccatgccgctgccatggaactcactgctcggccgcgccctggccatgctccctgcgctcgccagccgtgcgcatctccctctgcgcgcgcgcgcctgcgtcctgcgccgcgaaccccgccgtggagcttccccgagctcgccccatggcgcccggccgagctcctccctgccgtgttcttgctcggcgtccggttttcctgtgcgccacggtcttcctccccgagctcgccccagccccttgtattccccatggccggagcttcttccagctccagctcggatccctctcccatggctctctgcgtgctagccgctgcgcgcccatctatctctcgcggatctccctccccagctcctctctgctcgtgccgtcgcccagcctgttggcgcgcgcatgctcctctcgccgcgcccccctgcttctcttcctccccttctctccttgctgcgtgcgccctgcgctctgctcgcagcgccgc

SEQ ID NO: 44013 - DNA, 667 bp, Zea mays
  misc_feature: Ceres CLONE 1445528-F
  misc_feature: Encodes the peptide sequence at SEQ ID NO. 44014
ggagctccccgcggtggcggccgctctagaactagtggatcccccgggctgcaggaattcgcacgagaccattacctagaacatcctaatcgaaaaagggattcctacctagggaggcccgacgtagccatggatttcctgacagacaaaagcgtccagaccacaatgggcatcgccgtggctgtcaccgccgccgccgcaggctgaggcttccccccccttcaatccacgaagaacaacggctgctaggatcctgagaacttcaagacagttcacacttgtcgaaaagaagcaaatcattcataatgttgccctgctcaagttcgctcttcacaactactacttctgtatgtgcgccttccaaactggcaacatatcagctgcacagcacaagacgatgcaggtgaagacagaatcaagccttatacccctactacattggatactgagcctgcatattgtgagcttgtcataacgatgtatccccaagggagaatgtcccatcatttccgagagatgaaagatcgtgattatctgcctgtaaggggaccaaaaggccgattccaatctgacgttggaccactgagaacatttggaatgctggctggtggatcaggcattactccaaagtttctagttgcaacagcagttcttgacatcccgtatg

SEQ ID NO: 44014 - protein, 63 aa, Zea mays
  misc_feature: Ceres CLONE 1445528-F
  misc_feature: SWISSPROT Homolog: EC 1.6.2.2 Cytochrome-b5 reductase
MYPQGRMSHHFREMKDRDYLPVRGPKGRFQSDVGPLRTFGMLAGGSGITPKFLVATAVLDIPY

SEQ ID NO: 44015 - DNA, 675 bp, Zea mays
  misc_feature: Ceres CLONE 1445537-F
  misc_feature: Encodes the peptide sequence at SEQ ID NO. 44016
aagctggagctccccgcggtggcggccgctctagaactagtggatcccccgggctgcaggaattcgcacgagaccattacctagaacatcctaatcgaaaaactcagtggcacgggcgcggacgctgccgctcgcgatatttgcgagagagaagagagggcccgagagccgaggacgagtgcagtctggctggcgtgatgctgcttcggagcgcgtcctcgccgctgctcaactgcgggcgcgcgccggctgcggcggcgtcgatcgagcacctcgcggtggtttcgccgttgttgtcaccggcgttggcggcgcctaggcaggggccggtgctgtgccgcgccatgtccgagggggacctcgccgcgccgctcgtgcccaagaaggacgatggacacgggagggcgccgaggctgtcggcgtccttgtcctcgtccgcctccatcttcgtcgaggaggacggcgagggcgaggaggaggcggaggacctggtcgcggtcgcgggggccggcgtggacgtgccgctgccgctgcgtcggctgctgacgaacacggggctggacgtgtccgccgccgcggcgctggcgttcgtggagcagggcggcaggggcgggaaggcgtgcggcagcacggcggcaagggtgggggtcggagacggcgactgtggcagcaacc

SEQ ID NO: 44016 - protein, 159 aa, Zea mays
  misc_feature: Ceres CLONE 1445537-F
MLLRSASSPLLNCGRAPAAAASIEHLAVVSPLLSPALAAPRQGPVLCRAMSEGDLAAPLVPKKDDGHGRAPRLSASLSSSASIFVEEDGEGEEEAEDLVAVAGAGVDVPLPLRRLLTNTGLDVSAAAALAFVEQGGRGGKACGSTAARVGVGDGDCGSN

SEQ ID NO: 44017 - DNA, 711 bp, Zea mays
  misc_feature: Ceres CLONE 1445541-F
  misc_feature: Encodes the peptide sequence at SEQ ID NO. 44018
  misc_feature (428)..(428): n is a, c, t, g, unknown, or other
cagagctggagctccccgcggtggcggccgctctagaactagtggatcccccgggctgcaggaattcgcacgagaccattacctagaacatcctaatcgaaaacgtacgagaccgttatctagaacatcttaattgacaaactcaggaggccgttctttcctttattggctgggtgatcgctaggatgattccggcctccgccgccggcgagcgagatgaacttcaagggcgcgtggatgccgagcgcgtcggcgggctcgtgcacactggtcaatctcgggctggatgggggtgctgctgtctagcacggtcacctgacccgtctacacctctagggaggccgccggcgccgcacgccttcaccgttaccaggggagtaagaacaatggctaccctttatgggactcacattcatcctcaccccccnccaagaggcccatcatcttagacgtgcgcttgaggacccaacctcgtcgagactgcctgctgaagcctggatctccagatggtgagaactggccttcgggttcttacacgacccaggccatactagactaccgcctatgtgcaggaccctggtgtagaactacggtcagagagtgttgcctatgatcatgcttgcatggctcatggctgtggttgcccaatacgctgctcgtcaccgtctcactcaaagagaggctgtgagcacggagatcacgaagatgctg

SEQ ID NO: 44018 - protein, 29 aa, Zea mays
  misc_feature: Ceres CLONE 1445541-F
MNFKGAWMPSASAGSCTLVNLGLDGGAAV

SEQ ID NO: 44019 - DNA, 690 bp, Zea mays
  misc_feature: Ceres CLONE 1445573-F
  misc_feature: Encodes the peptide sequence at SEQ ID NO. 44020
  misc_feature (419)..(419): n is a, c, t, g, unknown, or other
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaaaaaaaaaaacactattttccaaacaacttcaagttctcggcaatgcattttgggccggctcggcccttgacccatgagtagcctgatccgcttgctcttcaccctcgccgcggccatcggcgcggcctcgctcctcgtcgcctcactccgccgccgcgcgccgcctcccgggcttcccgccaagctcgtcccctcctcccacatggcaggacgcaaccggagtttcgtgctgtggctgcacggcctcggcgactcaggcccggccaacgagcccatccgcaacctcttctccgccccggagttccggctcgccaacnggncgttcccctccgctccccgcgcccccgtatcatgcaacaatggttttgtcatgccgtcgtggttcgatatccacgagcttcccatgagcgctggctctccccaagatgaaactggggttctccaggctggggaaaaagggcccgccatgatagacagggaagaagcccagggcatcccccccgaaaacaaattttgtttgtgattccagccaaggaggggccccaaacatagccagggttttgctttaccccaaaaagtttgggggga

SEQ ID NO: 44020 - protein, 106 aa, Zea mays
  misc_feature: Ceres CLONE 1445573-F
  misc_feature: SWISSPROT Homolog: EC 3.1.1.1 Carboxylesterase
  misc_feature (39)..(39): Xaa is any aa, unknown, or other
  misc_feature (40)..(40): Xaa is any aa, unknown, or other
MAGRNRSFVLWLHGLGDSGPANEPIRNLFSAPEFRLANXXFPSAPRAPVSCNNGFVMPSWFDIHELPMSAGSPQDETGVLQAGEKGPAMIDREEAQGIPPENKFCL

SEQ ID NO: 44021 - DNA, 625 bp, Zea mays
  misc_feature: Ceres CLONE 1445586-F
  misc_feature: Encodes the peptide sequence at SEQ ID NO. 44022
cgctctataactagtggatcccccgggctgcaggaattcgcacgagaccattacctagaacatcctaatcgaaaaatccaccatcatcctctgccttgtcgatcatccatcgaccgcctcctgctcggcttcccaccccgcctgcgttgcacaccagggaggagctcctccgaccggccatgagctaccaggctcctcctccgggcacctcagcctacccgccgccgggcacggcctaccctccgccaggccagccgcaggcgtacccgccgccggcatacggcgcgccgccacccatggccgccggcgggtaccctcccccgccgcagcaggactctaaggcccgccacgacggcttcctgaaaggatgcttggccgctctctgccccccccgcatgctcgacatgtgcttctgagttcgtcgtcaggggctcatggcacggggaatgcgcgcctagagtccagactgatctccatcatgcatccaggcggaaaacaatgcatggagctgttttttttccattctgaaccttgacgatgatacattctttggttccgttttcctcccggtaaacgcacttccccgaggcacgcatggaaactttccctagcgtcccccagtagg

SEQ ID NO: 44022 - protein, 78 aa, Zea mays
  misc_feature: Ceres CLONE 1445586-F
MSYQAPPPGTSAYPPPGTAYPPPGQPQAYPPPAYGAPPPMAAGGYPPPPQQDSKARHDGFLKGCLAALCPPRMLDMCF

SEQ ID NO: 44023 - DNA, 655 bp, Zea mays
  misc_feature: Ceres CLONE 1445592-F
  misc_feature: Encodes the peptide sequence at SEQ ID NO. 44024
aagctggagctccccgcggtggcggccgctctagaactagtggatcccccgggctgcaggaattcgcacgagaccattacctagaacatcctaatcgaaaatctcttagttattcttccagcagcagttcgcccaaatccattgccgctcctgcccccaacggcgcatgccttcatctcctcagccatggagctcacgagcacctccctctgcgcaccccctccgcgcgtccctgctccctcgtcaccaggtgcacgtgcgcagcttcctgcgcgccgggatggccctctagccccagctcgcccctgccctcagccatggcgcctggccgccgccgcccctgctttccatggcagcacttcctgcttcctggtggtcggcgccctccccaacatctctgctggtggttgtctccatcccctccatggcgagctcgcccctgcattcctgctcgcccaagatccccttccctgttccagccacctcctatggacgccagccctcacctcatagtcgcccagccccctctctgctggtggccggccacctctgctgcttccatggtgtggcacttagggtatttaagatagagtggaatatttcagcacatcacacaccaggtgttcggtgaaaggtccaagccaaaagtcgtcgt

SEQ ID NO: 44024 - protein, 90 aa, Zea mays
  misc_feature: Ceres CLONE 1445592-F
MAPGRRRPCFPWQHFLLPGGRRPPQHLCWWLSPSPPWRARPCIPARPRSPSLFQPPPMDASPHLIVAQPPLCWWPATSAASMVWHLGYLR

SEQ ID NO: 44025 - DNA, 657 bp, Zea mays
  misc_feature: Ceres CLONE 1445602-F
  misc_feature: Encodes the peptide sequence at SEQ ID NO. 44026
aaagctggagctccccgcggtggcggccgctctagaactagtggatcccccgggctgcaggaattcgcacgagaccattacctagaacatcctaatcgaaaaatctccgcatttccatcttcccgtgggatcccagccgccgccgcaagaagaagagctcggggacttccaggtgtcgcgagaagatgccgaagcagatccacgagatcaaggatttccttctcaccgcgaggaggaaggatgcccgatcagtgaagatcaagaggagcaaggatgttgtcaagttcaaggtccgctgctccaagtacttgtacaccctctgcgtattcgacgctgagaaggcaaacaagttgaagcaatctctccccccaggcttgagcgtccaggaggtttgattggatacatggcaacgtcgggtcgaacctctagggcatctttatcattagcagagcatgctgtttatgtagttttggaccttaagctattagacatgtcagtgttggatttgtggatcttgaatttttggagaaataccaatttgcctcgttcaaggacgcacctttcagttttttcttatttaactgcatgttccccttcgcaacttagctctgcaaacttactagatttttgtggttttatatgtatcccatgtggata

SEQ ID NO: 44026 - protein, 69 aa, Zea mays; identical to SEQ ID NO: 5090
  misc_feature: Ceres CLONE 1445602-F
  misc_feature (2)..(69): Pfam Name: Ribosomal_L38e Pfam Description: Ribosomal L38e protein family

SEQ ID NO: 44027 - DNA, 723 bp, Zea mays
  misc_feature: Ceres CLONE 1445603-F
  misc_feature: Encodes the peptide sequence at SEQ ID NO. 44028
  misc_feature (345)..(345): n is a, c, t, g, unknown, or other
  misc_feature (346)..(346): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagaacatcctaatcgaaaactccgtcggcgacgagcctgggcgaccagcgccgccgcccctagcccaggtctccatcggacgcttcgccaggtcttgtttagacccaccgccggcaacgagcaactcttgttatcggatcccgcatcgtggaatgcttgccaaagggaggaaggtagctggcaggcgtgaagaaatgtctgcaaattatgcgtttggaccacaggatgatgatgcgattattaaacacaggcttctgactanngacacgaccaccaggggtgaaccgcccactaaagaagcttcagagaaagtcatgtcctttgcaactgagatcgagaaggatgcagatnacataagtgactgtgaaagactgtaacaagcctttctacatgaaatttaacacctggaactacctcttctgaaaagcaaggctggggttgatgcaaacttagggaaaaaaaaaacttttatgaacctcccgttgaatttaacggcaaatcttgctgccaaaacggaatttggagactttaaaaacaacttttgcccaaacaaattttaaggggccccaaaaaaaaggtggacccccccccaaaagttttttttttggcccccccccgggaaaaaaaaaaaaattttggg

SEQ ID NO: 44028 - protein, 74 aa, Zea mays
  misc_feature: Ceres CLONE 1445603-F
  misc_feature (37)..(37): Xaa is any aa, unknown, or other
  misc_feature (67)..(67): Xaa is any aa, unknown, or other
MLAKGRKVAGRREEMSANYAFGPQDDDAIIKHRLLTXDTTTRGEPPTKEASEKVMSFATEIEKDADXISDCERL

SEQ ID NO: 44029 - DNA, 665 bp, Zea mays
  misc_feature: Ceres CLONE 1445619-F
  misc_feature: Encodes the peptide sequence at SEQ ID NO. 44030
  misc_feature (530)..(530): n is a, c, t, g, unknown, or other
ctccccgcggtggcggccgctctagaactagtggatcccccgggctgcaggaattcgcacgagaccattacctagaacatcctaatcgaaaagtcgagaacgaatgctgtctcttcttcccttctatcgagaagctgcccgcgcgctccctccgtagagtccaaaccgccacaggaagcgcaacagcggagtctccaaaatggccgccgaggacaaggagaccgactcgccgcagccgccggcgaagctgccccgtctctcctgcgccgacacgagcgccggagtggcggcctcgtcgccgctggttctcgggctgggcctggggctcggcgggggcgggggcggcgagcgagacgcggatgcgtccccggcaacggcgacgccgcccaagaggccgtcagcgctgacgttcatgcagcagcaggaactggagcaccaggtgctcatctaccgctacttcgcagcgggcgcgccggtgccggtgcaccttgtgctccctatctggaagagcgtcgccgcgtccctcctcnggccgcaacgcttcccctcgctgatgggcctggggagcctgtgcttcgactaccgcagcagcatggagccggagccccggccgtgccggcgcacggatgggcagaagtggcggtgctcccgcgaccgtggtgccg

SEQ ID NO: 44030 - protein, 155 aa, Zea mays
  misc_feature: Ceres CLONE 1445619-F
  misc_feature (67)..(103): Pfam Name: QLQ Pfam Description: QLQ
  misc_feature (111)..(111): Xaa is any aa, unknown, or other
MAAEDKETDSPQPPAKLPRLSCADTSAGVAASSPLVLGLGLGLGGGGGGERDADASPATATPPKRPSALTFMQQQELEHQVLIYRYFAAGAPVPVHLVLPIWKSVAASLLXPQRFPSLMGLGSLCFDYRSSMEPEPRPCRRTDGQKWRCSRDRGA

SEQ ID NO: 44031 - DNA, 664 bp, Zea mays
  misc_feature: Ceres CLONE 1445628-F
aaagctggagctccccgcggtggcggccgctctagaactagtggatcccccgggctgcaggaattcgcacgagaccattacctagaacatcctaatcgaaaacagaggatctcgttccagccgcggcagggcgcacaacaccggcacctcatgggcgccgacgacgacgccgccgccgccatggaggcgcaagagagggaggcggagatcgagaaggccatgcgcgcccgcgtcgcagacttcaagaagcaggccgagtgagcacactctctccccttcctccaacttccgaggctggtgtgaccgccctgcccctcgtctatggtttgcacgctctaatgttcaggtctatggcgtatggaattgggtcgcttctcgtggccacgtttggtctgccgttgcttgctgcggagaaacgtgcactgcgggagggttttgggctagtggggcggtctcgggggtagggtttctacttctgctgtcctggtaggagatgaaggcgagcggcgatgatgaatcctgaaacatggtcttccgaacgggtggtgcacgtctcagtcgcagttggcagctcctagggttttagagggtaggaggaaaaggaaatcccagatatcaactggcaatactagaaggctactgaatcctgtaagaaaccctttat

SEQ ID NO: 44032 - DNA, 699 bp, Zea mays
  misc_feature: Ceres CLONE 1445640-F
  misc_feature: Translation starting site: 432
atagctggagctccccgcggtggcggccgctctagaactagtggatcccccgggctgcaggaattcgcacgagaccattacctagaacatcctaatcgaaaagtggagaggtcacgcggctggttcccgccgcttccggacgggttccgagggaggaggatcagctgccgcgatgttcctcaggatctctcgtctcggggcgcggcttctgcgcgagtctggagcgcacacgagagctggaaatttgctaagccagtccaggcattttgtatcaagctcatcttaaccagcattcgaccagagtgcgcaatgtccttttctcaactgcaacaagtggtgatcaggatgaaagcagtcaggcaaaggataaaatctcagtaacatttgttaacaaggatggctcagaaaagacaataccccccccccttggaatgcccatgttagaagctgctcatgaagatgacatagagcttgaaggagcatgtgagggttcacttgcctgtactactgggcatgcagtaccaggggatgcaactgctataacaaattagaagatccccctcatcgagaaaatgacctgcttgaccttgcagttggggctccccgaaaccatgctcgcctcggttgccaagggaatccaaaagcccggaactcgatgggtttccgcctgggccttagcctgaagccaccacaaacctg

SEQ ID NO: 44033 - DNA, 645 bp, Zea mays
  misc_feature: Ceres CLONE 1445651-F
  misc_feature: Encodes the peptide sequence at SEQ ID NO. 44034
  misc_feature (473)..(473): n is a, c, t, g, unknown, or other
ctggagctccccgcggtggcggccgctctagaactagtggatcccccgggctgcaggaattcgcacgagaccattacctagaacatcctaatcgaaaagggcatgtttaccatcagcagcaccccacatgttccgcagggctgcaggcgacgatgtggcgacgccgtgtctaggccgagatcctacctcgtctgccaaagtcacctcccgtccgggccgccggcaagcggcggcggcgggggaggtggtgggtgaggagaagacgaccccgtggtgggctgccacggccgagaggctgcgcggcgacgtggtgaaggccgggatggcggcgcgggagagcctgagccccaagcagaagggggactggaaggacgtcacgctcatgagcttctccttcgccgtctacgtgtacatctctcagaagctcgtgtgcacgtactgcgcttggctctctatgataaccactgacttgntgctgtatcatcgataccgttgctgatcttcaggtagaacagattgtgctgttagtgcataggatgctgtacctgtagtaaatttagatcccaatccaataaagcctcatttccattgtaaaaaaaaaaaaaaaacttttcgataccgtcacctcaaggggggcccgtacca

SEQ ID NO: 44034 - protein, 123 aa, Zea mays
  misc_feature: Ceres CLONE 1445651-F
  misc_feature (116)..(116): Xaa is any aa, unknown, or other
MFRRAAGDDVATPCLGRDPTSSAKVTSRPGRRQAAAAGEVVGEEKTTPWWAATAERLRGDVVKAGMAARESLSPKQKGDWKDVTLMSFSFAVYVYISQKLVCTYCAWLSMITTDLXLYHRYRC

SEQ ID NO: 44035 - DNA, 654 bp, Zea mays
  misc_feature: Ceres CLONE 1445655-F
  misc_feature: Encodes the peptide sequence at SEQ ID NO. 44036
  misc_feature (287)..(287): n is a, c, t, g, unknown, or other
  misc_feature (288)..(288): n is a, c, t, g, unknown, or other
  misc_feature (621)..(621): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
gcggtggcggccgctctagaactagtggatcccccgggctgcaggaattcgcacgagaccattacctagaacatcctaatcgaaaaacatccaaaattcccagtccgcgatacaagaccaatccaatccaatccaatcccagcggaagtggaagcagcttcatttccttccttgcagctagcagcgatgattcttgtggcgatagtggcggagctgctcgaggagtacaccgcgctggtggcgcgggtgctggagcagctgctcaacgacgcgccgtcccgcgccgnnggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccaccaactagcctgcgcttgaggcagctagtagagaaactggagggtgaccaggaacccacggggggttccccgcttcccttggccggggaattccatgggggaaaaaaaaaaaaaaaaaaatttttctttccgcgccccccgggggggggggcggggcccccccccccatgaagtatttgncggggnnngcccgcggggcggttttaaaaaggg

SEQ ID NO: 44036 - protein, 141 aa, Zea mays
  misc_feature: Ceres CLONE 1445655-F
  misc_feature (34)..(34): Xaa is any aa, unknown, or other
MILVAIVAELLEEYTALVARVLEQLLNDAPSRAXGCASSCCGASPSCRRLCPRRRRRTPSTLPPESDYWLHFSQGFQPTARHGRPPTSLRLRQLVEKLEGDQEPTGGSPLPLAGEFHGGKKKKKKFFFPRPPGGGAGPPPP

SEQ ID NO: 44037 - DNA, 663 bp, Zea mays
  misc_feature: Ceres CLONE 1445656-F
  misc_feature: Encodes the peptide sequence at SEQ ID NO. 44038
  misc_feature (350)..(350): n is a, c, t, g, unknown, or other
  misc_feature (357)..(357): n is a, c, t, g, unknown, or other
  misc_feature (359)..(359): n is a, c, t, g, unknown, or other
  misc_feature (360)..(360): n is a, c, t, g, unknown, or other
  misc_feature (366)..(366): n is a, c, t, g, unknown, or other
  misc_feature (368)..(368): n is a, c, t, g, unknown, or other
  misc_feature (369)..(369): n is a, c, t, g, unknown, or other
  misc_feature (453)..(453): n is a, c, t, g, unknown, or other
  misc_feature (497)..(497): n is a, c, t, g, unknown, or other
ggagctccccgcggtggcggccgctctagaactagtggatcccccgggctgcaggaattcgcacgagaccattacctagaacatcctaatcgaaaatccattcctcctcctgtcctccacccaagccaaagcccctcggatcggatccggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttncctctcntnnctctcntnncgcacacgacgccgcggtccgtgctggcggcggcgccggcgccggcgctggagatcccgcgcgggagctggagggcgtgctgcngcgcctggggcacgcggagcgtccgacgcgagctcgacgccgtnccgcgctccgcggcaaccccccgcgtgggacgcgaagcccaccccaaggggacctcatggagggtttcccggtgtcaacccggaggggaaggccccctccccgccaagaattccccgccgtcctggaaccgtcctcgggggggggggaaccttaaaaatggccccc

SEQ ID NO: 44038 - protein, 153 aa, Zea mays
  misc_feature: Ceres CLONE 1445656-F
  misc_feature (49)..(49): Xaa is any aa, unknown, or other
  misc_feature (52)..(52): Xaa is any aa, unknown, or other
  misc_feature (55)..(55): Xaa is any aa, unknown, or other
  misc_feature (98)..(98): Xaa is any aa, unknown, or other
MKLSIQSLARKLSLPSPKRGGGGIVEDGKKKKKRSLSRGEAPSFASSSXLSXLSXRTRRRGPCWRRRRRRRWRSRAGAGGRAAAPGARGASDASSTPXRAPRQPPAWDAKPTPRGPHGGFPGVNPEGKAPSPPRIPRRPGTVLGGGGTLKMAP

SEQ ID NO: 44039 - DNA, 692 bp, Zea mays
  misc_feature: Ceres CLONE 1445661-F
  misc_feature: Encodes the peptide sequence at SEQ ID NO. 44040
  misc_feature (569)..(569): n is a, c, t, g, unknown, or other
  misc_feature (671)..(671): n is a, c, t, g, unknown, or other
ctggagctccccgcggtggcggccgctctagaactagtggatcccccgggctgcaggaattcgcacgagaccattacctagaacatcctaatcgaaaacctattctttctctctcacgctaaatggatgggcacgctacgccgcattcctcccccgcagccgcttcttcgcccacacgctcgcgcgctcggaatactccgaggagggtgctcgaggagggcgacgatccggccacttcctgctcgcctcgccgccggtcccgcgccccggagccctagagctctccccgcggcgggaccgccagagtcctcgggcgcgtggagaaaatggaggcggcgctggaggcggcgcgcgccaaggacaccaaggagcgtctggccggggtcgagcggctgcacgaggtgcttgacgtcgcgacgcgtcgcgggctgacggcggccgaggtcaccgcgctggtggacccctgcatggatctgacgcgggatgccaacttccgcatcgcccagggcggcctcccagcgctctccgtcgccgctgtcgtcgccggcgaccactttcagatccacctncactccctcgtctccgccgctgtcgagcgcctcggcgacagcaagcagcccgttcgcaacgccgcgcgccagctcctcatcacgctcatggaggagatgtancagcacatgggatcacaattt

SEQ ID NO: 44040 - protein, 122 aa, Zea mays
  misc_feature: Ceres CLONE 1445661-F
  misc_feature (115)..(115): Xaa is any aa, unknown, or other
MEAALEAARAKDTKERLAGVERLHEVLDVATRRGLTAAEVTALVDPCMDLTRDANFRIAQGGLPALSVAAVVAGDHFQIHLHSLVSAAVERLGDSKQPVRNAARQLLITLMEEMXQHMGSQF

SEQ ID NO: 44041 - DNA, 686 bp, Zea mays
  misc_feature: Ceres CLONE 1445667-F
  misc_feature: Encodes the peptide sequence at SEQ ID NO. 44042
ggagctccccgcggtggcggccgctctataactagtggatcccccgggctgcaggaattcgcacgagaccattacctagaacatcctaatcgaaaactccctcgctctctcagccgccactgtagaagcttcgaggctgctgctgcgcccatggtcgcggaagccaagacgccgtccctcgatgaggaatattcacttcccccacaggaagttccagtgaaaaaggcagctgacgagaagccctctagtggtactgagactgaatctgctccttcaaccaatgatgagactccttcatctgtagaagataagaatgaaacgtctgaagtacaagatgctgctgaaaagtcatacgcataagaaactaacactgctgcagaggaagcaagtgagactgccgaggaggaagagcctcacaaacctgacatcaagattgaaacagctccagcagattttcgtttcccaacaacaaatcaaacgaggcattgtttcacacgctatgttgaaaacaacgggagtgtggctgcaaaaggtaaggatgcccctaagtgtgataagtttgccaagtactatcgatccctgtgccccggtgaattgggttgaaccctgggaaccagcaccggggaaaatgggcacccttcccttggaccttttgaataccctcattgcaaaacagattaagggac

SEQ ID NO: 44042 - protein, 69 aa, Zea mays
  misc_feature: Ceres CLONE 1445667-F
MVAEAKTPSLDEEYSLPPQEVPVKKAADEKPSSGTETESAPSTNDETPSSVEDKNETSEVQDAAEKSYA

SEQ ID NO: 44043 - DNA, 579 bp, Zea mays
  misc_feature: Ceres CLONE 1445675-F
  misc_feature: Translation starting site: 147
  misc_feature (325)..(325): n is a, c, t, g, unknown, or other
tccccgcggtggcggccgctctagaactagtggatcccccgggctgcaggaattcgcacgagaccattacctagaacatcctaatcgaaaagctcctcactgccgcgccgccaccctctacagataaggaagaggaggagggcaggatgtcgcaccgtaagttcgagcacccgaggcacggctccctcggcttccttcccaggaagcgctccctcccgtcaccgcggcaaggtgaagtcattccctagggatgacgccaagaagccttgccatctcactgccttccttggctacaggctggcatgactcacattgtccgtgaggntgagaagccaggatccaactccattagaaggaaactgtggaggctgtacatcattgaaccccctctcctgtcattgtggggctcgtggcaatgggaagaactcctcgtgccctccgcacactcactctgtttgggcccacctcttacccaaaaaatgaggaaaaggtcttccaaaaaacgggggccaaaaccaaaaaaaaaggcttttccccaaaggtaggcccccccaatataaaaaaggaagcgggggaaag

SEQ ID NO: 44044 - DNA, 667 bp, Zea mays
  misc_feature: Ceres CLONE 1445676-F
  misc_feature: Encodes the peptide sequence at SEQ ID NO. 44045
  misc_feature (330)..(330): n is a, c, t, g, unknown, or other
  misc_feature (635)..(635): n is a, c, t, g, unknown, or other
ctccccgcggtggcggccgctctagaactagtggatcccccgggctgcaggaattcgcacgagaccattacctagaacatcctaatcgaaaaaaatgggtattcaaagaaccatctgaatctgaacccaatcttgctaattactggcagagttcttttgatgctattcctccagaatggcccgaccaatttgaatcaggcatccagacaattgctgtgattcaagcaggacatggtctgttacagctaggttcttgcaagattattcaagaagatcttcattttgcgctgaggatgaggcaaatggttgaatcaatcggttatcaatcangtttatacctcttctcttcaatggaaccgctgctactccatcggggggcggcagttcaaaccagcagcttcaatcccaggtttttactgaggatcacattctccgttgttgccttcctctagcttccaaacccactacctgcatcaacaaaatatgatttccttcaagaaagcattgcttcccccagtggaagaaccagaagacgacctccaatgggccccaagggttaacctttgttcaatgcattgactgggccctgcagaagaaacctagttagcccccccgaaccaaaaccaaatgaattntccgaaaaacccgaaccgaaattgttgaaccc

SEQ ID NO: 44045 - protein, 149 aa, Zea mays
  misc_feature: Ceres CLONE 1445676-F
  misc_feature (110)..(110): Xaa is any aa, unknown, or other
PRGGGRSRTSGSPGLQEFARDHYLEHPNRKKWVFKEPSESEPNLANYWQSSFDAIPPEWPDQFESGIQTIAVIQAGHGLLQLGSCKIIQEDLHFALRMRQMVESIGYQSXLYLFSSMEPLLLHRGAAVQTSSFNPRFLLRITFSVVAFL

SEQ ID NO: 44046 - DNA, 643 bp, Zea mays
  misc_feature: Ceres CLONE 1445677-F
  misc_feature: Translation starting site: 159
  misc_feature (308)..(308): n is a, c, t, g, unknown, or other
ctggagctccccgcggtggcggccgctctagaactagtggatcccccgggctgcaggaattcgcacgagaccattacctagaacatcctaatcgaaaaaaaaatcggtctatctatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtnggaggtggtgcgcctggctccacaccccaagtacaagcgccgggagcgcatcaagaagaagtaccaggcgcacgaccccgacaaccagttcaaggtcggcgacgtcgtcgagctccaaccctcccgtcccatctccaagaccaagcacttcctcgccatcccgctcccgccccgcgacactcgccgcaagtctcagctcctaccgccgctccagtccgacgacgaccaggagccgtcctcgcgagagtgattgattgtgattgattgctgcctgtctatggcttcgtcgtaagctcctctccatcagaggtgctgcttcccaattccaaatgcga

SEQ ID NO: 44047 - DNA, 633 bp, Zea mays
  misc_feature: Ceres CLONE 1445678-F
  misc_feature: Encodes the peptide sequence at SEQ ID NO. 44048
  misc_feature (633)..(633): n is a, c, t, g, unknown, or other
ccccgcggtggcggccgctctagaactagtggatcccccgggctgcaggaattcgcacgagaccattacctagaacatcctaatcgaaaaaaaaatcggtctatctatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggtgtatgaccccgacaaccagttcaaggtcggcgacttcccccacctccaaccctgccgtcccatctccaagaccaagcacttcctcgccaccccgctcccgccccgcgacactcgccgcaagtctcagctcctaccgccgctccagtccgacgacgaccaggagccgtcctcgcgagagtgattgattgtgattgattgctgcctgtctatggcttcctcgtaagctcctctccatcagaggtgctgcttcccaatttccaatgcn

SEQ ID NO: 44048 - protein, 132 aa, Zea mays
  misc_feature: Ceres CLONE 1445678-F
  misc_feature (37)..(105): Pfam Name: Ribosomal_S17 Pfam Description: Ribosomal protein S17
MLLLSSPFVSVSPPPPPLSSHGARPALRIEAARQLTGRVVTTKADKTVGVEVVRLAPHPKYKRRERIKKKYQVYDPDNQFKVGDFPHLQPCRPISKTKHFLATPLPPRDTRRKSQLLPPLQSDDDQEPSSRE

SEQ ID NO: 44049 - DNA, 649 bp, Zea mays
  misc_feature: Ceres CLONE 1445680-F
  misc_feature: Translation starting site: 110
  misc_feature (621)..(621): n is a, c, t, g, unknown, or other
  misc_feature (622)..(622): n is a, c, t, g, unknown, or other
  misc_feature (649)..(649): n is a, c, t, g, unknown, or other
gcggtggcggccgctctagaactagtggatcccccgggctgcaggaattcgcacgagaccattacctagaacatcctaatcgaaaacctcaccccccgtcgtcccaggcatggccccaacgagagcgctgcccgccctctggttgtccatggccgccgccgccagctatgtcgtcggagaaaagtactgcaggttgtgctatctgaagggcagttccatggtccccactatccaagcccagggcgacgtcgggctgctggaccgccgctgccttgccggctacgacttctcccacggcgacgtcgttgttttcaggtcagctgctgcgcgcagccggactctccttggcgtttcttcggttggatgggtcggccggcccgctgatgccatcccgttcgcatcgcaggttgtcgacggatcatgggatgaagatggtccagaggctgatcgcgctgccgggggattggatccagatcccggagaagcgggacatccggcaggtccccagcggccactgttgggtggaaggggacaatgccggcaacagctgggactcgagacactatggccccgtaagggcattctccctaacatcattcttagcagattttcgtcaatctnngtcagttctttctttacaagaactgcn

SEQ ID NO: 44050 - DNA, 679 bp, Zea mays
  misc_feature: Ceres CLONE 1445681-F
  misc_feature: Encodes the peptide sequence at SEQ ID NO. 44051
tggagctccccgcggtggcggccgctctagaactagtggatcccccgggctgcaggaattcgcacgagaccattacctagaacatcctaatcgaaaagcttctgggatggctgcatttatgcaggcacactgctgccggcagccacgactggatgaaaggacggaggggtactagtaaaaccagttatgtgtggctggctcgtgcagcggcggcacgcggcagtgatagccatgatcgcggcggcggcgagctcggtcaccaagatcatcaagtgcgtcacggacggcgatggggccgtcaggaagacctgcatgctcatctgctacacctgcaacaagttcccctcggattatatctccaccgtatttgacaacttcaacgccaatgtctccgtgggagggagcatcgttgacttccgcctctgggactctgttgacaggagtattaacagcacgtttgaggctctcaactacaggggtgccggatgtgttcatcctctccttctccctgagtcgcatggtctacctatgacaacgtcctccaacaggtgcatgccagagcttcccccgattttcacctactgttcctgtatttctttgtcgaacccaaactagattctccgtgaagacagatcttaccttgctgacccttctgctgcttccatcatcactaccgaaa

SEQ ID NO: 44051 - protein, 142 aa, Zea mays
  misc_feature: Ceres CLONE 1445681-F
  misc_feature (29)..(121): Pfam Name: Ras Pfam Description: Ras family
MCGWLVQRRHAAVIAMIAAAASSVTKIIKCVTDGDGAVRKTCMLICYTCNKFPSDYISTVFDNFNANVSVGGSIVDFRLWDSVDRSINSTFEALNYRGAGCVHPLLLPESHGLPMTTSSNRCMPELPPIFTYCSCISLSNPN

SEQ ID NO: 44052 - DNA, 715 bp, Zea mays
  misc_feature: Ceres CLONE 1445687-F
  misc_feature: Translation starting site: 128
  misc_feature: SWISSPROT Homolog: EC 3.2.1.147 Thioglucosidase
  misc_feature (397)..(397): n is a, c, t, g, unknown, or other
  misc_feature (680)..(680): n is a, c, t, g, unknown, or other
acagctggagctccccgcggtggcggccgctctagaactagtggatcccccgggctgcaggaattcgcacgagaccattacctagaacatcctaatcgaaaaatatggagggtggttaagcgcgaagatggcggacttgtttacagactatgctgacttctgttttaagacctacggcgatcgcgtaaagcactggtttacattcaatgagccaaggatagtagcgctacttggctatgacacagggtcaaatcctcctcaaaggtgcaccagatgcgctgctggtgggaattcagcaaccgaaccttacatagttgctcataattttctcttggcacatgctactgcagttgcaagataccgtacgaaatatcaggctggggggagggtaaggtcngaatagtcctgaacttcaactggtacgaggctcttacaaactcacctgatgaccaagcagcaccccaaagagccagggacttccacattggctggtttgttgatccattgataaacggacactatccacagataatgcaagatctcctgaaggagaggctcctcaggttcactcctgaccaggctaaactggtgaagggctccgccaacatacatcgctatcaaccgagtacccatccgggttcctgaaggggccgaagctgggcccgcctggcgccctacanctattctgccgattgcgggggtcaataggtgtttc

SEQ ID NO: 44053 - DNA, 662 bp, Zea mays
  misc_feature: Ceres CLONE 1445697-F
  misc_feature: Encodes the peptide sequence at SEQ ID NO. 44054
tggagctccccgcggtggcggccgctctagaactagtggatcccccgggctgcaggaattcgcacgagaccattacctagaacatcctaatcgaaaaatcacgtctcgcatgttgcgcactggccggcgggcggcgccgctcagctctttcctataaatagggcacaggccacagggaagaagggcaccggccggtgttggtttaagcttgtattcccacactctgtcgcagcgtcgcccgtcgccgctgagatcctagctaggaagaaatggagctctctcgcaagctcttcacggccgtcctcctcgtcatgctgctgctgctgtccgcagaggtcgggccggtggcggtggcggaggcgcggacgtgccagtcgcagaaccacaggttccggggcccctgcctccgccggtccaactgcgccaacgtctgcaggaccgaggggttccccggcggcaggtgccgcggcttccgccgccgctgcttctgcaccacgcactgccactgattcgctcgcccagcggccggctggcgtcgccgtcgatcgcgcgcgtcgcgaccagtccatggctccatgcatgaataacaagggtgtgcggtttgtgatgccaaattgtatcctctcgtcgtgtgttgaagcgttcgatcgtcggtctagtag

SEQ ID NO: 44054 - protein, 79 aa, Zea mays
  misc_feature: Ceres CLONE 1445697-F
  misc_feature (32)..(78): Pfam Name: Gamma-thionin Pfam Description: Gamma-thionin family
MELSRKLFTAVLLVMLLLLSAEVGPVAVAEARTCQSQNHRFRGPCLRRSNCANVCRTEGFPGGRCRGFRRRCFCTTHCH

SEQ ID NO: 44055 - DNA, 661 bp, Zea mays
  misc_feature: Ceres CLONE 1445706-F
  misc_feature: Encodes the peptide sequence at SEQ ID NO. 44056
  misc_feature (335)..(335): n is a, c, t, g, unknown, or other
  misc_feature (376)..(376): n is a, c, t, g, unknown, or other
ggagctccccgcggtggcggccgctctataactagtggatcccccgggctgcaggaattcgcacgagaccattacctagaacatcctaatcgaaaaatccagtctccgtgtccagtcgagtctcagcaaggaagatgtgggggaaaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaangacggcaagactctccccacccgcaaagttatatcactccnattagatcagtggaagatactgaaggacaacttcaagccctttatggaggcaatcgaagaaaattactgatggggagccgccaacattcccgggagcggggagctttttgcttctttcctgttttgaggccctgatgtacgaaaatattttttgttgcccttaggcgggccgggtgctttttggccctttgccccccccttttttttagggggcccctgggccaaaaggtttttttcttccccccccgtttataaaaaaatttaaagggggggggggggaggatt

SEQ ID NO: 44056 - protein, 103 aa, Zea mays
  misc_feature: Ceres CLONE 1445706-F
  misc_feature (1)..(103): Pfam Name: PC4 Pfam Description: Transcriptional Coactivator p15 (PC4)
  misc_feature (67)..(67): Xaa is any aa, unknown, or other
  misc_feature (81)..(81): Xaa is any aa, unknown, or other
MWGKGKKRFGGGGSGEPAAKRQAARDDGPSESAEDGTVVAEISKNKKVSVRSWKGRVFVDLREFYFXDGKTLPTRKVISLXLDQWKILKDNFKPFMEAIEENY

SEQ ID NO: 44057 - DNA, 664 bp, Zea mays
  misc_feature: Ceres CLONE 1445712-F
  misc_feature: Encodes the peptide sequence at SEQ ID NO. 44058
ctggagctccccgcggtggcggccgctctagaactagtggatcccccgggctgcaggaattcgcacgagaccattacctagaacatcctaatcgaaaaaacaaaaggcgcaagcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtccacatcgttgagggcaggtccatggcgtccgccgacgcgcctgaggccgacgaaccatcacacgggcctgactccccctcgtcaccggactcctcgtcagatgcaccctccagcagtagatcctcggaatagatagctagccgctcgacacacgatctccctctccccccacacagcgatcgagttctagctttgtcggcatgcaatgcaaaattccgattcttccggaataatcaagctccaaaggaatgtgcttgtctcactcactactagtaccttgttttaatatatgtttcctctcctgaccctctccgattttaatcttcacgtatgcaacatatgtgatgaatggaaaaatcaatttgtatttgttagtcagaacagcctgttataccaactccgtccggttttctgaaa

SEQ ID NO: 44058 - protein, 70 aa, Zea mays
  misc_feature: Ceres CLONE 1445712-F
MARAYVFLVVLLLAAVIVAPFAGATRVHIVEGRSMASADAPEADEPSHGPDSPSSPDSSSDAPSSSRSSE

SEQ ID NO: 44059 - DNA, 652 bp, Zea mays
  misc_feature: Ceres CLONE 1445713-F
  misc_feature: Encodes the peptide sequence at SEQ ID NO. 44060
  misc_feature (215)..(215): n is a, c, t, g, unknown, or other
  misc_feature (375)..(375): n is a, c, t, g, unknown, or other
ggagctccccgcggtggcggccgctctagaactagtggatcccccgggctgcaggaattcgcacgagaccattacctagaacatcctaatcgaaaatcacccagcaccgcagagctctcatcctctctctctctctctttctcgcgctcgctttgcttcctcgtcgaggtccaagttcctgcattgatggcgaccgagggtggctgagactcccngcgccgttggcggaggcggtccccgagacccccgcggaggcaccggcggcgcccgccgccgaggcgaagcctaccaaggccaagaaggcctctgcgcccaagaagcgtgccaacccgaccccacccgccgtacgccaagatgatctcggaggctgtcacntcccccaaggagccgaacggggtccagccagttaccccaccccccattttctccaagaacaaccccaagggacagctccccgccccaatttccccaaggctcctgggtcggcccgcctaaaaaagtcctttccccgggggcaacctctcccagggggaaaaaccctcctaaaggtggcccggaacggcccccgggggccgcccccaaagcccaaacccccaaactcccaaaacccctgttgaaaaaaaccccccgggggcgggggccccaaaaaacc

SEQ ID NO: 44060 - protein, 46 aa, Zea mays
  misc_feature: Ceres CLONE 1445713-F
MISEAVTSPKEPNGVQPVTPPPIFSKNNPKGQLPAPISPRLLGRPA

SEQ ID NO: 44061 - DNA, 665 bp, Zea mays
  misc_feature: Ceres CLONE 1445718-F
  misc_feature: Translation starting site: 201
  misc_feature: SWISSPROT Homolog: EC 6.1.1.19 Arginine--tRNA ligase
tggagctccccgcggtggcggccgctctagaatagtggatcccccgggctgcaggaattcgcacgagaccattacctagaacatcctaatcgaaaatacagatgttggtcctcagcagcactttgacatggttttaagtgctcgccacatggccggttggctcccacatcacggtgaaaaaaagtttccgaaaacaagccatgttggatttagtcttattcttggttcacatggcctgcggctccgaacccacagagactgaggttgttcgattggtatatctacttgatgaggctcaatctcggagcgaatgggaactaccacgacggctcactgaaaatggcaaaattgttggctggacggatgaagaattagaccaaacttcacaggatggtggatatggtgctgagaggtacgctgatctacaaaataacaggctcactaattatgcatttaattttgaactaatgctgagcgataaggaaaatactgctgtgtaccttcagcatgcacatgctcgtatttgtgccattgttcgtgaatccaacaataacgtggaagagctgactatgactggagccatttctctcgaccatccggatgagcgcgtgttgaggctgtatcttatccgatttgcatacgttgttgaagaggcctgccccaat

SEQ ID NO: 44062 - DNA, 706 bp, Zea mays
  misc_feature: Ceres CLONE 1445722-F
  misc_feature: Encodes the peptide sequence at SEQ ID NO. 44063
  misc_feature (383)..(383): n is a, c, t, g, unknown, or other
  misc_feature (389)..(389): n is a, c, t, g, unknown, or other
  misc_feature (394)..(394): n is a, c, t, g, unknown, or other
  misc_feature (395)..(395): n is a, c, t, g, unknown, or other
ctggagctccccgcggtggcggccgctctagaactagtggatcccccgggctgcaggaattcgcacgagaccattacctagaacatcctaatcgaaaaactgcagcgcaagcgaaatcgccgaaggaaaggagaccccgagacgagcaaggcggcgagggagggcaaagaccacgtaccagcgcgcacgcacaatgtcgggagcacagggcgcgcacccggtcggccagacgacgccgacgacgtacgagtcggtgggcggcggggagaaccgcacgcgcacggacctgcggtcgcgggaggaccagggcgccatccagatcgagaaggtgcaggacaaggtcgacgatgccgcggggcgtggggtagaacacagcaccttcngcgccnaacanngaggccgcgacgacaaggccgatgccggggcacccggcacgggcaccaggcgcgtgattttgtgcccttccgcatgggacctgatcgtgggggtaccatagctttggtgtccctggctggctggtcctgttccccgcggctggaatggggggaacctttcctggaaaaatgcccggtttaatggaaaaaaaaaaaggcccgtggggttgaaaacccctttgggcccccccccttggggaaaataaaaaaaaaaaaaaaaatttttttttccccgcccccccgggggggggcccccgaaccatatccccttt

SEQ ID NO: 44063 - protein, 100 aa, Zea mays
  misc_feature: Ceres CLONE 1445722-F
  misc_feature (64)..(64): Xaa is any aa, unknown, or other
  misc_feature (66)..(66): Xaa is any aa, unknown, or other
  misc_feature (67)..(67): Xaa is any aa, unknown, or other
  misc_feature (68)..(68): Xaa is any aa, unknown, or other
MSGAQGAHPVGQTTPTTYESVGGGENRTRTDLRSREDQGAIQIEKVQDKVDDAAGRGVEHSTFXAXXXGRDDKADAGAPGTGTRRVILCPSAWDLIVGVP

SEQ ID NO: 44064 - DNA, 731 bp, Zea mays
  misc_feature: Ceres CLONE 1445724-F
  misc_feature: Encodes the peptide sequence at SEQ ID NO. 44065
  misc_feature (647)..(647): n is a, c, t, g, unknown, or other
  misc_feature (687)..(687): n is a, c, t, g, unknown, or other
  misc_feature (690)..(690): n is a, c, t, g, unknown, or other
  misc_feature (703)..(703): n is a, c, t, g, unknown, or other
  misc_feature (707)..(707): n is a, c, t, g, unknown, or other
ctggagctccccgcggtggcggccgctctagaactagtggatcccccgggctgcaggaattcgcacgagaccattacctagaacatcctaatcgaaaaaggtttactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatatccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtcccaagtgaagttcagtgtgaagaaaaactcaagaatacagataaagagattaaagggcaaaggcaggaagaaagccaaaaatgcaaaaccacctgccaaggagaaagttgatgccatggtagaatgacagttgatgccatggtagcatgacggacaagactacatacatccatcccctttgtatgtttttctcagagtttgcagcaatggaccgacctcaaggaancactgggcgcgtgtctccttgcacgcttctgctgaatgtnaantagagctctttangccntggtgtaatgtacttcaacatgat

SEQ ID NO: 44065 - protein, 129 aa, Zea mays
  misc_feature: Ceres CLONE 1445724-F
MAKYNVVQKNKRQCNQDRKRAAHGEPGTGKLKQRTAPVSISGKRKKKLERRLNRKQKEAAMIKALENNMGDVDMVSVEESSEAAKGKSQVKFSVKKNSRIQIKRLKGKGRKKAKNAKPPAKEKVDAMVE

SEQ ID NO: 44066 - DNA, 715 bp, Zea mays
  misc_feature: Ceres CLONE 1445730-F
  misc_feature: Encodes the peptide sequence at SEQ ID NO. 44067
  misc_feature (345)..(345): n is a, c, t, g, unknown, or other
ctggagctccccgcggtggcggccgctctagaactagtggatcccccgggctgcaggaattcgcacgagaccattacctagaacattctaatcgaaaaacttctctagtctagcccctctgtcgctctcagacgacgggtgcgccgccgcggccgccctaagccaggtgctgactgctgaggctttctttggtctcttcgccggcgacgacacccgccagtatccacggtgtcattgcaagacaagatggtttccttcgagatgaatgacctcaagaagattgggcttggcctgacaggctttggaatattcttctcatttctgggaattgttttcttctttgancaggggctcatcgcaatgggcaatattcttttcctgtcagggttggggttgacaattggtctgaaaatcactatgcagttcttcacccagccaagaattacaagggtactatctcatttggggctgggttttttctggtcctcatggggggcggttttttgcatgcccttaaagccatgggctttattggccccttcggggggttcgggccaaattttctgggttctggcaaaggatcccttccccgggggggtttctccaaccctttttggaattttttctttgcccttaaaaagaaaaagtgtcccggtttaacacccttttgccaaaaatatggtgggggggaaacccaacgccccttttttttttt

SEQ ID NO: 44067 - protein, 137 aa, Zea mays
  misc_feature: Ceres CLONE 1445730-F
  misc_feature (30)..(135): Pfam Name: Got1 Pfam Description: Got1-like family
  misc_feature (33)..(33): Xaa is any aa, unknown, or other
MVSFEMNDLKKIGLGLTGFGIFFSFLGIVFFFXQGLIAMGNILFLSGLGLTIGLKITMQFFTQPRITRVLSHLGLGFFWSSWGAVFCMPLKPWALLAPSGGSGQIFWVLAKDPFPGGVSPTLFGIFSLPLKRKSVPV

SEQ ID NO: 44068 - DNA, 636 bp, Zea mays
  misc_feature: Ceres CLONE 1445745-F
  misc_feature: Encodes the peptide sequence at SEQ ID NO. 44069
tcccccgggctgcaggtatttcgcacgagaccattacctagaacatcctaatcaaaaaaccgcgaggccgcaaaagcaatcgcgaaagcgagcgcgaggcgagtcggccggcgaagggggcggatggcgcgcgggctgcgcggcgtccgcgacgacctatccgagctggggcgccacctgctcgacatcgcctgcttcctgcacccgctcctcaacccggcccacaccgactccccgccacccacccccacgggccgccgccgcccgcgccgctccccgtccccgcaccccgccgcgccgccgtcaccgtcgctcctcgcgggcatcctctccgacctcgccgagatcggcggctccttccgcggccccccccgcgcgctcctcgccggcgcccgaccaccccgcccccgacgcgctcgagtcacagcaggccgcctcgtccccgtccccgcgtccgcctcctccctgctgctgccgaccagatcgcagatgatgtcatgggagcagcgcgtgccctcaccggcgcggcccgaggcggggatcgacttccccgtgctcccccctaaatgaggggtcctgtaatttctggtatcccaaggagatcattagggaatccccttgaaaaaactttgcccc

SEQ ID NO: 44069 - protein, 148 aa, Zea mays
  misc_feature: Ceres CLONE 1445745-F
MARGLRGVRDDLSELGRHLLDIACFLHPLLNPAHTDSPPPTPTGRRRPRRSPSPHPAAPPSPSLLAGILSDLAEIGGSFRGPPRALLAGARPPRPRRARVTAGRLVPVPASASSLLLPTRSQMMSWEQRVPSPARPEAGIDFPVLPPK

SEQ ID NO: 44070 - DNA, 651 bp, Zea mays
  misc_feature: Ceres CLONE 1445747-F
  misc_feature: Encodes the peptide sequence at SEQ ID NO. 44071
ctccccgcggtggcggccgctctagaactagtggatcccccgggctgcaggaattcgcacgagaccattacctagaacatcctaatcgaaaaattctgcagtcccacgcgcgtctgttgtgttacccggtagcgctccccccgttcgaggtccgagtccgaccgaacgagacaggcactctccatggctaacggcggtctgagcgagctccggtgcatggtctagaggaagtggtactcgtcgagggggatcgtctcctgcgcccggtctccactggctcacgtcgacgctgtcgctcgtcccgccaattcaggacacgcgcgcggagcgtcgtccacggcgcggacgacgcgcccaagggcctgcacgcggtgtacgtcggtaggttactccacctgtacctcgtcgcgcaggagctcgtgcgaccactgatgttccagaccctcgtctatcgcaccggtggcgccggccgtcccacaggtacagtcgtcctcggctgcgaggtcgtcctcttagatcacctcgtctggatgctagagcacgccgacccgcatccggagtccctcgacgagctcgtcgactactacgcctgctgacctgcgattcgatggtagatacagtagaccaagcattgttgcagctcatgaaccc

SEQ ID NO: 44071 - protein, 54 aa, Zea mays
  misc_feature: Ceres CLONE 1445747-F
MFQTLVYRTGGAGRPTGTVVLGCEVVLLDHLVWMLEHADPHPESLDELVDYYAC

SEQ ID NO: 44072 - DNA, 722 bp, Zea mays
  misc_feature: Ceres CLONE 1445748-F
  misc_feature: Encodes the peptide sequence at SEQ ID NO. 44073
  misc_feature (418)..(418): n is a, c, t, g, unknown, or other
  misc_feature (448)..(448): n is a, c, t, g, unknown, or other
  misc_feature (493)..(493): n is a, c, t, g, unknown, or other
  misc_feature (542)..(542): n is a, c, t, g, unknown, or other
  misc_feature (543)..(543): n is a, c, t, g, unknown, or other
  misc_feature (575)..(575): n is a, c, t, g, unknown, or other
caaagctggagctccccgcggtggcggccgctcctagaactagtggatcccccgggctgcaggaattcgcacgagaaccattacctagaacatcctaatcgaaaaagaaaaacgcattccgcagacgcgcggcgagggagtaggaggggacggcgggtgccgaggcccgcaggcacggggaagctacctgcttgcgtagccgggcgggctcgcgctgtgctgtcgctccatgtcggtcgccggcgagagcggctggggatccgagcggcggcacgccgccggtgggatctctccaacaagggccccgacagcactccaatgttgaaagaggctgtggaaatgtctacagatgaagaatcggatggcgttgttatatgccatccgaatggtaacactgatggatgtgacgaagccattnagtgcagtcatgatgatgatagcctagaangccaggaaactagttccatcaaggatcctgatgtagaaggtgacncacagaaagactagtgtgtaaatcaagattcacctgagtttgattgatnncagagacgtctgctcccccccaagtccccaancaaagtcctgccactgccaattctgggaccaaagaaacctaaaacgggtttgccccccacccaatggcccctttctactccacgaaaggtcatctgggagaaaaggggggggtggaccaaatccttcccccaataaggaaaaaatct

SEQ ID NO: 44073 - protein, 168 aa, Zea mays
  misc_feature: Ceres CLONE 1445748-F
  misc_feature (140)..(140): Xaa is any aa, unknown, or other
  misc_feature (150)..(150): Xaa is any aa, unknown, or other
  misc_feature (165)..(165): Xaa is any aa, unknown, or other
QSWSSPRWRPLLELVDPPGCRNSHENHYLEHPNRKRKTHSADARRGSRRGRRVPRPAGTGKLPACVAGRARAVLSLHVGRRRERLGIRAAARRRWDLSNKGPDSTPMLKEAVEMSTDEESDGVVICHPNGNTDGCDEAIXCSHDDDSLEXQETSSIKDPDVEGDXQKD

SEQ ID NO: 44074 - DNA, 633 bp, Zea mays
  misc_feature: Ceres CLONE 1445751-F
  misc_feature: Translation starting site: 124
  misc_feature: SWISSPROT Homolog: EC 1.11.1.15 Peroxiredoxin
  misc_feature (136)..(136): n is a, c, t, g, unknown, or other
  misc_feature (137)..(137): n is a, c, t, g, unknown, or other
  misc_feature (205)..(205): n is a, c, t, g, unknown, or other
  misc_feature (214)..(214): n is a, c, t, g, unknown, or other
  misc_feature (383)..(383): n is a, c, t, g, unknown, or other
ctctttaactagtggatcccccgggctgcaggaattcgcacgagaccattacctagaacatcctaatcgaaaaagaagtccgatagccacgaatgccgtggacgtccactgacttactccaccatgccgggtctcnncttaggggacaccgtccccaacctggatctggactccacccgcggcaagatccgcatcgatgactacnttggcgacngctactccatcatcttctctcacccagctgacttctcgcccgtgtgcgcgacggagatgacctctatcgctgcgtacgccaaggagttcaagaagcgtggcgtgaagctgctggccatcttgtgcgaggaggtgtaatcgcagcaggcatcggaccacccacgtgcacncgtaaggggggaagcagcaacagcatcatcatacgacgacgaaggtgacgttcccgatcctggcagacccggcgcgggacgccatccggcagctgatcatggtggaccccgacgatgaagacgcgggcgggcggagcatgccgtcccccgcgctccacgtcttcgggcccgaccaggccgtgaagatgagcttcctgtacccggccaccacggggcggaacatggaacgaggtgctgcgcgccgtcaact

SEQ ID NO: 44075 - DNA, 647 bp, Zea mays
  misc_feature: Ceres CLONE 1445753-F
  misc_feature: Translation starting site: 196
gctctagaactagtggatcccccgggctgcaggaattcgcacgagaccattacctagaacatcctaatcgaaaaattgaactgctctgggaccgccctgtaacatccaccaactcgaggaggaggaggaggagaagagatccccccaccgagcctcggtttccaagcgccagcagaagaagaagagacaggacacatggcggcaggtttcggcccgaggttcgccgccggcgatgctccggcgagacggtgtaacctgaagcggttcctcgaggccaccacgcccgtcgttgcgtcctccagctgctcgtccaaggagaccgcgaacggttgggggcagcggcggtcagacgacgcagacggctcgtcgccgttcttcgctctgggcgacctcagggactcgtatcaggagtgcagcgcgaacagcaccgctgtgccccttgctcttgaagggctgcagcgacggcgtcgttcattactacgtcccctacctgtctgacatccagctttacagaccccttctcaaggaattcggcccttcgaggtaaccgaactaccggatcccgacggggcccaacgctgcccgacctggacccctgcttcctcaactaccactccctggtccccctattcgcaacaaggcccaac

SEQ ID NO: 44076 - DNA, 752 bp, Zea mays
  misc_feature: Ceres CLONE 1445772-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (149)..(149): n is a, c, t, g, unknown, or other
  misc_feature (150)..(150): n is a, c, t, g, unknown, or other
  misc_feature (169)..(169): n is a, c, t, g, unknown, or other
  misc_feature (171)..(171): n is a, c, t, g, unknown, or other
  misc_feature (174)..(174): n is a, c, t, g, unknown, or other
  misc_feature (175)..(175): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (204)..(204): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (261)..(261): n is a, c, t, g, unknown, or other
  misc_feature (274)..(274): n is a, c, t, g, unknown, or other
  misc_feature (311)..(311): n is a, c, t, g, unknown, or other
  misc_feature (364)..(364): n is a, c, t, g, unknown, or other
  misc_feature (410)..(410): n is a, c, t, g, unknown, or other
  misc_feature (570)..(570): n is a, c, t, g, unknown, or other
nnnnnnnnnnnnnnnnnnnnnnnnnnnnnnnnnnnnnnnnnnnggggnnnnnnnnnnnnnnnnnnnnnnnnnnnnnnnnnnnnnnnnnnnnngggggagggggggggccccccgggggggggggccgcccctagaactagggggatccnnccgggctggcggggatccncnccnngccnnnnnnnnnnnnntgggcggggcaanggannnnnnnnnnnnccaaaaaagaactgggggggaccttccccacccgggcggggnggggggccggggncccgggccttccctaaggaaaacctaagggggggggnaaatccccccccccgggggggcctgggggcaagggggaaaaattttccgggcnaaccggaaagggaaccccaaatttaaccctaaggaaacaattcccntaatcggaaaaacaaatacacgagggctggggagaccactgcacttaaccactactccgcatctactgacgccgccgccgccgccggccgcggctctctccgtcgggactagtcagaggatccgtcatggcgaagaaccccaaggtgggtctcgacatcntcatcggcaagtcaaggccgggcgggtcgtgatggaagctctcggcgaacaagtgcccaagacggccgaggaacttccgctgccctgggcacgggcgaaaaaagggccgggggctcccgggggggaaacccgcctggaaaaaaaaaggggggttgggggccttttccaccgggggggaaaac

SEQ ID NO: 44077 - DNA, 658 bp, Zea mays
  misc_feature: Ceres CLONE 1445773-F
  misc_feature: Encodes the peptide sequence at SEQ ID NO. 44078
ctccccgcggtggcggccgctctagaactagtggatcccccgggctgcaggaattcgcacgagaccattacctagaacatcctaatcgaaaaagaaagcagagagagccggcaacatcgcagagagagagagagagagagagaggcaaactggagaggccgagggtgatggtttccaaggagcagaataagcgaggagctttgcatgagaagctcaagattctccgcagcgttactcactctcatgcgggggataaagtgtcgataatagcggacgcgtcatcgtacatcaaggaactaaagcagaagatcgcgaagctaagccaagagatggcatcgtcgtctccgcagcacgccactagtgtctgccaacaacaaccgtcgtcgtcgtcggtgagtgtgggagtcctgctggacaagaagggccgtttcctcgtcagtgtgttcatggacgagagctgcggcccgccgccggccgggctactcgcttccgtcctcgaggccttcgacgagatcggactcacggtgcttgaggctagggctacctgcgctggttcctttcggctagaagctgtaggagaagaagtagtagtagatgggggcctcatcgtcgacgcgcacgcggtggagccagcagtagttcagcaatcaagaattgc

SEQ ID NO: 44078 - protein, 163 aa, Zea mays
  misc_feature: Ceres CLONE 1445773-F
MVSKEQNKRGALHEKLKILRSVTHSHAGDKVSIIADASSYIKELKQKIAKLSQEMASSSPQHATSVCQQQPSSSSVSVGVLLDKKGRFLVSVFMDESCGPPPAGLLASVLEAFDEIGLTVLEARATCAGSFRLEAVGEEVVVDGGLIVDAHAVEPAVVQQSRI

SEQ ID NO: 44079 - DNA, 621 bp, Zea mays
  misc_feature: Ceres CLONE 1445774-F
  misc_feature: Pfam Name: YTH Pfam Description: YT521-B-like family
  misc_feature (468)..(468): n is a, c, t, g, unknown, or other
  misc_feature (487)..(487): n is a, c, t, g, unknown, or other
  misc_feature (490)..(490): n is a, c, t, g, unknown, or other
  misc_feature (493)..(493): n is a, c, t, g, unknown, or other
  misc_feature (497)..(497): n is a, c, t, g, unknown, or other
  misc_feature (498)..(498): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (590)..(590): n is a, c, t, g, unknown, or other
  misc_feature (591)..(591): n is a, c, t, g, unknown, or other
  misc_feature (596)..(596): n is a, c, t, g, unknown, or other
  misc_feature (598)..(598): n is a, c, t, g, unknown, or other
tggagctccccgcggtggcggccgctctagtactagtggatcccccgggctgcaggaattcgcacgagaccattacctagaacatcctaatcgaaaagtgaagatgatgttcacaagagcgttaagtacaatgtgtgggctagcactcccaatggtaataagaaacttgatgctgcctatcaagaggctaaagaaaaatcaagcgaaactcctgtttttcttcttttctctgtgaatgcaagtggccagtttgtcggccttgctgaaatggtgggtcgtgttgattttgaaaaaacagtaaagcattggcaacaggacaaatggactggttgtttccctgtcaagtggcacattgtgaatgatgttccaccccgcttgctgaagcacatctttcttgagttgtttgtttttacccccctgtctaccaacaaatatataaatggtgtggttgtcccccccccccccccncgtgggttgggtccccccnccnctngttnngtagggaccccnnnnnnnnnnnnnnnnnnnnnnnnnnnnnnnnnnnnnnnnnnnnnnnnnnnnnnnnnnnnnnnnnnnnnnnaannnntttnncacancnctacaaaatacacatacaaacaa

SEQ ID NO: 44080 - DNA, 652 bp, Zea mays
  misc_feature: Ceres CLONE 1445780-F
  misc_feature: Translation starting site: 563
  misc_feature: Pfam Name: DUF740 Pfam Description: Protein of unknown function (DUF740)
  misc_feature (467)..(467): n is a, c, t, g, unknown, or other
  misc_feature (468)..(468): n is a, c, t, g, unknown, or other
  misc_feature (477)..(477): n is a, c, t, g, unknown, or other
  misc_feature (609)..(609): n is a, c, t, g, unknown, or other
  misc_feature (611)..(611): n is a, c, t, g, unknown, or other
ctccccgcggtggcggccgctctagaactagtggatcccccgggctgcaggaattcgcacgagaccattacctagaacatcctaatcgaaaaagagttctaccacttccaccacgcggaggacttgctcgaccgcggattcagctccaactccctcatcgaggacatctccgcgagcctggaggcggcgctgtccgggtccgggtccggccccgccaagaagccgcggcggtggcgcaaggcgtggagcctctgggggctcatccaccgccgcgccgccgggcgcaggggcgggggcccgtcggacatcgccgaccgctccttctccgagccgtggccggacctgcgcgtccgcggagccaaccccaaggtgcagcggtgcaacagcagcctgagcgcgcgcagctcgttcagcagcaacagcggcgggctcggcagctccaggcgcagcagctacgtggacccagnncgtgaggcnggagggaaggagccgcaggcgcagctgggagcggaaccgcagcgcgcgctactcgcccggacgcgccgccacggcggacaacggcatgctgcgtttctacctgacgccgatgaggagcggcactgggcggcnancgcggagccggcctgccgaccaaggccggcagcgtgctccg

SEQ ID NO: 44081 - DNA, 646 bp, Zea mays
  misc_feature: Ceres CLONE 1445787-F
  misc_feature: Translation starting site: 162
  misc_feature (201)..(201): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (220)..(220): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (243)..(243): n is a, c, t, g, unknown, or other
  misc_feature (245)..(245): n is a, c, t, g, unknown, or other
  misc_feature (246)..(246): n is a, c, t, g, unknown, or other
  misc_feature (258)..(258): n is a, c, t, g, unknown, or other
  misc_feature (466)..(466): n is a, c, t, g, unknown, or other
  misc_feature (501)..(501): n is a, c, t, g, unknown, or other
  misc_feature (502)..(502): n is a, c, t, g, unknown, or other
  misc_feature (505)..(505): n is a, c, t, g, unknown, or other
  misc_feature (506)..(506): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (542)..(542): n is a, c, t, g, unknown, or other
  misc_feature (547)..(547): n is a, c, t, g, unknown, or other
  misc_feature (548)..(548): n is a, c, t, g, unknown, or other
  misc_feature (553)..(553): n is a, c, t, g, unknown, or other
  misc_feature (561)..(561): n is a, c, t, g, unknown, or other
  misc_feature (567)..(567): n is a, c, t, g, unknown, or other
  misc_feature (568)..(568): n is a, c, t, g, unknown, or other
  misc_feature (575)..(575): n is a, c, t, g, unknown, or other
  misc_feature (577)..(577): n is a, c, t, g, unknown, or other
  misc_feature (578)..(578): n is a, c, t, g, unknown, or other
  misc_feature (582)..(582): n is a, c, t, g, unknown, or other
  misc_feature (595)..(595): n is a, c, t, g, unknown, or other
  misc_feature (599)..(599): n is a, c, t, g, unknown, or other
  misc_feature (603)..(603): n is a, c, t, g, unknown, or other
  misc_feature (604)..(604): n is a, c, t, g, unknown, or other
  misc_feature (618)..(618): n is a, c, t, g, unknown, or other
  misc_feature (632)..(632): n is a, c, t, g, unknown, or other
  misc_feature (637)..(637): n is a, c, t, g, unknown, or other
tcaccgcggtggcggccgctctagaactagtggatcccccgggctgcaggaattcgcacgagaccattacctagaacatcctaatcgaaaacttttttgcgcctccccgaatcgcatcagcctttctcctcgtgtcgcgactcgcgagcgaaaccctcgccatggcggaggcgaccgacaccgccgcagccacgccgcctngccagcgcnnncagcgatnggcgaacttnnntgtccccgccntnncctaaaggttcnggggggaaatccccccggcccccgcccggggttaaccaaaccccctgggggaaaccgccccaaagattgggggggaaccccgttggccctttctgaaaaaccccttttttttttccccaaatatttcccccccggtttttttccaaaaagaggatttttttttggcgcccccccttataaaaaaaatttccccccccccctttttttnccccccccccccttttttttttttcttgccgcccnnccnngggggggggggggggggnnnnnngnnnccccccccnccccnnccccncccccctntttttnnttttttntnntttnttttttttttagntatntagnnataaaatgaagagntatgggaggagagnacggnaggcgggcg

SEQ ID NO: 44082 - DNA, 722 bp, Zea mays
  misc_feature: Ceres CLONE 1445794-F
  misc_feature: Translation starting site: 179
  misc_feature (542)..(542): n is a, c, t, g, unknown, or other
ctccccgcggtggcggccgctctagaactagtggatcccccgggctgcaggaattcgcacgagaccattacctagaacatcctaatcgaaaaaaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacaacgccaccgagatcaagcccttcgcccgcaagagtacttttctcagagatggcttaagcaccatgactactgctggttatgatgcccctgcagcaaggttgcccaaaaggaagagaaggaatcaatacaggggtatcccccagncgcccttgggggagatgggctgctaagatcaaaagaccccaaaagggcgttcggggttgggttgggactttcaatagcccggaaggaaccttcagaacttattaatgctaaaccgcccggaatccgggaaaaaggccaagggtaacttttcctgatgcccccccgcttgggcaaaaaggc

SEQ ID NO: 44083 - DNA, 689 bp, Zea mays
  misc_feature: Ceres CLONE 1445806-F
  misc_feature: Encodes the peptide sequence at SEQ ID NO. 44084
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
aaagctggagctccccgcggtggcggccgctctagaactagtggatcccccgggctgcaggaattcgcacgagaccattacctagaacatccctaatcgaaaactactacttctccctagcagcggagcagcttctctcccagccgcagctcctccctctctcccctctcccaaaacccctctctctccacgcttctccctcactctcccagccgttgcagccgcgctgccctccgccccggcgcccgtcgcgctgccctcccctctccctccggtgttgtgttgtcatttgtcaggtagcgcnnnccccccccccaaannnnnntcttcagcttgttctccgcggcggcggcggcggcggcttggatcggagcggagggagaagatggtggcatcaatcagggtgcccaagacccaacgcgccaggcgggagcttctcaagcacgcgcccaagcttgttgagaccagcaagaagacactgatcctccatggtaccaagactagtgctgtgttgaactctgtgctgtcagatatttaccacctaaagcgtgataatgctgtgaaatataccaagaagaatgacaacattaggccttttgaaagtggtggagaatcttctctggaatttttctccctcaaggcagactgtagccttatagtgtatggttctcattcaaagaagaggccca

SEQ ID NO: 44084 - protein, 101 aa, Zea mays
  misc_feature: Ceres CLONE 1445806-F
MVASIRVPKTQRARRELLKHAPKLVETSKKTLILHGTKTSAVLNSVLSDIYHLKRDNAVKYTKKNDNIRPFESGGESSLEFFSLKADCSLIVYGSHSKKRP

SEQ ID NO: 44085 - DNA, 745 bp, Zea mays
  misc_feature: Ceres CLONE 1445809-F
  misc_feature (20)..(20): n is a, c, t, g, unknown, or other
  misc_feature (33)..(33): n is a, c, t, g, unknown, or other
  misc_feature (53)..(53): n is a, c, t, g, unknown, or other
  misc_feature (54)..(54): n is a, c, t, g, unknown, or other
  misc_feature (58)..(58): n is a, c, t, g, unknown, or other
  misc_feature (61)..(61): n is a, c, t, g, unknown, or other
  misc_feature (62)..(62): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
ttgtcggccgaacgggaagncttttcccccccncacctctttcccctcttctnncttnaanntttnnnnnnnnnnntttttttnnnnnnaaacctggagctcaccgcggtggcggccgctctatactagtggatcccccgggctgcaggaattcgcacgagaccattacctagaacatcctaatcgaaaagagggagacgttggggaggggagcgagcgagccgtaacatccgagctgttccaatggcgacccctgccgttgctttcgtcgccagcgctttgttggggcggtggtagcgctaggagcggagcagtactaggttggtaggtggttgtagctttgcgcgtgacccgagcgcgcgctcgctcgctcctgtgcctctctacctcgcttgcgtgcgccgggaaggcagggggtggctggtcggctctcgcaagaggttgctggtgctgttcccccccccccgggggatgggcgtggggcattgttccgagcatttttaccgccccccagggggactaaggacttggaacggcgccgaccaggttcgcggacccggtctcccgcgggggggcgccccgttccgggtctgccctgtcccgagggccaggttcgctcccgcggaacgaatctacccccgggcgagggaacctccccccttccaaccccagtgaaggggacacccttctaaccccccccaacaagccgaccccggtggcgggttattccccaaacctggcctcg

SEQ ID NO: 44086 - DNA, 661 bp, Zea mays
  misc_feature: Ceres CLONE 1445816-F
  misc_feature: Encodes the peptide sequence at SEQ ID NO. 44087
ccgcggtggcggccgctctattctagtggatcccccgggctgcaggaattcgcacgagaccattacctagaacatcctaatcgaaaaaaaggctgctgctgcatactggaaggccctctgtctgtgtgcgagcgcatgacctagggagtcagacagagagagatagagggaggacaccttgcagatgagcgaagcaagctaggtgggaaagaggcaacagcaagggcggcgggctgccggaaggggaacatgctccctcctcatctcacagagaatggcgcggtgatgattcattctggccatcagatgcctgattacgactccccggctacccagtcgaccagtgagactagccatcaagaagcgtctggaatgagcaaagggagcctcaccgaggataataatgaccatccaggcaaccttgatgagtactcgaagagtgaccaaaacaagatgatgtcagcgttatccctgggcaatccggaaactgcttacgcacataatccgaatcctgcacgtactcactccttcatgcaccctcagctggttggcatggtctccctctctcgagtgccactgcctatcgagtcacccgcctgaagagcccatctatgtcaacgctaatctttaccacgctattctccgggaggagacagctccg

SEQ ID NO: 44087 - protein, 116 aa, Zea mays
  misc_feature: Ceres CLONE 1445816-F
MLPPHLTENGAVMIHSGHQMPDYDSPATQSTSETSHQEASGMSKGSLTEDNNDHPGNLDEYSKSDQNKMMSALSLGNPETAYAHNPNPARTHSFMHPQLVGMVSLSRVPLPIESPA

SEQ ID NO: 44088 - DNA, 554 bp, Zea mays
  misc_feature: Ceres CLONE 1445818-F
  misc_feature: Encodes the peptide sequence at SEQ ID NO. 44089
  misc_feature (156)..(156): n is a, c, t, g, unknown, or other
  misc_feature (165)..(165): n is a, c, t, g, unknown, or other
  misc_feature (166)..(166): n is a, c, t, g, unknown, or other
ctccccgcggtggcggccgctctagaactagtggatcccccgggctgcaggaattcgcacgagaccattacctagaacatcctaatcgaaaaatcacaagctgtcacaaactcagcacacaatcacactgacacacacaccaccaccacggcaccngctagtggnnagaagcggaagcgggaggacacgcggcgcggactgcgatggctcgtgcgctcggcgcttgcgtgctgctcgccgtccctgctcggtgccctggcgccggcggcgggccgcgcgcgcccacgacgaccagggcagcggggcccggcataccgcaagcgaagcgcaagtaccgcgggaaggagggtggggcccaggacggaagtgcgggaacctggaagggccaccgccaaggtgcaaggacctcggccgggttttcccgtcgccaattaaaacggggacctcccaaaaaggtgggggggggcgggggcaggcctccaatttcggcaggggtgggggggcggcccccccgcccggggggggttcggggcccaaaagatacccccccccgc

SEQ ID NO: 44089 - protein, 117 aa, Zea mays
  misc_feature: Ceres CLONE 1445818-F
MARALGACVLLAVPARCPGAGGGPRAPTTTRAAGPGIPQAKRKYRGKEGGAQDGSAGTWKGHRQGARTSAGFSRRQLKRGPPKKVGGGGGRPPISAGVGGRPPRPGGVRGPKDTPPR

SEQ ID NO: 44090 - DNA, 650 bp, Zea mays
  misc_feature: Ceres CLONE 1445823-F
  misc_feature: Translation starting site: 165
  misc_feature (586)..(586): n is a, c, t, g, unknown, or other
tggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgacccaccacaccccagctctcatcatgggtgtcgcacccatcccaggggcacgccgagggcggggtcgaggcggccgcccggagctgagaacggcgggtgcaagtgcggcgtcaactgccagtgcgacccctgcaactgcggcaagtgagctaggtgctccaccctgcaggcccgccggaggaagctagctaattattataagctaaataaagtatagcggcgtcgctgtgtgtgtttcgagtcagtcagtcagttagttgcgtgccatggctggcatgctctgaatctgaaatgatgatgatgcctgatggcggcgtcntgtcctgtaatcctcccctgccccctcgggcgcttctgcggcaagcaatgtgttgtgttttgtt

SEQ ID NO: 44091 - DNA, 654 bp, Zea mays
  misc_feature: Ceres CLONE 1445829-F
  misc_feature (160)..(160): n is a, c, t, g, unknown, or other
  misc_feature (192)..(192): n is a, c, t, g, unknown, or other
  misc_feature (207)..(207): n is a, c, t, g, unknown, or other
  misc_feature (307)..(307): n is a, c, t, g, unknown, or other
  misc_feature (308)..(308): n is a, c, t, g, unknown, or other
  misc_feature (352)..(352): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (409)..(409): n is a, c, t, g, unknown, or other
  misc_feature (428)..(428): n is a, c, t, g, unknown, or other
  misc_feature (450)..(450): n is a, c, t, g, unknown, or other
tctgaactacgtggatcccccgggctgcaggaattcccacgagaccattacctagaacatcctaatcgaaaaatcctgccccaacccaagtcccctccaccaggccgcacacctccgccgcccggcgcgaccttgcatccaccagcctgccctctccttngggtgaggcggccccggagaccgcgtctgcantgcaaaaccaaaccncgcctcctcccggtggaaggttcccccatggccagcgccaatctgctgttgaggaggaggaggaaaatcctccctctttgattcttcaaaaggaaacgcnnccatccccccccccgttttttttccccccccgagggaaaaaganaagggggnnnnnnnnnnnnnnnnnnnnnnnncnnnaaaaaaaaaaaaaacacattantaattgggggggcgcgcgncctccctgttaaaaaaaccccngccccctttccccccccaccacgcggcagaagaacccgccctttttcaataatccctcaagaactgagaataccccgaagggggagcgcctgcgtacgccccaccaggacaacccacaagggagactagctacgcccacccggcgcccgcgcgccgccgcagaccggggggttgcggcccccagaggccccgaccattttcccc

SEQ ID NO: 44092 - DNA, 610 bp, Zea mays
  misc_feature: Ceres CLONE 1445831-F
  misc_feature: Encodes the peptide sequence at SEQ ID NO. 44093
  misc_feature (610)..(610): n is a, c, t, g, unknown, or other
gctctagaactagtggatcccccgggctgcaggaattcgcacgagaccattacctagaacatcctaatcgaaaaaacaagagagcgagatagagaaagaagagataaaataaaaattttaagaagataatggagaagagcgatgatcatcacaagactagccacggtggtgctgcggcggagaagtgggaggaggttagtactgcaatccgaactgcagagacaatgctccggttagctccggtggggctttgtcttgcggcgcttgttatcatgcttaaagactctcagaataatgagttcggttcagtttcttattccaatctctcagctttctggtacttggtgcacgcaaatggaatttgtgcaggctactctctcctgtcagcagctattgcagccatgcctggttcttcttctacaatgcctcgtgtttggaccttcttctgtcttgaccaggttcttacatacgtggttcttgctgctggagctgtgtctactgaagttctgtacttagcctacaaaggagacaatgccattacgtggagcgatgcgtgcagctcctttggtagtttctgccatagacgcactgcttctgttataattacatn

SEQ ID NO: 44093 - protein, 160 aa, Zea mays
  misc_feature: Ceres CLONE 1445831-F
  misc_feature (24)..(160): Pfam Name: DUF588 Pfam Description: Domain of unknown function (DUF588)
MEKSDDHHKTSHGGAAAEKWEEVSTAIRTAETMLRLAPVGLCLAALVIMLKDSQNNEFGSVSYSNLSAFWYLVHANGICAGYSLLSAAIAAMPGSSSTMPRVWTFFCLDQVLTYVVLAAGAVSTEVLYLAYKGDNAITWSDACSSFGSFCHRRTASVIIT

SEQ ID NO: 44094 - DNA, 633 bp, Zea mays
  misc_feature: Ceres CLONE 1445834-F
  misc_feature: Encodes the peptide sequence at SEQ ID NO. 44095
ggagctccccgcggtggcggccgctctattttcgtggatcccccgggctgcaggaattcgcacgagaccattacctagaacatcctaatcgaaaaaccaccagatccttgttaggtcggaacgccccgaaccgcctgcggtcatatggagaaagtctgcgcgattccaccggccgagggaggattcagcggggggccggataatatgatcggccccggcgcgaacaaggtggtccatgcggcggggaaagccggcaggacaatcatcgactgggagggcatggccaagttgctcgtcaccgacgaggcgcgtaaggagttcgccgccctccgccgcgctttcgatgacgtcccccaccctctccagaccaaattctcccaggaaccccagccgattgattgggagtactacataacaggaattggatcacaagtggtggatatgtacgaagaggcttttgaaagcatcgagatcccgaagtacgtcgacacagttactccccagtacaagccaaagtttgatgctgtgattgctgaattaaaggaggctgagaaagagcatctcaaggagtcagaaaggatagagaatgaacttgctgagatggaggatatgaggaaaaagatcagtacaatg

SEQ ID NO: 44095 - protein, 163 aa, Zea mays
  misc_feature: Ceres CLONE 1445834-F
MEKVCAIPPAEGGFSGGPDNMIGPGANKVVHAAGKAGRTIIDWEGMAKLLVTDEARKEFAALRRAFDDVPHPLQTKFSQEPQPIDWEYYITGIGSQVVDMYEEAFESIEIPKYVDTVTPQYKPKFDAVIAELKEAEKEHLKESERIENELAEMEDMRKKISTM

SEQ ID NO: 44096 - DNA, 660 bp, Zea mays
  misc_feature: Ceres CLONE 1445840-F
  misc_feature: Encodes the peptide sequence at SEQ ID NO. 44097
  misc_feature (484)..(484): n is a, c, t, g, unknown, or other
tggagctccccgcggtggcggccgctctagaactagtggatcccccgggctgcaggaattcgcacgagaccattacctagaacatcctaatcgaaaaaatttttccactgccatcgcacccattcataaaaccctaaacccaggacccaggtttatcggtgaggcgagccgcgagtggaactgtggaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagncttggcgggctggataaaaagaaagtaacccttccctcctttcccgaaagaagggaaattgaaatttttttggggcacacttggggggaactgaattccaaaaccccggggcaaagcggggggggtgaaaattgcctaaaggaattttaaagcctggggaacaaaaaactcccaaa

SEQ ID NO: 44097 - protein, 82 aa, Zea mays
  misc_feature: Ceres CLONE 1445840-F
  misc_feature (4)..(79): Pfam Name: Cpn10 Pfam Description: Chaperonin 10 Kd subunit
  misc_feature (78)..(78): Xaa is any aa, unknown, or other
MAKRLLPSLNRVLVEKLVQPKKTAGGILLPETSKQLNAAKVVAVGPGERDKAGNLIPVALKEGDTVLLPEYGGSEVKXWRAG

SEQ ID NO: 44098 - DNA, 622 bp, Zea mays
  misc_feature: Ceres CLONE 1445844-F
  misc_feature: Encodes the peptide sequence at SEQ ID NO. 44099
cgctctagaactagtggatcccccgggctgcaggaattcgcacgagaccattacctagaacatcctaatcgaaaaatttccccgccgcctccagatcacgactctgtccttcccaattctcaggcaaccccgtcgtcttccgccatgatccggttcatcctgctgcagaaccggcaggggaaaacacggctggccaagtactatgtcgctctcgaggactccgagaagcacaaggttgagtacgaggtgcatcggctcgtggtcaaccgggaccccaagttcaccaacttcgtcgagttccgcacgcacaaagttatatataggagatatgcaggactttttttctctatatgtgtggacatcaccgacaacgaattggcatacttggaatgtatccatctgtttgttgagatattggaccatttcttcagcaatgtgtgtgaacttgatttagtatttaatttccacaaggtttacttgatattggatgagttcattcttgctggagagcttcaagaaacaagcaaaagggcaattatagagaggatgggcgagcttgagaagctggaatgaaaagaacaatggtgtagtgtacattagcaatttagcataggtccggagc

SEQ ID NO: 44099 - protein, 142 aa, Zea mays
  misc_feature: Ceres CLONE 1445844-F
  misc_feature (1)..(142): Pfam Name: Clat_adaptor_s Pfam Description: Clathrin adaptor complex small chain
MIRFILLQNRQGKTRLAKYYVALEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKRAIIERMGELEKLE

SEQ ID NO: 44100 - DNA, 635 bp, Zea mays
  misc_feature: Ceres CLONE 1445845-F
  misc_feature: Encodes the peptide sequence at SEQ ID NO. 44101
  misc_feature (503)..(503): n is a, c, t, g, unknown, or other
gcggtggcggccgctctagaactagtggatcccccgggctgcaggaattcgcacgagaccattacctagaacatcctaatcgaaaaacaacgagggccgcctcgtctcgagtcgctgaagccatggcgaccacggcgaccactgcaatcctccgcctcactccagccccttctccccgcaccgcgcgccctcctcgctctgctaccttcctccagcccgcgttctccgtttccctctcccactccctccccgactgccgcaaccaccgccttgccgccgcttccaaggacactgctagcagcaaggggcaggaacaagaccaagagcccgcaccgtcggcgccgcaggaaggaggacaggagaaggtaacggaggtgggggcagcatcgcccggggagaagagcccggaggcggtggcggcggaactgaaggagatgctgagggcgcggaaggaggcggaggccgccgagggccgcggcgggtggtgggcaggcgtggcgcangagatgaccgagatcgagtggccggcgcctgggaaggtgttgggcaccaccggcgtggtgcttggggtcatcgcgggctccactgtcgcgctgctgtccgtcaacgccctcctcgccgagctctccgacacc

SEQ ID NO: 44101 - protein, 171 aa, Zea mays
  misc_feature: Ceres CLONE 1445845-F
  misc_feature (127)..(127): Xaa is any aa, unknown, or other
MATTATTAILRLTPAPSPRTARPPRSATFLQPAFSVSLSHSLPDCRNHRLAAASKDTASSKGQEQDQEPAPSAPQEGGQEKVTEVGAASPGEKSPEAVAAELKEMLRARKEAEAAEGRGGWWAGVAXEMTEIEWPAPGKVLGTTGVVLGVIAGSTVALLSVNALLAELSDT

SEQ ID NO: 44102 - DNA, 693 bp, Zea mays
  misc_feature: Ceres CLONE 1445851-F
  misc_feature: Encodes the peptide sequence at SEQ ID NO. 44103
  misc_feature (321)..(321): n is a, c, t, g, unknown, or other
  misc_feature (322)..(322): n is a, c, t, g, unknown, or other
  misc_feature (354)..(354): n is a, c, t, g, unknown, or other
  misc_feature (385)..(385): n is a, c, t, g, unknown, or other
  misc_feature (415)..(415): n is a, c, t, g, unknown, or other
  misc_feature (430)..(430): n is a, c, t, g, unknown, or other
ctccccgcggtggcggccgctctagaactagtggatcccccgggctgcaggaattcgcacgagaccattacctagaacatcctaatcgaaaaaaacagttgagttcagcagcggcgtgttaacttatccactccctcggcactgcagctcagtgcccttcccagcctctcgctctcccgccgacgcgcacgtcctccgcgccgagcccagaggcagacagaggacgcggccatggcgtccatcccgtgcaccttccagctgagcacggcggcgtcgaggagggtgtcgccgcgggcggcggcgcaggggagaggccaaggnnagaggggagctgtgctgaggacgccgctgctnggcgcggggaggcgggccctgggtggctgcngccgtcgcggttgacccccgtgtgccgtcnagcgagacgggcggncgggtcccactgctggtttcagttcgcaacaagacccgaaggtgccgcatttacggagccggcccggacaattttacgggaagaactaaaaaaacttcaactctggggaggctggcgggggggcccccccaaaaaggggggggttgaaaacagaaaaccccccggggaaacccccctgtgggggcccccgggggggcccccccaaaaaaagaagtcctcccccccgccgggtttacctaaagaatcaaggggggggggtcttc

SEQ ID NO: 44103 - protein, 55 aa, Zea mays
  misc_feature: Ceres CLONE 1445851-F
  misc_feature (31)..(31): Xaa is any aa, unknown, or other
  misc_feature (52)..(52): Xaa is any aa, unknown, or other
MASIPCTFQLSTAASRRVSPRAAAQGRGQGXRGAVLRTPLLGAGRRALGGCXRRG

SEQ ID NO: 44104 - DNA, 549 bp, Zea mays
  misc_feature: Ceres CLONE 1445861-F
  misc_feature (61)..(61): n is a, c, t, g, unknown, or other
  misc_feature (62)..(62): n is a, c, t, g, unknown, or other
  misc_feature (201)..(201): n is a, c, t, g, unknown, or other
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (276)..(276): n is a, c, t, g, unknown, or other
ggagctccccgcggtggcggccgctctagtactagtgggatcccccgggggctgcagggannattcgcacgagaccattacctagaacatcctaatcgaaaaagcactagcagccctcgctcgcattctctcctcccagtcccctagtccttactccttaccatcccatatatccctagctagcgctctcggccgcatcgncggacgtctattttaacgncnngcgctctcctcggcatgcgcggttctgctcgcctgcgaaatggcgcctgcagnttccatcttctcggccacgccgcggcctccggcagggccgggccacttcgaagctgaggagctccggaagaagactcccccgggcccacaaagggggagttaataattggccctggacgattctactaccccgccgaatggctactcccggggaaaaaagggggggggttaccaaggggggggcctcctggggggggaaaaaacccccgggaaggggacaaaaaccggggaacaaaatttgtgggtggcccctttttttctccccaaaaaagg

SEQ ID NO: 44105 - DNA, 653 bp, Zea mays
  misc_feature: Ceres CLONE 1445866-F
  misc_feature: Encodes the peptide sequence at SEQ ID NO. 44106
ctccccgcggtggcggccgctctagaactagtggatcccccgggctgcaggaattcgcacgagaccattacctagaacatcctaatcgaaaaccgttcacccgtcgcaggcgagcagcagacagccagaggagacgtcgcgcctgtgcctaccatggacgagaaggagttctggcgcatgctcgacctcttccccgtcgtccgctcccgtgactattgcgctgatcctggaacatctatcagaggaaccagacagcgatcacgagttcaggaggcagcgaagggcaatgacaaggactcatccgacgcacaagatttgtttatgcagaagttgaagatggctgcagagaaaaagattggaacaacaaaagcagagttggtctgcgaggcatttgaagaaactcatgagaagcttgtttacaagagctgaatttggatgctgctaagaagtttctgaccgcatatgagagctgatgatgaacagtaggtagatgctgctcaaggatcggcaggtgccaatgatccctaaaaagttgttgatgctgtcaagattttgatcattgacaaattggtgttgggtgcaaacagtaaacatcccttttttggcagctaccctttttttttcagagaaccttttggagttgtccaattgga

SEQ ID NO: 44106 - protein, 91 aa, Zea mays
  misc_feature: Ceres CLONE 1445866-F
MDEKEFWRMLDLFPVVRSRDYCADPGTSIRGTRQRSRVQEAAKGNDKDSSDAQDLFMQKLKMAAEKKIGTTKAELVCEAFEETHEKLVYKS

SEQ ID NO: 44107 - DNA, 675 bp, Zea mays
  misc_feature: Ceres CLONE 1445868-F
  misc_feature: Encodes the peptide sequence at SEQ ID NO. 44108
  misc_feature (396)..(396): n is a, c, t, g, unknown, or other
  misc_feature (459)..(459): n is a, c, t, g, unknown, or other
  misc_feature (675)..(675): n is a, c, t, g, unknown, or other
ggagctccccgcggtggcggccgctctagaactagtggatcccccgggctgcaggaattcgcacgagaccattacctagaacatcctaatcgaaaagctaggtttactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgccccatgtcgacgtgggctcagttgaaaantcttcaaaagctgcaaagggccagtcccagtgaagttcagtgtgaagaaaaactcaggatacngataaagagattaagggcaaaggcaggagaaagcccaaaatgcaaaaccacctgcccaggagaaagttgatgccctggtaagaatgaaatttgatgccatgggaaccatgaccggacaaaactacttactcccttcccctttgtatggttttccccaaatttggcgccatggacccaccccccccgaaacctggggcgggggccccttgcattttn

SEQ ID NO: 44108 - protein, 89 aa, Zea mays
  misc_feature: Ceres CLONE 1445868-F
  misc_feature (79)..(79): Xaa is any aa, unknown, or other
MAKYNVVQKNKRQCNQDRKRAAHGEPGTGKLKQRTAPVSMSGKRKKKLERRLNRKQKEAAMIKALENNMPHVDVGSVEXSSKAAKGQSQ

SEQ ID NO: 44109 - DNA, 629 bp, Zea mays
  misc_feature: Ceres CLONE 1445875-F
  misc_feature: Translation starting site: 138
ggagctccccgcggtggcggccgctctagtactagtggatcccccgggctgcaggaattcgcacgagaccattacctagaacatcctaatcgaaaagactgcctcgagcagcatagatcagggaggccgagggcggaatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacccctcccttttcttcctcgtcggcgtcgacagcgatgaggaatgagtagctatcccttgattcatacgtcttctggtggaaactatggatcgccactcggcaatgtgtgcgagctcgatatccttgtccctctggaaaaagtgtactttctgttgaaaaaaatggtgaatgatggttgcattggggaaaacaaataaacagaaaatcttggcccccataacaatttaggaagaaaaccttccaaaaaaagggatacccgtttggggaagttttaacacccccttcctaaagcattttggcccc

SEQ ID NO: 44110 - DNA, 683 bp, Zea mays
  misc_feature: Ceres CLONE 1445878-R
  misc_feature: Pfam Name: zf-HIT Pfam Description: HIT zinc finger
  misc_feature (47)..(47): n is a, c, t, g, unknown, or other
gcgatcttgtttcccttttatttctcgactactagtagactcatacntcgaaccgaccggtccataagttttaaactcaatccaatccaccattactaatcccggcttggttcacgacgggcagaaggaaaccggcagtcacacatctatcttttgtcaggttgattggttgttatcacgactctattcccgacgagagaccagtaaaacaacacaccaacgagctggccttgtcgagattacacttctccagccaactgactgtcacggttgaatcgcgtcaggcacctagattcatcatgcttgcttcccagcactctcctgggtggcatcagatccctgcccagcatcgcttccctggccatttgttaattcactcccctgggcaggaggacggtcctcgacggcctctacatcttttcaaggttgcttagagggaccacagtcttggagtgccggcacttgtacggatttgtgcacgatgggcctgcacacttcttcctcggaggcggatagctgacatgtttggagttgatttactcggaagccccctgctctcagggaatgtaatcattttttcggtttggacccatgacaggctggacgcagtttttcctgggatcttccaatcttgcctgggtttccctctcatttcgttttattagcttcatttacttcgattt

SEQ ID NO: 44111 - DNA, 638 bp, Zea mays
  misc_feature: Ceres CLONE 1445878-F
  misc_feature: Encodes the peptide sequence at SEQ ID NO. 44112
tggagctccccgcggtggcggccgctctagaactagtggatcccccgggctgcaggaattcgcacgagaccattacctagaacatcctaatctaaaaattcctctcgtgcgccacaaagcctatatcctttctctggcttgctccatacctggtcccgtgctagttaaatctgcatagggtccttgctgcgccccttctagggttcgcttgcaagtttgctgtggcctccgccctgccgccaccacccccgcgagagatgccacgaggctcgtcgagcaggggcgcaagaaggggccgcggaagaaatcagggaaggggtggcgctaggggaaaggtgcacagggcaaccctggtttggtcagatctggattctggtggccacacaaacaaagagacccatggtaatcgtgttgaaggaaaacatggcaacgggcatgaaatttttccatcttctgaccttgttcgcaagagcaaaaggattcccaagaagaaaacacttgacggagattctgatgatgaagatggtgaattacgctatctggaaaaactcaaaggggctaaagttgcaccagatcctgtgaacactagccataaaggttatgattttggtgatgatgctctcaagaaaaagaagcta

SEQ ID NO: 44112 - protein, 127 aa, Zea mays
  misc_feature: Ceres CLONE 1445878-F
MPRGSSSRGARRGRGRNQGRGGARGKVHRATLVWSDLDSGGHTNKETHGNRVEGKHGNGHEIFPSSDLVRKSKRIPKKKTLDGDSDDEDGELRYLEKLKGAKVAPDPVNTSHKGYDFGDDALKKKKL

SEQ ID NO: 44113 - DNA, 647 bp, Zea mays
  misc_feature: Ceres CLONE 1445881-F
  misc_feature: Translation starting site: 237
ctccccgcggtggcggccgctctagaactagtggatcccccgggctgcaggaattcgcacgagaccattacctagaacatcctaatcgaaaaaaaggtacccaagctgaaagcatcacactcgcagttgcagagttccgcttcatcagtcccacactctccccttcctccccccagtcctgagcttcgccgaggcatacggacaataccggcaccggcagcgagcagtcgggagccatggctccgcggctcctgctcttcctcctcctcctcctcccgctcctcgccgccggacaccagcacccgtcctcctacggctcctccgcgctttccgagtggcgccccgccaaggcatcctactacgccgccgaccccgaagacgccatcgtgttaagtgcctccttgaaggtggtgtcaggttctctgtcaacggtcggcacttcttctttacagtcctaatcagcaacgttggtggcgcgggtgatgttagatctgtgaagatcaaaggaacagagttgggatggctcccgatgggccgcaactggggccaggtgtggcacatcaactgtgacatgaggggacaacctctatcgtttgagctcagctcgagcgatggcaaggcgctgaccagtttcaacgtcgtcccta

SEQ ID NO: 44114 - DNA, 713 bp, Zea mays
  misc_feature: Ceres CLONE 1445888-F
  misc_feature: Pfam Name: HIT Pfam Description: HIT domain
agagctggagctccccgcggtggcggccgctctttcatagtggatcccccgggctgcaggatttcgcacgagaccattacctagaacatcctaatcgaaaaaacatttatccgcagatcttccggtgccaggggcaacaacttgaggcgatccatccctcgaccatggcgtcggagaatgaggcggcgctcgccgccgagctcgatgacagccacaccatatttaacaagatcatctaaaaggaaataccttctactgcggtttatgaggaccataaggtactgcctgttcgggacataaaccctccaccacgacctcatattctcctgctacccaacctcaaagatggactacctggcctgccaaaggatgaagaacatcacatacaaatactaggctatctcctctatgcacccacagtagctacgcaacctgaaggacttgaagatggatatcgcatcctcatcaatgaccgtccaagtgcatgtcaatctagtgttaccacatccacgttcatcgcctctccagaaggcgaatgaactggtccccattctaagaatatcttgtgattgatcgccgctgatgctaatgactgactacaccatgtctctatcaataagccttgcaattaccataaaagactagtcttcactgctcctgacctagtactatatttgccgtatccctgaaggcaaacctgctgtgatctatga

SEQ ID NO: 44115 - DNA, 672 bp, Zea mays
  misc_feature: Ceres CLONE 1445894-F
  misc_feature: Encodes the peptide sequence at SEQ ID NO. 44116
ggagctccccgcggtggcggccgctctttcctagtggatcccccgggctgcatgttttcgcacgagaccattacctagaacatcctaatcaaaaagtggcacagtgcacacactcgtctcatcggagaaaagtagatccggattagggttttagacggcgatgggtgcggcgggcgacgagaaggctgcggtggctgcggccgctgcggccgcgggggccggtgccgccgagggcgagggcgcggtggactccaaggaccttcagcagcagagcaaggctctcgacaagctcactgatcatgtcgaggaccggcagctcgattcatcccgtgtccaatccgccatggcggcacttgcttcatccaaggaggctgactggaacgcgatgaggctgagggagaaacacccccctgctgtgaagatcaaccctgcggatgtcgaaattatcgctagtgagcttgagctggacaagaagatcgcggagagaacgctccgtgagcacaagggtgatgccgtggctgcgggtcgattcctgctgcgctagttccgagatttcgtcgccagcatcatatgttccccttcagttccacacaacaggtgatgatgtgaagtgaagcactaggaacttttgtgtgcctgtttttggaagtttgctattagaactatgttgca

SEQ ID NO: 44116 - protein, 127 aa, Zea mays
  misc_feature: Ceres CLONE 1445894-F
MGAAGDEKAAVAAAAAAAGAGAAEGEGAVDSKDLQQQSKALDKLTDHVEDRQLDSSRVQSAMAALASSKEADWNAMRLREKHPPAVKINPADVEIIASELELDKKIAERTLREHKGDAVAAGRFLLR

SEQ ID NO: 44117 - DNA, 658 bp, Zea mays
  misc_feature: Ceres CLONE 1445896-F
  misc_feature: Encodes the peptide sequence at SEQ ID NO. 44118
ctccccgcggtggcggccgctctagaactagtggatcccccgggctgcaggaattcgcacgagaccattacctagaacatcctaatcgaaaaatagctcctgccttcttcctagttcctaccttcgtcccccccgccgccgtcgattcgtgctgcgctcacctcgacccagttcaatatcgccggcgagggaagcagcagcagaagctccggcgagaacccccacctccggctatcgcctggggataaagtggggtcggtaggggcggtgacctagggggagcaaaagggatccgatagggagagatgaagcaatcaatttattcgtccgccgtcgcccctgctaacgcccccactactaaccctaggatcatactgtcttttggcgtttcttctccggctctttttcgtttgcctgtcggttacaaggtggaacgtcttcagaagcttctccactagattagtgtaaatagtagacttgttcaggtttagtttggttggaagaattagtttctggttcgtgttcatttctgctagcaataatggctgcgatgaacggaaaggtattgggtaaatgtggaaggaacatgaatagtctcaagagaaagcgggagaaccccgctgcatatgatgctgacatattccacaactctgaattg

SEQ ID NO: 44118 - protein, 39 aa, Zea mays
  misc_feature: Ceres CLONE 1445896-F
MAAMNGKVLGKCGRNMNSLKRKRENPAAYDADIFHNSEL

SEQ ID NO: 44119 - DNA, 664 bp, Zea mays
  misc_feature: Ceres CLONE 1445903-F
  misc_feature: Encodes the peptide sequence at SEQ ID NO. 44120
ccccgcggtggcggccgctctagaactagtggatcccccgggctgcaggaattcgcacgagaccattacctagaacatcctaatcgaaaaaaaaaaatcgccgccgcagcagccgccgccgccatcagccatggccgctgacacttcgaagcccttcttccccgcggcgccgcactcggctctccgcccctccaggagcgccgcctcgcgcgcgttccctgagagctcctactggggcgccttccgctcctcggagctcgtgtccgacgccggcttccccgtcaccgatctcaccttcgcctcgtctggggaggacagagctgcccctaccctcgccgcttcttggtcaatttttgggcccccctttgggggggggggggggaaaaattcctaagaatctcttccccggggaaattccccctttcccccggcctttccggggggggagggccccccccccccccccgaaaaaaaaaagggggtcccccccatttccccccccaaaaggggcccccggggggcccccccccggttggggccccccccccaaaaaaaccgggggggccaacaccacggggggggggaaaaaattttctccccccccccgggaggaaacacctccctcctttgagggggggccgccaaagaaaacccgcttcttccg

SEQ ID NO: 44120 - protein, 87 aa, Zea mays
  misc_feature: Ceres CLONE 1445903-F
MAADTSKPFFPAAPHSALRPSRSAASRAFPESSYWGAFRSSELVSDAGFPVTDLTFASSGEDRAAPTLAASWSIFGPPFGGGGGKNS

SEQ ID NO: 44121 - DNA, 649 bp, Zea mays
  misc_feature: Ceres CLONE 1445910-F
  misc_feature: Encodes the peptide sequence at SEQ ID NO. 44122
  misc_feature (277)..(277): n is a, c, t, g, unknown, or other
  misc_feature (279)..(279): n is a, c, t, g, unknown, or other
  misc_feature (280)..(280): n is a, c, t, g, unknown, or other
  misc_feature (305)..(305): n is a, c, t, g, unknown, or other
  misc_feature (537)..(537): n is a, c, t, g, unknown, or other
agctccccgcggtggcggccgctctagaactagtggatcccccgggctgcaggaattcgcacgagaccattacctagaacatcctaatcgaaaagccaagtttttttaactatacaatccaggaaggaagtcactgtcacttggtgagatcgatggcccgcgtcgccgccgtcctcgttgctctcctcgccctctttgccgtcgcggccacggcgcaggcccctgccgcgtcgcccaagcgcgccccagcccctgcgccacccaagatggccctctncnncgcgcggcgaacagggccccatggnctccccgccctcgctcccacaatggcgcggggtccgccccttcgcagacctcccaccacgagccccccggggcggaatttgcaaccaatgcccccgcgaagcctccttttaatccgccccccccctttccggaaaaaacataccctatttccccccccattaatttttcccctccccgggttttgggaccccccccccttttttttaaacccgcgaaggttttaaaagtttnatttccccaaaaccccttttggtttaaaaaaaccccccttttttttttttttaaaaccccggggtttttttatttgggggggggcgcccaagggggccaacaaaaaagaagg

SEQ ID NO: 44122 - protein, 38 aa, Zea mays
  misc_feature: Ceres CLONE 1445910-F
  misc_feature (2)..(2): Xaa is any aa, unknown, or other
MXSPPSLPQWRGVRPFADLPPRAPRGGICNQCPREASF

SEQ ID NO: 44123 - DNA, 625 bp, Zea mays
  misc_feature: Ceres CLONE 1445926-F
  misc_feature (127)..(127): n is a, c, t, g, unknown, or other
  misc_feature (218)..(218): n is a, c, t, g, unknown, or other
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (233)..(233): n is a, c, t, g, unknown, or other
  misc_feature (237)..(237): n is a, c, t, g, unknown, or other
  misc_feature (242)..(242): n is a, c, t, g, unknown, or other
  misc_feature (256)..(256): n is a, c, t, g, unknown, or other
  misc_feature (270)..(270): n is a, c, t, g, unknown, or other
  misc_feature (274)..(274): n is a, c, t, g, unknown, or other
  misc_feature (301)..(301): n is a, c, t, g, unknown, or other
  misc_feature (304)..(304): n is a, c, t, g, unknown, or other
  misc_feature (330)..(330): n is a, c, t, g, unknown, or other
  misc_feature (337)..(337): n is a, c, t, g, unknown, or other
  misc_feature (338)..(338): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (412)..(412): n is a, c, t, g, unknown, or other
  misc_feature (414)..(414): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (444)..(444): n is a, c, t, g, unknown, or other
  misc_feature (470)..(470): n is a, c, t, g, unknown, or other
  misc_feature (476)..(476): n is a, c, t, g, unknown, or other
  misc_feature (477)..(477): n is a, c, t, g, unknown, or other
  misc_feature (486)..(486): n is a, c, t, g, unknown, or other
  misc_feature (501)..(501): n is a, c, t, g, unknown, or other
tccccgcggtggcggccgctctagaactagtggatcccccgggctgcaggaattcgcacgagaccattacctagaacatcctaatcaaaaagcacccaggccgcggccgcatcctctccccatcggnagtcttcccccaagacgtctaaaccccaatccctaaatcgccgacgcagaccacacgacgggcacctccgttcacgaggcggaagcatgantngnnncccgattantaantgggnacaaaggtccaacngggtgttcttgacnatanacctgccccacccccaaggaggggaanctnaacttgaagccttttttgccttttcncttctcnnctaagggttcaaattttttttttcccccccccccgggggaaaagaaaggggagannnnnnannnnnnnnnaaancnanncncccctaaccaccaaaaaacaaaatnttccctggggggggagggggggaccncctttnntccaaaaantttaaaaaaaataantcaagacctctcgggtttctttaaactaagccgagaaaatggggcgactactatttagtaaggccccgcgttatggggagttggggctccagggggtgtgaacgccaggaacagggtgcgcccg

SEQ ID NO: 44124 - DNA, 640 bp, Zea mays
  misc_feature: Ceres CLONE 1445929-F
  misc_feature: Translation starting site: 203
ggtggcggccgctctagaactagtggatcccccgggctgcaggaattcgcacgagaccattacctagaacatcctaatcgaaaaagcccagcaccgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggctgatggtcagatgcccggtgacaagaccattgggggtggtgatgatgctttcaacaccttcttcagtgagactggtgctggggagcacgtccctcgtgctgtttttgttgactttgaaccactgtcatcgatgaggtgaggactggcacctaccgcagctcttccaccctgagcagcttatcagtggcaaggaagatgcagccaacaacttcgcccgtggtcactacaccattggcaaagagattgttaacctgtgccttggtcgcatcaggaagcttgccgacaactgcactggtctccagggcttcctccgcttcaaagctgttggtgggaggaaaggctc

SEQ ID NO: 44125 - DNA, 623 bp, Zea mays
  misc_feature: Ceres CLONE 1445935-F
  misc_feature: Encodes the peptide sequence at SEQ ID NO. 44126
ccccgcggtggcggccgctctagttcttatggatcccccgggctgcaggaattttcacgagaccattacctagaacatcctaatcgaaaaatctcccacctcgatccctgcgctgcaagcaacaaagttctactctgtccacccgtccatctagctcccaagaaccaacccgtacaaacgctatccggccggacatggcggcggcgcgccggctctccctgcccctcgtcctgctggacgtcctggccgacgacgggcgcggggcgtcgcaggactacgacttcttctacctcgtgctgcagtggccgggggcctactgcgacaccaagaagagctgctgctaccccaagtccggtaagccggcggcgaacttcgggatccacggactctggactcaacgttattaccacacgtacacgcagaaatgcatccccgacagcgccttcaacccgtcgaaggtgagcgacctgctgagctacctccgcaccaagtggccgacgctggcgtgcccatccaacaacaggctgcctttctggcgccacgattgggaaaaaaaggctgctgcgcagtcgacgtcttcgcagagcacggtaacttccagggcccgttgcacctccgggaga

SEQ ID NO: 44126 - protein, 143 aa, Zea mays
  misc_feature: Ceres CLONE 1445935-F
  misc_feature (28)..(143): Pfam Name: Ribonuclease_T2 Pfam Description: Ribonuclease T2 family
  misc_feature: SWISSPROT Homolog: EC 3.1.27.1 Ribonuclease T(2)
MAAARRLSLPLVLLDVLADDGRGASQDYDFFYLVLQWPGAYCDTKKSCCYPKSGKPAANFGIHGLWTQRYYHTYTQKCIPDSAFNPSKVSDLLSYLRTKWPTLACPSNNRLPFWRHDWEKKAAAQSTSSQSTVTSRARCTSGR

SEQ ID NO: 44127 - DNA, 618 bp, Zea mays
  misc_feature: Ceres CLONE 1445950-F
  misc_feature: Encodes the peptide sequence at SEQ ID NO. 44128
  misc_feature (432)..(432): n is a, c, t, g, unknown, or other
  misc_feature (445)..(445): n is a, c, t, g, unknown, or other
  misc_feature (509)..(509): n is a, c, t, g, unknown, or other
  misc_feature (510)..(510): n is a, c, t, g, unknown, or other
  misc_feature (576)..(576): n is a, c, t, g, unknown, or other
  misc_feature (613)..(613): n is a, c, t, g, unknown, or other
ggagctccccgcggtggcggccgctctagaactagtggatcccccgggctgcaggaattcgcacgagaccattacctagaacatcctaatcaaaaagagcacagcaaatccatcaatccaacagaccaacacaaacccaacctgcccccggtcgatcgcgcaaaccctagcgccgtcgcctccctctcggttctacaccgtcctctccagcctcgcccgcgtgcaccgcagatcaggggacgtacgtcgcccgcgcgcaccgcagatcaggcaacgtacgtcgcccgccggagatcggaattctgtatttttccttccgtgctcgcggctgctacggcgatggcgggcggcgggagcaggcgcgccggcgcggcggagcagccgaagatcggcagcggcaacgtcttcgccgcgctcgagacgcttaagaangaagaagaagccngcggacaggggggccaagcccgccgccagggaggaccccaagccagaagtcttctgggcgcccnngcacgctcacgccaagtcctgggccgacgtcgaggacgacgacgatgacgactattttcgccacancgcgccgccttccaagcccgtctggggggaacgcctnacgcg

SEQ ID NO: 44128 - protein, 72 aa, Zea mays
  misc_feature: Ceres CLONE 1445950-F
  misc_feature (31)..(31): Xaa is any aa, unknown, or other
  misc_feature (36)..(36): Xaa is any aa, unknown, or other
  misc_feature (57)..(57): Xaa is any aa, unknown, or other
MAGGGSRRAGAAEQPKIGSGNVFAALETLKXEEEAXGQGGQARRQGGPQARSLLGAXARSRQVLGRRRGRRR

SEQ ID NO: 44129 - DNA, 618 bp, Zea mays
  misc_feature: Ceres CLONE 1445954-F
  misc_feature: Encodes the peptide sequence at SEQ ID NO. 44130
tggagctccccgcggtggcggccgctctagaactagtggatcccccgggctgcaggaattcgcacgagaccattacctagaacatcctaatcgaaaaaagacaaagcacgccaagcgcaagtccaacagcccgcatcgctcactccgtcactcactcggcgcggcgcccatccccgcggttctcacgagcgcgcgcgcctgcgtccggcgccgtccgccatggcgtcgtccaagcctttattccccttccccgtccccgcccccgacccgtccgacgaggtcgtgcgcgagttcggcccgctgctccgggtctacaagagcggccgcatcgagcggcccctggtggctccgcccgtggagcctggccacgacgccgccacgggggtccaatccaaggacgtccacctcggctcctactcggcccgcctctacctgccccccgtggccgacgccgacgctggtgccaagctgcccgtcgtcgtgttcgtgcacggcggcggcttcgtggccgagtccgccgcctcgcccaactaccacctcttcctcaacaggctcgccgccgcctgccccgcgctcgccgtctccgtcgactaccgcctggcgcccgagcacccgctt

SEQ ID NO: 44130 - protein, 133 aa, Zea mays
  misc_feature: Ceres CLONE 1445954-F
MASSKPLFPFPVPAPDPSDEVVREFGPLLRVYKSGRIERPLVAPPVEPGHDAATGVQSKDVHLGSYSARLYLPPVADADAGAKLPVVVFVHGGGFVAESAASPNYHLFLNRLAAACPALAVSVDYRLAPEHPL

SEQ ID NO: 44131 - DNA, 714 bp, Zea mays
  misc_feature: Ceres CLONE 1445959-F
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaaagaaaatgttttagtgatgctctttgcgtttaggaatggtagcggggctagagcttcaccggttccaccgctagatccgtcccggccattggtgacgaataggaattggtttattgagatagtattaatcagataaccgtctcttcatcttcctcgtgcgcttccagtcaggcaaaggcggcggcacgcccccacgatcttgcggcgcgctggactcgcagccttgcatcgcaagctagttctttgggggcggattccccgattgcctgccattattctggcttggttcttgcccctgtttgggtactccggcgaatcgtctgagttggggactggtcctcctcctcctcctcccgatggggggctggaaccggtcgcggcatgtgagatggcagcgtgaccgcccgcggcgccctccgctccctccgcctgattacggaccggggcactgctcagtcccgttatgggaaagggaattctgcagctacgtcggcaacatttcttggcaaaggttctgtgaaaacaagcggtatgcttcagtagacaataccctcgagcactgggacgattcangagcccttgagaatttccagaactcaaaggcgaggttca

SEQ ID NO: 44132 - DNA, 758 bp, Zea mays
  misc_feature: Ceres CLONE 1445963-F
  misc_feature: Translation starting site: 210
  misc_feature: Pfam Name: Rcd1 Pfam Description: Cell differentiation family, Rcd1-like
aagctggagctccccgcggtggcggccgctctagaactagtggatcccccgggctgcaggaattcgcacgagaccattacctagaacatcctaatcgaaaaaaataactcgtcggagtcagtacggtgctctctccgtctcagccgtcgccaactaatctatccccgatcacgcggcgaaccgccgcaacaccactatcaccaatcgcaatggagaaccctccaccgtcctccgccggtccgtactcggcgcccgcgccggcagcgcagcatcaggacgcggcgaaggaggatcaggacgtggcgcagctcgtgctcaacctctgcatcccggagctccgcgagaaggccatcatcatcctttccaagaagcgagaaaaatgtgaagatcttgctctactactatggcactcttttggtacaatggctgcactactccaggaaattgtgtcaatttatcgattactttcacccccacaatttatctttggacaatcaactcgagtctgcaatgtgcttgtactcctttacgtgtgtggcatcacaccctgatactaggatgccatttttaaatgcacagtttccactgtacctgtaccctttcttgaacactacctacaaaacagaaaatatgagttcttgaagaatagtagccctgagcctgatcggggctctggggaagccggatgatcatgaaggcatggggaatttgctggggttctgaaatagttcttttgtgccggcgtgctattgagaagg

SEQ ID NO: 44133 - DNA, 820 bp, Zea mays
  misc_feature: Ceres CLONE 1445972-F
  misc_feature: Encodes the peptide sequence at SEQ ID NO. 44134
  misc_feature (311)..(311): n is a, c, t, g, unknown, or other
  misc_feature (398)..(398): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
aattgctggagctccccgcggtggcggccgctctagaactagtggatcccccgggctgcaggaattcgcacgagaccattacctagaacatcctaatcgaaaaacgttacgatccccaacttaacgccgatcggaggccggagagaccggctcagcctcgctccgccgccgccggggaccatgtccctggcggctatcttcgtcttcctcatcgtgtccgcgctgcagctgctctaccgctacctcgacctcgccagaaagagcggaggacttagtgatgagcagatcttaccgcggcttgagatcaagcnacttctcaaggttgctgatcagtttgtcaacgccgtccccatttgcacttttttttttccccccccccccggggaggtggggggganaannanctnnnnntttttccccccccctggcctttaaaagaaagaaattccttttccggcggagggggggggggtttttgcttggtttctctacggctccttttttgggcgggcccgctcctgcgcggtttgtaagactccctctatgctggctcttcctttgcgtctttctaggggccccccccaaaaacgtgttccccggggtcgggggtggttcccgcctccgcccccacacctctctgagcagtaccaccccgcgttgtcgttctgatcccctctcttacacctcccattgctggctgataggaacagggcgttcacctctcctctcttcctctcgcgctgcttcgtccctcctctcgcgagatcccgctggctggctgactatgactggtttctccctttctttccggccctcttcc

SEQ ID NO: 44134 - protein, 84 aa, Zea mays
  misc_feature: Ceres CLONE 1445972-F
  misc_feature (44)..(44): Xaa is any aa, unknown, or other
  misc_feature (73)..(73): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
MSLAAIFVFLIVSALQLLYRYLDLARKSGGLSDEQILPRLEIKXLLKVADQFVNAVPICTFFFPPPPGEVGGXXXXXFFPPPGL

SEQ ID NO: 44135 - DNA, 765 bp, Zea mays
  misc_feature: Ceres CLONE 1445973-F
  misc_feature: Encodes the peptide sequence at SEQ ID NO. 44136
  misc_feature (719)..(719): n is a, c, t, g, unknown, or other
ctggagctccccgcggtggcggccgctctagaactagtggatcccccgggctgcaggaattcgcacgagaccattacctagaacatcctaatcgaaaagaagcacaccgcaggacaggagaagcttgggtctcctatcctccccacccctctctcggtctcttccccaccgcgtcttcgtcgtctcgtcttcctgcctccttcgcccgagaaaggagagaatggggagcagcgagaagaccgttaccgcttacggcgagtacacctacgctgagctggagagggagccctactggccgagtgagaagctgaggatttcgattactggggctggtggtttcattggatcccacattgctcgccgtctgaagaacgagggccattacatcattgcctctgactggaagaagaacgagcacatgaccgaggacatgttctgccatgagttccacctcgttgatcttagggtcatggacaactgtctcaaggtcacccatggtgtcgaccatgtctttcatcttgctgcagatatgggtggcatggggttcatccagtcaaatcactctgtgatcatgtacaacaacaccatgatcagtttttacatgctggaggctgcacgtatcaatggtgtgaagaggttctctatgcctcgagtgcatgcatttaccctgagttcaagcagcttgcacaaatgtgagcttgagggatctgatgcctggnctgctgagcctcagatgcctatggcttgaaaaacttgcaaccaaga

SEQ ID NO: 44136 - protein, 175 aa, Zea mays
  misc_feature: Ceres CLONE 1445973-F
  misc_feature: SWISSPROT Homolog: EC 5.1.3.18 GDP-mannose 3,5-epimerase
  misc_feature (167)..(167): Xaa is any aa, unknown, or other
MGSSEKTVTAYGEYTYAELEREPYWPSEKLRISITGAGGFIGSHIARRLKNEGHYIIASDWKKNEHMTEDMFCHEFHLVDLRVMDNCLKVTHGVDHVFHLAADMGGMGFIQSNHSVIMYNNTMISFYMLEAARINGVKRFSMPRVHAFTLSSSSLHKCELEGSDAWXAEPQMPMA

SEQ ID NO: 44137 - DNA, 761 bp, Zea mays
  misc_feature: Ceres CLONE 1445981-F
  misc_feature: Encodes the peptide sequence at SEQ ID NO. 44138
ctggagctccccgcggtggcggccgctctagaactagtggatcccccgggctgcaggaattcgcacgagaccattacctagaacatcctaatcgaaaaaacgataatcacgaaacaagctatccgacgcagttttgaccacagccgacggcaatagaagtagagaactccgacttcttcactcacacacacatggcgctgatgagccttggcgccgccgggtacaccacggccaccgcgccgcctcgtccccgaagatgcaccctgccgtttcgcgccgccgcctcccctgcggcactggaccgccggcgacggccgcataatgtggctggcgacttcttcgtcgaccaccgctgcatcgactgccagacctgccgatggatggcgccggaggtgttcaagagggtggatggcaaggccgccgtagcggcgcagcccagctccgaggaggagaggaccaaggccctgcaggcgctgctatcctgtccaacatcctcaattcacactgagaaacctccaaaagacattcttaaagtgcaaaacatgtttcctctaccaatcgacgacaagctactcccaggtgtttatctctgtgggtataattctgaagactcatatggggcaacatcgtacctggtaattcatcccacaggaaacatactgattgacagcccaaagtatactccaaagctggccaaacatattgaaaagcttggtggagcgcgctacatgtttttgacccacattgatgacgtagcagat

SEQ ID NO: 44138 - protein, 190 aa, Zea mays
  misc_feature: Ceres CLONE 1445981-F
MALMSLGAAGYTTATAPPRPRRCTLPFRAAASPAALDRRRRPHNVAGDFFVDHRCIDCQTCRWMAPEVFKRVDGKAAVAAQPSSEEERTKALQALLSCPTSSIHTEKPPKDILKVQNMFPLPIDDKLLPGVYLCGYNSEDSYGATSYLVIHPTGNILIDSPKYTPKLAKHIEKLGGARYMFLTHIDDVAD

SEQ ID NO: 44139 - DNA, 606 bp, Zea mays
  misc_feature: Ceres CLONE 1445984-F
  misc_feature (235)..(235): n is a, c, t, g, unknown, or other
  misc_feature (266)..(266): n is a, c, t, g, unknown, or other
tggagctccccgcggtggcggccgctctagaactagtggatcccccgggctgcaggaattcgcacgagaccattacctagaacatcctaatcgaaaatgcagctaccggccttcctctcccccattccaattccgagaacaggggcggcggagtcaaccaggtacgatgtgctcggtagcgaggctggcgtttgtgcttgcactggccatagccgcctcatcaattacggttgcnggagagcagagatttttatatctttgctcanggcagcttggcctgatgcaaccccaagggatccgtcagggcctagcttgcaacccagggggaaaaagtttgtggttcctttttttgggagagagattttcttcttccgaggggggcccccctttttccttcccaaaaaagggggcccccccgggggggtttttttttaatttccccccccccggaaaggggggggggggccctttttttcccccccccccttaaaaaaaaaaggggggggccccccccccgggggggggtaaaaaaaaaaacaccccccctttttttttttttttggggggggggccccccttttgggtccccccccccccaacaaaaaa

SEQ ID NO: 44140 - DNA, 828 bp, Zea mays
  misc_feature: Ceres CLONE 1445986-F
  misc_feature: Encodes the peptide sequence at SEQ ID NO. 44141
  misc_feature (329)..(329): n is a, c, t, g, unknown, or other
  misc_feature (330)..(330): n is a, c, t, g, unknown, or other
  misc_feature (346)..(346): n is a, c, t, g, unknown, or other
  misc_feature (347)..(347): n is a, c, t, g, unknown, or other
  misc_feature (396)..(396): n is a, c, t, g, unknown, or other
aagctggagctccccgcggtggcggccgctctagaactagtggatcccccgggctgcaggaattcgcacgagaccattacctagaacatcctaatcgaaaaatctcccaacccctacactcccggcggcggcgcaggagcagcagcaccagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgcccagtaccccaagaaggtggtccgcaggnnactcgccaagaagacnngcaagaagtcgcgcgtcaagtgcttcatcaagctcgtcaactccaccanctcatgccaacccgctaacacctcaaagtcgacttcaagaacttgggcaccgggggggccgaaagcgttcctcaacccgaaaaaaaaggtccccccattgaagggccccaaggggcccccctcagagaaaagttccaaacccgcaaaaaaacgggggttttttcaccaagccccctttttaaaaggggcgggcccccaaaaggggccaccccttttttttttttggggaaaccaacccaaagaggttttttttttttttattgcaaaaaaaacactttttgtttttacccgcgcgcgcccaccaaaaatagggggcggggtacacaaaaagtgggtgcggggaaacacccccccagaggaaagaagtttttttttttttctcacaaataaacaacaaaatttggccccccttcttttccccgcgggggggtg

SEQ ID NO: 44141 - protein, 222 aa, Zea mays
  misc_feature: Ceres CLONE 1445986-F
  misc_feature (7)..(40): Pfam Name: KOW Pfam Description: KOW motif
  misc_feature (57)..(57): Xaa is any aa, unknown, or other
  misc_feature (63)..(63): Xaa is any aa, unknown, or other
  misc_feature (79)..(79): Xaa is any aa, unknown, or other
MVKFLKPGKAVILLQGRFAGRKAVIVRVFEEGTRDRPYGHCLVAGLAQYPKKVVRRXLAKKTXKKSRVKCFIKLVNSTXSCQPANTSKSTSRTWAPGGPKAFLNPKKKVPPLKGPKGPPSEKSSKPAKKRGFFHQAPFLKGAGPQKGPPLFFFWGNQPKEVFFFFIAKKTLFVFTRARPPKIGGGVHKKWVRGNTPPEERSFFFFLTNKQQNLAPLLFPAGG

SEQ ID NO: 44142 - DNA, 622 bp, Zea mays
  misc_feature: Ceres CLONE 1445987-F
  misc_feature: Encodes the peptide sequence at SEQ ID NO. 44143
aaagctggagctccccgcggtggcggccgctctagaactagtggatcccccgggctgcaggaattcgcacgagaccattacctagaacaccctaatcgaaaaaagcttctagggttttcgcgccgccgccgccgcttcgtcgtctccgccgcagcgatgccgtcgcacaagaccttccggatcaagaagaagctggcgaagaagatgcgccagaaccgccccatcccctactggatccgcatgcgcaccgacaacaccatcaggtacaacgccaagcgcaggcactggcgccgcaccaagctcggcttctgagcgcggggatcggccgtctcccgcgtcggattctagggtctctacctttcctttggtttatcgatgtctcttgggttctgtaagctagcaaacgggtcccgaaagcctttgttaaaattttgatgaccctaaaaggatgaagccaccaggcggaccccggatccctgcgggcttgggaggcaaatttaaaaaaccccggttaccccacctttttggggaaagggttccccgggtttgagaccccaaaaatttaaccccgggggcccctcccccaaaccgggaattggggggggctcccttccttttacac

SEQ ID NO: 44143 - protein, 51 aa, Zea mays; identical to SEQ ID NO: 2355
  misc_feature: Ceres CLONE 1445987-F
  misc_feature (9)..(51): Pfam Name: Ribosomal_L39 Pfam Description: Ribosomal L39 protein

SEQ ID NO: 44144 - DNA, 757 bp, Zea mays
  misc_feature: Ceres CLONE 1445988-F
  misc_feature: Encodes the peptide sequence at SEQ ID NO. 44145
  misc_feature (276)..(276): n is a, c, t, g, unknown, or other
  misc_feature (338)..(338): n is a, c, t, g, unknown, or other
  misc_feature (423)..(423): n is a, c, t, g, unknown, or other
  misc_feature (425)..(425): n is a, c, t, g, unknown, or other
  misc_feature (444)..(444): n is a, c, t, g, unknown, or other
  misc_feature (445)..(445): n is a, c, t, g, unknown, or other
  misc_feature (448)..(448): n is a, c, t, g, unknown, or other
  misc_feature (498)..(498): n is a, c, t, g, unknown, or other
  misc_feature (536)..(536): n is a, c, t, g, unknown, or other
  misc_feature (537)..(537): n is a, c, t, g, unknown, or other
  misc_feature (599)..(599): n is a, c, t, g, unknown, or other
  misc_feature (655)..(655): n is a, c, t, g, unknown, or other
  misc_feature (656)..(656): n is a, c, t, g, unknown, or other
  misc_feature (659)..(659): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (688)..(688): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (713)..(713): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (750)..(750): n is a, c, t, g, unknown, or other
caagctggagctccccgcggtggcggccgctctagaactagtggatcccccgggctgcaggaattcgcacgagaccattacctagaacatcctaatcgaaaagtcaaaacgtcgaaaagctagctagcgcaatgtccgccgccaccagcgtctccctcgccgtcgccgacgccgtctgggcggagatcagatccgctggccgcgcatccgacgagcacctatccatcctcgagacgctgttcggaaagaacatgctgcgggcctgcaagatcgtcnacaagcgcggcgtcaggcgcgtcaccggcgcgcccagtggccgctcggtctttctggtgatnggggagtccaaaaggaaggaggattaccccctcctcccggagggggggggcgcgtgttactcattcttcttctacccccccccgncnagggcaaacaactaaacgnnaancccccttggggcggcttcccccaccttggaacaaaaaaaattctaccccntgcaaacccttggcaaaatttaaaaaaggagaaccccnncgccacctttaaacccccctcccccccaaaccaaaaaaaaaattttcgaaaaaaggaattgnggctcccccgagcaccacccccccacccggccgggtttgggggatgggggtggcgnnggngcccnnnnnannnnaaaaaaaaaaaaaanaaaaaannnnnnnnnaacccaaaancctattgtgtctgnnnnnntccnnnnnnnnnnnnntnttgtttt

SEQ ID NO: 44145 - protein, 102 aa, Zea mays
  misc_feature: Ceres CLONE 1445988-F
  misc_feature (49)..(49): Xaa is any aa, unknown, or other
  misc_feature (69)..(69): Xaa is any aa, unknown, or other
  misc_feature (98)..(98): Xaa is any aa, unknown, or other
MSAATSVSLAVADAVWAEIRSAGRASDEHLSILETLFGKNMLRACKIVXKRGVRRVTGAPSGRSVFLVXGESKRKEDYPLLPEGGGACYSFFFYPPPXRANN

SEQ ID NO: 44146 - DNA, 781 bp, Zea mays
  misc_feature: Ceres CLONE 1445992-F
  misc_feature (369)..(369): n is a, c, t, g, unknown, or other
  misc_feature (370)..(370): n is a, c, t, g, unknown, or other
aaagctggagctccccgcggtggcggccgctctagaactagtggatcccccgggctgcaggaattcgcacgagaccattacctagaacatcctaatcgaaaaacgacccgcgtgtaggtgtagcactctccatcctcattgctaactgctcgattctcctccatacccttgtgcacgcacagccaagactgcactgaggaacttgaacagaagaagaagcccggctgagcgctctctcgtctagctagctgcgctgcggcgatgaagatgcatcgcttcactctgcctgcgctggggtttctcgtccggtggatgctgcattgcagaagcgagtccgccacggcggtgactccagatggatggtaagannacaccacctactgcgactgcacaggtcagccggagtcgaccccccacaattgagggattatcaagttcagcaggtgccccagcaggcagccgcgatccccaaagataccccacaacagaaaccggtctcttcccacccgccttcatggggtacaacctcgacaagcaccaccatgttgacttttctcatgctgggtgaacctggcaaggctcaaactcgattcagaataacccccaagctgggctccggaataatccggcgccaagtggcatcgccaaggatgttttgcaaagaccaactgatgggcccttcgtccaggggcgggattactcctgggagtgccccaacgcaaaacctacagtatacttcttttcaaaagcctaacaacacccccgattggagacccctctg

SEQ ID NO: 44147 - DNA, 746 bp, Zea mays
  misc_feature: Ceres CLONE 1445993-F
  misc_feature: Encodes the peptide sequence at SEQ ID NO. 44148
aagctggagctccccgcggtggcggccgctctagaactagtggatcccccgggctgcaggaattcgcacgagaccattacctagaacatcctaatcgaaaaggagcttcgacgtgcggtttccatttccttccctgctctgatggccgtcgccgaagtggcgatcgagattctcccgcagcagcagcagcagcagccgccgccgtcgcagccgcgggaaccggcggtagcgcccccgaacctctccgtgccgagagtgctccagtatctgtacctcttgagcgcgtgggtcgcctgcgcgggcgtggctgccgggaccgtggcgcgccgggccttgggcgactcttccccgttggtctacgggttcctcaaagtctcgatcggagccctcgttttccccgcgctgctcatcctcgtcttcgccctgcgggtcttgcgcgcccatgctgcggtgggggtcagacggtcactccgcactcacgccagggagattcagatccaagccacgaagataattagagcgttaacgtgaaaggtgctgcagaccctatgtgcttggcctgctcgcatctttgcttttcacccggctctctgcacaagtattcgggggtttgggggacttccaccatgaaggattcccccaaaaaaagatggttatgccctcccgaatgggggtatgggggcaagggcaaggtttgctttaatttaaccaattttgccctaaaaattggagagaaaaaggggggg

SEQ ID NO: 44148 - protein, 129 aa, Zea mays
  misc_feature: Ceres CLONE 1445993-F
MAVAEVAIEILPQQQQQQPPPSQPREPAVAPPNLSVPRVLQYLYLLSAWVACAGVAAGTVARRALGDSSPLVYGFLKVSIGALVFPALLILVFALRVLRAHAAVGVRRSLRTHAREIQIQATKIIRALT

SEQ ID NO: 44149 - DNA, 774 bp, Zea mays
  misc_feature: Ceres CLONE 1445994-F
  misc_feature: Encodes the peptide sequence at SEQ ID NO. 44150
aaagctggagctccccgcggtggcggccgctctagaactagtggatcccccgggctgcaggaattcgcacgagaccattacctagaacatcctaatcgaaaactagtcagttccccgccgcccactccatggaggacgacgccatctctgcgctcatggacatcgacaactcgccgctcagcgctgcggggggcgggttcctccaccaggacgacggggaaggctagatgttcatcgccccgcagagcgcggcccgcggaggctctggcgatgcccgcgggcccctccccttattccgggttctgctacagcttctacggcgccgatttccacgacgacgacctcgctctgagggaactgccgcccggctccggaacgcatgtgggtcgtggatcgccaatcgggttatgcccatacagtgatgcggcctcttaatgaccgcatcgattcacactcggatggacaatctgaagatgtttagggatcaacattacctatgtggcatatggttcgtggatgcacatgcgctgggatcagtatagattcctttgtgccccgtgctacgtggatcactgcgcgagtgttctgccgcgtctttcgctgaagtctggcaccatccgtatgatctaatgacccttcctgtggtagcagtctgtcgctggtactcgacgacttgtactatgcttgatagaagacgtcatctgtatgcctgagcatagagcgaagagcttatctataacggcgacttcgaggtgggggcctgtacccagtgcg

SEQ ID NO: 44150 - protein, 32 aa, Zea mays
  misc_feature: Ceres CLONE 1445994-F
MEDDAISALMDIDNSPLSAAGGGFLHQDDGEG

SEQ ID NO: 44151 - DNA, 811 bp, Zea mays
  misc_feature: Ceres CLONE 1445999-F
  misc_feature: Encodes the peptide sequence at SEQ ID NO. 44152
caaagctggagctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagcggccgaggccccggccccggctcccgcgtccgacgccgcgggcggcgtaccccttggcggggcttccttggcgcccccccctttcgttacctctctggtaaaaacgggcccccccccctgttcctgttccaaaaatgatttccctgcctcgggcgcgtggaaacccacccggggggggggggccccccgggaaaaatccccgcgcagtttttatttttttataccccccccccccccccccaacaaaaaggtccccgcgtgggtgtacttttataaaccccccccttttgggggggaaatataacccacgcgcggttttcgggtttataagaggatttttttttgttaaacaaaaaaaaaaaattttttttatttctccactgggggggggcgcgccccacacaccccatatagaaggttttttttctcgccccccaccccgctcccttttttaccctccgtgaaaaaaaacaatggtgtccaccactcacatgttgccctaataccctcct

SEQ ID NO: 44152 - protein, 124 aa, Zea mays
  misc_feature: Ceres CLONE 1445999-F
MAGLRMKFVAVAAMAAALVASAAAAEAPAPAPASDAAGGVPLGGASLAPPPFVTSLVKTGPPPCSCSKNDFPASGAWKPTRGGGAPREKSPRSFYFFIPPPPPPNKKVPAWVYFYKPPPFGGEI

SEQ ID NO: 44153 - DNA, 746 bp, Zea mays
  misc_feature: Ceres CLONE 1446002-F
  misc_feature: Encodes the peptide sequence at SEQ ID NO. 44154
  misc_feature (723)..(723): n is a, c, t, g, unknown, or other
  misc_feature (735)..(735): n is a, c, t, g, unknown, or other
ggagctccccgcggtggcggccgctctagaactagtggatcccccgggctgcaggaattcgcacgagaccattacctagaacatactaatcgaaaacttcctcaccttcactcctcttcctcgtttcccccacggtcaatcgggtgatctgacggcggcggcggcggcggcggcggcactccgagcttccgcaacatggcgacgcggttggctgcggccgcggccgccacgttcatgcggcgcctggccccagcgcgcccaccagtacctatcctggcggcagcatctacggcggaggcggtgacgtgcgggcgcggggacaagaaaaccaagcgcgggaagcggttcaagggctcctacggcaacgcccgaccgaagcgtgagaagaagattgagcgcatcaaggaccgcgtcgaggtgccccgttccactccctggcccctccccttcaagcttatctgagcgcctcccctcggtccgccgggggtaccttgggtttgctgcgacagttgctgctacttcgccgtttccaaatagctgcacgcgctgcacgggcgtgtgtttcctttgtttttaatttgttctcattgtgtggcgtcagatatgtactgcccgcgaactgctgtggttcaagcatatcctttttgatggaagtgaagagatgtgtttctgtccatcattccctctctgtagtgtatgcataattggaaaattatggatccnttattcatcagncaaaaaaaaaa

SEQ ID NO: 44154 - protein, 88 aa, Zea mays
  misc_feature: Ceres CLONE 1446002-F
MATRLAAAAAATFMRRLAPARPPVPILAAASTAEAVTCGRGDKKTKRGKRFKGSYGNARPKREKKIERIKDRVEVPRSTPWPLPFKLI

SEQ ID NO: 44155 - DNA, 755 bp, Zea mays
  misc_feature: Ceres CLONE 1446005-F
  misc_feature: Encodes the peptide sequence at SEQ ID NO. 44156
  misc_feature (674)..(674): n is a, c, t, g, unknown, or other
  misc_feature (717)..(717): n is a, c, t, g, unknown, or other
  misc_feature (718)..(718): n is a, c, t, g, unknown, or other
ctggagctccccgcggtggcggccgctctagaactagtggatcccccgggctgcaggaattcgcacgagaccattacctagaacatcctaatcgaaaagagagatgcgtgttcgtcttccttcccacccatccctgtttctagctcctcctccttccccagcgggtggccgcagcaatttgcaagcagaggaagaaagcttccgggcgtctcggcgcgaagaacagcgtcacgttctgacggaggagaacaggagaaggtctcgggtttcggccggctgcctgtatgagcgccaccatggcgtggtatccattaccgcagagcggaggcacaggcacgccgtcgggcggcggcgagctgttggacgaccagagcggcggctgggcgctctggagcttcggctcagctgacgacgaccacggcgctggcgtggtgcgcgcggagacgcacgggagttcagacgagcggacggaggagggccggcccgcgccgccgcagcagcagcagcaggcaacagacgacatcttcatgagccagttctcggacgaggaggtgaggaagatggacgacgccccgttcgaagcgctgggcatgttcccggactccatgcaccagctgctgtcctacgagaacatgctgagcggcggggcgctgctgagctgctgcagctcgaangacctgctcctgaacgcacgctgggcgtgggacgcatgaacannctgcgctccctctcttcagccacgactgcagctgcaa

SEQ ID NO: 44156 - protein, 142 aa, Zea mays
  misc_feature: Ceres CLONE 1446005-F
  misc_feature (130)..(130): Xaa is any aa, unknown, or other
MSATMAWYPLPQSGGTGTPSGGGELLDDQSGGWALWSFGSADDDHGAGVVRAETHGSSDERTEEGRPAPPQQQQQATDDIFMSQFSDEEVRKMDDAPFEALGMFPDSMHQLLSYENMLSGGALLSCCSSXDLLLNARWAWDA

SEQ ID NO: 44157 - DNA, 769 bp, Zea mays
  misc_feature: Ceres CLONE 1446012-F
  misc_feature: Encodes the peptide sequence at SEQ ID NO. 44158
  misc_feature (223)..(223): n is a, c, t, g, unknown, or other
  misc_feature (224)..(224): n is a, c, t, g, unknown, or other
  misc_feature (262)..(262): n is a, c, t, g, unknown, or other
  misc_feature (340)..(340): n is a, c, t, g, unknown, or other
tggagctccccgcggtggcggccgctctagaactagtggatcccccgggctgcaggaattcgcacgagaccattacctagaacatcctaatcgaaaacttttcctcgcttgccctaattccgcatccccggctgaggcagcagcggcggcgccggcagcggcaccggctcaccagcgataccaggaagaatgggggagtacagtcccgcgtacagccccccgnnagagagacatggcggcagggggaagagccccactcccnaggagagatatgccggtgggcgtggtgaccatggttctgtcaccctcctggtccgaaacttccattggaaatgcagcntgaggaactcctgtccctttcaacggttcggcccggtcgggatttttcccgcccaaaaaattccccccgggaacccaaaaggtttgggtccgggaattctttaacctttaaccccttttgaggccccccccctaaaccccccaagtttttcggggggaaaaaaatgtgttttcctggcgaaaacccaaaaaggcgggggaagttttaaaaaaatcgcccaaagttttttttgttaaaggggggcccccacaccctgggggggggggggccctctttttttaaaaggggcccccccccccccccccgggggggggaaaaaaccacccccccccccccaaaggggtgggttccttcccccccccccccccaggaaaaccccccccccccccccccaccaaaaaaaagggggggggggggcccctccccccc

SEQ ID NO: 44158 - protein, 84 aa, Zea mays
  misc_feature: Ceres CLONE 1446012-F
  misc_feature (12)..(12): Xaa is any aa, unknown, or other
  misc_feature (25)..(25): Xaa is any aa, unknown, or other
  misc_feature (51)..(51): Xaa is any aa, unknown, or other
MGEYSPAYSPPXERHGGRGKSPTPXERYAGGRGDHGSVTLLVRNFHWKCSXRNSCPFQRFGPVGIFPAQKIPPGNPKGLGPGIL

SEQ ID NO: 44159 - DNA, 747 bp, Zea mays
  misc_feature: Ceres CLONE 1446015-F
  misc_feature: Encodes the peptide sequence at SEQ ID NO. 44160
tccccgcggtggcggccgctctagaactagtggatcccccgggctgcaggaattcgcacgagaccattacctagaacatcctaatcgaaaaaaaaccctacagttcatccctctcgacgcgccgccgccgtctcgccgctgcccacccagattgacggctccaattggcgcccatggcggaagaaaccaacataaaaaaggaggaagaggagttcagcaccggtcctctctcggtgctcatgatgagcgtcaagaataatacccaggttcttatcaactgccggaacaacaagaagttgcttggtcgcgtgcgagccttcgatcggcactgcaacatggttcttgagaacgttcgtgagatgtggaccgaggtaccgaagaccggtaaaggcagaagaaagctctcccggtgaacaaggacaggttcataagcaagatgttcctccgcgggaatcggtcatcatcgtcctcaggaaccccgaatgagtaccctgtacacgtagagagtctgtttgctagcagtacgttgtgctattgggtgttagggggatgccaatgctcaaagcttgggagtgtaagtcgcggcaaaatccgctattcgtgttgatggggggggatccaccttaaggcaggatgctaaggctgaattttgcttcttgtaccaaactttaacaggatgcttccttgaatgttccaacaaaccccctggttgaaccccggttccaaccgggtatccaaaaaaaaaaa

SEQ ID NO: 44160 - protein, 79 aa, Zea mays
  misc_feature: Ceres CLONE 1446015-F
  misc_feature (22)..(72): Pfam Name: LSM Pfam Description: LSM domain
MAEETNIKKEEEEFSTGPLSVLMMSVKNNTQVLINCRNNKKLLGRVRAFDRHCNMVLENVREMWTEVPKTGKGRRKLSR

SEQ ID NO: 44161 - DNA, 1803 bp, Zea mays
  misc_feature: Ceres CLONE 1446017
  misc_feature: Encodes the peptide sequence at SEQ ID NO. 44162
attttatacgcgcctcccccgtcccgtctcgtcccctctctctctctccctctcgcgtctcgtcttggccactcaccccacccgccccctctctctttctctctctctgccacagtgcactgctcagtcggcagtcgcagcgctgcggctgtggttcttcttgtcctgttccgccgcccgcccgcccgctgctactgctgggatagtgaaacctggtgcctggtggttcggttaggtgcttccctcgtcaacgtcagacgcccccacttccgccagcaacaacaccagcagcagcacgatgatgagcttcaggagcagcagccacgagggcttcggcttcggccacgccgccgccgcggccagcggagcgccgctgccgtggtgggcagggccggccccgatgctgagcggcgagccgctggccctgtcgccggaggcccactgccgggacggccgcatccaggccccccagggacctcccgtgccgtcggtcaaggctcctgtactggcaccccagcagccgcctccgctgccggagagggggatccctgagctcctcaacctctccgtggatcctcaaggtaaagggaagaaaggatctgatcactctgccactattgctttgcaatcaccatttgcaatatacaatgctcattttgagctgggccttggtcaatcaatgatttccgctgataattcttatgctgatcaacactatggcctgctttctccttatccagtgggtgcaacgcctggaggtcgtctgcttataccactgaataggccaacagaagcaccaatttatgtgaacgctaagcaatatgacgccatcatgcgtcggcgctgtgcccgtgccaaagcagagagggaaaataggctggtcaaaggcaggaagccatatctccatgagtcacgccatcagcatgcactgcgtcgcccgcgaggctctggcggacgcttcctgaacacaaagaaagaatccagcgggaaggatgctggtggtggcagcaaggcaatgttcagcaaccccctcatgcgccaggtggcgtctccaagctcagagatccagcagtcagacctgggcaacccgagcagcgtgtccagcctgtcgggttcagaggtgtcaagcatgtacgaccatgaagacgcgggtcactgccacggcttggatcaccccttcttcacccggctcccgagcatcatggacggcggcgagcacggggtcatcgtctgcaaccccttcaagtgggcagcggcctctgaagtctgctgcgacctcctgaaagcatgactagaggggttaccggacggccaaacgctaggagctggtgactgctggcggtttccagctccgggtcaggggttgtccctccctccgtttggctcccggtaggcaaatcattcttggctgaaggcaacgtgagcgttccactcgtcccacctatttctcctggaaactctggctcctagtttctgggatcttgtggtgagtgcaacatcccttgcctaaaaaaacaaaaaaaaatcactagttgattgtactatctaccaacttctaaatggtttcaccttagctttctgaataataaagcctgaaacttcggactcgtctgaagtttcagaggtactggagttctgctatgtatggattctgttaagcgtcaagactaaggttctgttggtgatgaattgtagtgtgattggagcttgggtggtcttgattcctactttgtaatgtgctgaaagcttgtgctagagtaatgtattggaactggagcttggtttgtaaaaaaaaaaaaaaaa

SEQ ID NO: 44162 - protein, 330 aa, Zea mays
  misc_feature: Ceres CLONE 1446017
  misc_feature (165)..(221): Pfam Name: CBFB_NFYA Pfam Description: CCAAT-binding transcription factor (CBF-B/NF-YA) subunit B
MMSFRSSSHEGFGFGHAAAAASGAPLPWWAGPAPMLSGEPLALSPEAHCRDGRIQAPQGPPVPSVKAPVLAPQQPPPLPERGIPELLNLSVDPQGKGKKGSDHSATIALQSPFAIYNAHFELGLGQSMISADNSYADQHYGLLSPYPVGATPGGRLLIPLNRPTEAPIYVNAKQYDAIMRRRCARAKAERENRLVKGRKPYLHESRHQHALRRPRGSGGRFLNTKKESSGKDAGGGSKAMFSNPLMRQVASPSSEIQQSDLGNPSSVSSLSGSEVSSMYDHEDAGHCHGLDHPFFTRLPSIMDGGEHGVIVCNPFKWAAASEVCCDLLKA

SEQ ID NO: 44163 - DNA, 788 bp, Zea mays
  misc_feature: Ceres CLONE 1446019-F
  misc_feature: Encodes the peptide sequence at SEQ ID NO. 44164
  misc_feature (349)..(349): n is a, c, t, g, unknown, or other
  misc_feature (367)..(367): n is a, c, t, g, unknown, or other
  misc_feature (391)..(391): n is a, c, t, g, unknown, or other
  misc_feature (400)..(400): n is a, c, t, g, unknown, or other
tggagctccccgcggtggcggccgctctagaactagtggatcccccgggctgcaggaattcgcacgagaccattacctagaacatcctaatcgaaaaccttttcccctcttcgtcgatctcaccaccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccngagacagtctacgacatncagtacttcacccgcgacggccgncgggaaccngtcgcccgtgcgccgcaccttgctcccgaagcccgacctcgagcgctacatggtcaccaagcagtttgaccccaaccaaggaattccccgggccatacttcaaccccactgtcgaggaggacgacaaccgggcggcggtggctaccaaaaatgatccagggggggggggctccccccttaaatccgatggggcccctagggttccaccttttttctttggcacccgggggcccgcttcccaatttttcagggggaggacttttcccaccttttaaggggggggaaacacaaaggtgttaaaaaaaaaaaaaaacggcggttaaaaaaaattttttggggttttccccaaaaaaaaagaatttttttggggagggggggggttgggggg

SEQ ID NO: 44164 - protein, 109 aa, Zea mays
  misc_feature: Ceres CLONE 1446019-F
  misc_feature (76)..(76): Xaa is any aa, unknown, or other
MASAASSAAAAGKSLFQGFRRFLKKPWEITGPCASPEYRSALPGALEYRVKCPATVRDDRDKAIVPTSDPETVYDXQYFTRDGRREPVARAPHLAPEARPRALHGHQAV

SEQ ID NO: 44165 - DNA, 773 bp, Zea mays
  misc_feature: Ceres CLONE 1446020-F
  misc_feature: Encodes the peptide sequence at SEQ ID NO. 44166
  misc_feature (413)..(413): n is a, c, t, g, unknown, or other
aagctggagctccccgcggtggcggccgctctagaactagtggatcccccgggctgcaggaattcgcacgagaccattacctagaacatcctaatcgaaaaaagagccaagaggtggtgagagagaggaccgaggagggaaacagagaagatgacgacgaagcgcgacaccgagtcggacggcgaaggctctaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaagacttttgcaattctctctggcgttcagagtttggtttnccccccccccccaaggctacgtggcaaggatgacattgtcaatgctggtatagctggttgttgaactggcctcgctttgggctttccgggggccgcacaggcattgctccaagctgtgcaccttcgccgcattctcatgcatcatggaggggctcaataagcagcaggctgcaatggctcgcacgcttggagggactgccccgaatggccttgcatgaaaaatgtggggttctgcccccgtttccgcttcccacctattcctgatgcatctgaaggctttaccttcttgcctgcttaagggttagtaaggccctagcccttgatcttcccattaaagggcgtgagccaatgcgcaaaaaa

SEQ ID NO: 44166 - protein, 108 aa, Zea mays
  misc_feature: Ceres CLONE 1446020-F
  misc_feature (26)..(109): Pfam Name: Tim17 Pfam Description: Tim17/Tim22/Tim23 family
  misc_feature (88)..(88): Xaa is any aa, unknown, or other
MTTKRDTESDGEGSNPVGGGATPPPLAAAPVVCLLRSAGDFGGGAFVGSIFGYGQGLITKKGFKGSFSNAGSSAKTFAILSGVQSLVXPPPPRLRGKDDIVNAGIAGC

SEQ ID NO: 44167 - DNA, 755 bp, Zea mays
  misc_feature: Ceres CLONE 1446021-F
  misc_feature: Encodes the peptide sequence at SEQ ID NO. 44168
  misc_feature (548)..(548): n is a, c, t, g, unknown, or other
  misc_feature (556)..(556): n is a, c, t, g, unknown, or other
  misc_feature (724)..(724): n is a, c, t, g, unknown, or other
aagctggagctccccgcggtggcggccgctctagaactagtggatcccccgggctgcaggaattcgcacgagaccattacctagaacatcctaatcgaaaaacaaacacgagccacgggccatccattacgctcaggtgcaatggatgccgggtccctccaagagatcactacgtgtcctggcaatttgttgacctgctggggcagccagcaactgctgttggtttccagttcaacctgaccgcaaggcaacatggcaacaatcagcacatgagctttgtgagtggtacaatgaactctgacggttatactgatgatgtcaagttgaagacgttcagggggagggattccaatgttctaaaatccagctgtttcctcagatatacaacaatcttggtaacctgccgctcttgcagccactggggtcagacttcactcaaagatctatgttttctgatgtcagcagcttgaattcctccctgcaaaaccctaggaatgaagtggtgaatactactctctacataagttatctctcagactacattgtgnagatcagncatgagagtgtagtaggcccagttagtgtactcgcaagtatgggtggcctttatgcccttcagtgtggcaattgtctcctgctcatgtctcaatgtgaagcaaggataaagaagcttcgtgacgaggattaccgaatgctgaaaattctgagcaaacgacgtgctcancggaaattgggataacctgcggaaagttgtc

SEQ ID NO: 44168 - protein, 155 aa, Zea mays
  misc_feature: Ceres CLONE 1446021-F
AGAPRGGGRSRTSGSPGLQEFARDHYLEHPNRKTNTSHGPSITLRCNGCRVPPRDHYVSWQFVDLLGQPATAVGFQFNLTARQHGNNQHMSFVSGTMNSDGYTDDVKLKTFRGRDSNVLKSSCFLRYTTILVTCRSCSHWGQTSLKDLCFLMSAA

SEQ ID NO: 44169 - DNA, 854 bp, Zea mays
  misc_feature: Ceres CLONE 1446023-F
  misc_feature: Encodes the peptide sequence at SEQ ID NO. 44170
  misc_feature (389)..(389): n is a, c, t, g, unknown, or other
  misc_feature (390)..(390): n is a, c, t, g, unknown, or other
  misc_feature (392)..(392): n is a, c, t, g, unknown, or other
  misc_feature (398)..(398): n is a, c, t, g, unknown, or other
  misc_feature (401)..(401): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (408)..(408): n is a, c, t, g, unknown, or other
  misc_feature (425)..(425): n is a, c, t, g, unknown, or other
  misc_feature (428)..(428): n is a, c, t, g, unknown, or other
  misc_feature (429)..(429): n is a, c, t, g, unknown, or other
  misc_feature (452)..(452): n is a, c, t, g, unknown, or other
  misc_feature (453)..(453): n is a, c, t, g, unknown, or other
tccccgcggtggcggccgctctagaatagtggatcccccgggctgcaggaattctcacgagaccattacctagaacatcctaatcgaaaaatccagcatacgatctgacgctcatcccacatcagtagtcgaccaagcacaagcagcatatccggccggaatatgtggacgatcaggaaggtggcgacgccgcaggtggccgtcctcctgctgctcctcatcgtcgttgcgcaggaagcggggccgttgggcggaagctcccgtgtgccgccgcctatattcggccttcaaggggtgctgcatgtcccaccctcttttttccgcaggtgtgcttgcaagagggccaccgccgttttttttttttcccccccccgaggaaagaaaggggnncncccttncanttnnnanttgggcctttccccccnaannaaaaaaaaaaaaaaaaaatgcanncaatgggtgagaagtccaaaaagacccagccccccaacgccgagccccttcatgtgaagggttacttagtaggtgctccctctatcccactcactctctgctcacgaatatttagcatttacttccgcccgcgcgcctctccggttcttcctcgctctttgtctctttgtcctgcatgtggtccgagtccgcctccccctccccggtctttacatctcccaccccctacaccaccatcccccgaactacgaccactccctacctccctttccccttccccctcttcacccgatcagctatctaacagattttcgccgcctctcggttaactctcttccttgcgcgtcttctccttccgcgcttagctatcacttgcacctcaccgtcttccataactatgg

SEQ ID NO: 44170 - protein, 115 aa, Zea mays
  misc_feature: Ceres CLONE 1446023-F
  misc_feature (76)..(76): Xaa is any aa, unknown, or other
  misc_feature (77)..(77): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (88)..(88): Xaa is any aa, unknown, or other
  misc_feature (89)..(89): Xaa is any aa, unknown, or other
  misc_feature (97)..(97): Xaa is any aa, unknown, or other
MWTIRKVATPQVAVLLLLLIVVAQEAGPLGGSSRVPPPIFGLQGVLHVPPSFFRRCACKRATAVFFFSPPRGKKGXXPXXXXLGLSPXXKKKKKKCXQWVRSPKRPSPPTPSPFM

SEQ ID NO: 44171 - DNA, 822 bp, Zea mays
  misc_feature: Ceres CLONE 1446024-F
  misc_feature (282)..(282): n is a, c, t, g, unknown, or other
  misc_feature (283)..(283): n is a, c, t, g, unknown, or other
  misc_feature (364)..(364): n is a, c, t, g, unknown, or other
tggagctccccgcggtggcggccgctctagaactagtggatcccccgggctgcaggaattcgcacgagaccattacctagaacatcctaatcgaaaaaaaaatcccagacgccacgccacccaacacatacaaacacacgcacgcgcgcgcgcgcgcctcccgctgttccgcaaaacaaaggaaacgaaggagaggaggccatggcgccgaagacgtcagagaaaacatggcaccggcggcgggcgctgccacggggctcgcgctcagcgtcggcggcggcnngcgggcccggcggcccgcactacaaaagcgtgaggaaacgggccgtgggcccggtacccggccgaaatccgccacccgggnaagaacaccccggtggtggtcggcccctaacaaccggccgaaagacctccccccgggcctaaaaacccccccggcggggattcccgcggccccaagggcaaaaacaaatttcccttaccccccggggggggcccccctccccacccggttgccgggaaaaaaaaaagggagccccgtaaaatcctttcaaaaagacacccaagggccccccctggagggcaaggccctccccccccctctctcagaatggaaccttttcccacccgggggggcgccccccaccaggacaaggggggttttcccccacaaatttctctcttttgggagaaaccccctttaccccccccatatattttttttggggagggcccgcaccccccccccacaaaaagagggggtctttttataaaaagggggcccccggcactccgggggaaaaaaaaaccccaaattgtttt

SEQ ID NO: 44172 - DNA, 742 bp, Zea mays
  misc_feature: Ceres CLONE 1446027-F
  misc_feature: Encodes the peptide sequence at SEQ ID NO. 44173
  misc_feature (488)..(488): n is a, c, t, g, unknown, or other
  misc_feature (493)..(493): n is a, c, t, g, unknown, or other
  misc_feature (544)..(544): n is a, c, t, g, unknown, or other
  misc_feature (555)..(555): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaatctgtagcgtgcatttatacagctcgtgtgtgcgtccgctgacaagccagggcaaggagagcagccggcagagagcaggcccggcaccgccaccgccagccatgacgttggacgaatcgttcaagaggcccggcaccgtcccgttcaagtgggaggtgcagccgggcatccccaagcagcaaggtgcagccggcgacgtccctccgccgccgaccagtccgaggctggcgcttcctcccgccgcccgcgtcgccgcgccgctggcgaccccgcacccgcagccgtcgcactcgcaccggcggtccatgtccgcgcgcttcgtcacgtcgctggcgctgatgcccttcgtcaccggcggggacggggaaggaggaggaggaggaggaggacncgccngcgccggcgccggcaactgcgaggacgaattctgcctgctgtacggcgacnaggccgcctangtagtctctgtgcgctgtagatagagatcagatgtagcatgtaaacgtgggaaatcagttctggaacgacaggcgtcgtcgtcgtcgtcgtactatgaaacatcgacggaaancgaaaacgaatgagggatcgaaaaaaaaaaaaaaaaagcttatcgataccgtcgaactcgaagggggggccggt

SEQ ID NO: 44173 - protein, 126 aa, Zea mays
  misc_feature: Ceres CLONE 1446027-F
  misc_feature (97)..(97): Xaa is any aa, unknown, or other
  misc_feature (99)..(99): Xaa is any aa, unknown, or other
  misc_feature (116)..(116): Xaa is any aa, unknown, or other
  misc_feature (119)..(119): Xaa is any aa, unknown, or other
MTLDESFKRPGTVPFKWEVQPGIPKQQGAAGDVPPPPTSPRLALPPAARVAAPLATPHPQPSHSHRRSMSARFVTSLALMPFVTGGDGEGGGGGGGXAXAGAGNCEDEFCLLYGDXAAXVVSVRCR

SEQ ID NO: 44174 - DNA, 784 bp, Zea mays
  misc_feature: Ceres CLONE 1446028-F
  misc_feature: Encodes the peptide sequence at SEQ ID NO. 44175
  misc_feature (303)..(303): n is a, c, t, g, unknown, or other
  misc_feature (317)..(317): n is a, c, t, g, unknown, or other
  misc_feature (326)..(326): n is a, c, t, g, unknown, or other
  misc_feature (359)..(359): n is a, c, t, g, unknown, or other
  misc_feature (362)..(362): n is a, c, t, g, unknown, or other
  misc_feature (388)..(388): n is a, c, t, g, unknown, or other
  misc_feature (403)..(403): n is a, c, t, g, unknown, or other
  misc_feature (405)..(405): n is a, c, t, g, unknown, or other
  misc_feature (483)..(483): n is a, c, t, g, unknown, or other
ggagctccccgcggtggcggccgctctagaactagtggatcccccgggctgcaggaattcgcacgagaccattacctagaacatcctaatcgaaaatatcaagaattcgcacgagaccattacctagaacatcctaatcgaaaaacgacacaactccgagggccgaggccagcaacgcaaagcagcacgttcccgtcccgacgcgcttcccgtctgagtccgccgcggacatcgatccccagttccgtccccatgtggccgtcctgggtcaagacgcgcagctctgacgactcccgcgtcggngccgccgcctccancctccacgncgtcggggcgtgcccctcgctctccatcccaanccngtgtctcaaggacctccggtccctgncttccgcgggactcntnccgctccccggcgccgggcggtttccaccggctccggggtcgccgcctgggggctccggggtcctccgcggaatcagnatcccggggcccagtcccccccccggggaaaggaaccaaccccgggccccttggggggggggggtggggtggtattctcccccccccgggggggccccggccccaaaaaagaggcgcggggggggccctttttgggggggtctcccccccctcaaaagagacccccttgttagagccccgttctctcgggggggtggtttcccctctcccccccggggggggcggggggggccccccccttttttggggggcccccccccggcgggcgaagagggggggcccctcacaagggggagagctc

SEQ ID NO: 44175 - protein, 177 aa, Zea mays
  misc_feature: Ceres CLONE 1446028-F
  misc_feature (22)..(22): Xaa is any aa, unknown, or other
  misc_feature (25)..(25): Xaa is any aa, unknown, or other
  misc_feature (36)..(36): Xaa is any aa, unknown, or other
  misc_feature (37)..(37): Xaa is any aa, unknown, or other
  misc_feature (46)..(46): Xaa is any aa, unknown, or other
  misc_feature (51)..(51): Xaa is any aa, unknown, or other
  misc_feature (77)..(77): Xaa is any aa, unknown, or other
MWPSWVKTRSSDDSRVGAAASXLHXVGACPSLSIPXXCLKDLRSLXSAGLXPLPGAGRFPPAPGSPPGGSGVLRGIXIPGPSPPPGERNQPRAPWGGGVGWYSPPPGGAPAPKKRRGGGPFWGGLPPLKRDPLVRAPFSRGGGFPSPPRGGRGGPPPFLGGPPPAGEEGGPLTRGRA

SEQ ID NO: 44176 - DNA, 754 bp, Zea mays
  misc_feature: Ceres CLONE 1446030-F
  misc_feature: Encodes the peptide sequence at SEQ ID NO. 44177
  misc_feature (506)..(506): n is a, c, t, g, unknown, or other
  misc_feature (588)..(588): n is a, c, t, g, unknown, or other
  misc_feature (639)..(639): n is a, c, t, g, unknown, or other
  misc_feature (679)..(679): n is a, c, t, g, unknown, or other
ctggagctccccgcggtggcggccgctctagaactagtggatcccccgggctgcaggaattcgcacgagaccattacctagaacatcctaatcgaaaaaccgtcaacggcggccgcgcgctcacgtcccggcggccacgggccgtgacagactcgagcccgtccgccgccttcgccgcgccgcctccgcctcctccatcgcacgccgactccgctgcctacatccgcgcacgtccgcctccactgcctccatccgctcgggagccgccgccctccgcgctaggcctcgcctccgtctggtctggattcttcgacatctggccatctgggcgctccgcgtcgccgacttctcgcaggcagagagtgagcatccttgatagacctgatggctatcgcagagagctgtgttgatgcggtggtcatggagatggtggcagtctactgcggtggcctctacaccgccaaaccagagcttgctgcccgccgcatcgaggccatcggcttccnagtcgggcaccagctctctgagagatataccatggagcgccctcgatttagtgatcatcttgaaagcatcaagtttatctgncaagatttttggtcagagctgttcaagaagcagatttgacatctgaaaacnaatcacaggggtacctttgtccttcagataaccgttttcngtggcttactcgtgtttctctagatcccgtacagagacacagattcactgaaatgatcctgcagcattgggtgaa

SEQ ID NO: 44177 - protein, 80 aa, Zea mays
  misc_feature: Ceres CLONE 1446030-F
  misc_feature (41)..(41): Xaa is any aa, unknown, or other
  misc_feature (68)..(68): Xaa is any aa, unknown, or other
MAIAESCVDAVVMEMVAVYCGGLYTAKPELAARRIEAIGFXVGHQLSERYTMERPRFSDHLESIKFIXQDFWSELFKKQI

SEQ ID NO: 44178 - DNA, 752 bp, Zea mays
  misc_feature: Ceres CLONE 1446031-F
  misc_feature: Encodes the peptide sequence at SEQ ID NO. 44179
  misc_feature (427)..(427): n is a, c, t, g, unknown, or other
  misc_feature (582)..(582): n is a, c, t, g, unknown, or other
  misc_feature (591)..(591): n is a, c, t, g, unknown, or other
  misc_feature (607)..(607): n is a, c, t, g, unknown, or other
  misc_feature (656)..(656): n is a, c, t, g, unknown, or other
  misc_feature (669)..(669): n is a, c, t, g, unknown, or other
  misc_feature (707)..(707): n is a, c, t, g, unknown, or other
ggagctccccgcggtggcggccgctctagaactagtggatcccccgggctgcaggaattcgcacgagaccattacctagaacatcctaatcgaagaccgtgtaaaactccaaccgcgcatcgtcgtcgtcgtcggctgcggcggcggccgggcaacgagcctcctcgaaacgacgcgcccgctctcccacatgctgcgctgtcacgcgccaccgcaatgcggccgcgcgccgctccgccaccacggaaggtgggagtcgtctcccgcacccggggtggtggtgcggtgcacgcggggtgcgccgcaggtatccgggatcgaggcggcgtcgccggaccacgcagctgccacggcggtggcggctaaggcggaagggggtgacgcgcggcccagcctggccgagcggctgcgactggggagcctcctnggagacgggctctcttacaaggagagtttcatcgtgcgctgctacgaggtgggtatcaacaagacggccaccgtcgagacccatcgcaatctcctcccagaggtaggatgtaaccatgcacaaagtgttgggttctctactgatggcttcgccancactactancatgagaaaacttggnactatttgggtgacgaaccgaatgcacattgagatcctacagtacccancttggggtgatgntgttgagatcgaaacatggtgcccagaagatggaaaantggtactcgtcgtgatgggacctccaagacctgtgtactggtgaa

SEQ ID NO: 44179 - protein, 186 aa, Zea mays
  misc_feature: Ceres CLONE 1446031-F
  misc_feature (82)..(183): Pfam Name: Acyl-ACP_TE Pfam Description: Acyl-ACP thioesterase
  misc_feature (131)..(131): Xaa is any aa, unknown, or other
  misc_feature (134)..(134): Xaa is any aa, unknown, or other
  misc_feature (156)..(156): Xaa is any aa, unknown, or other
  misc_feature (160)..(160): Xaa is any aa, unknown, or other
  misc_feature (173)..(173): Xaa is any aa, unknown, or other
MLRCHAPPQCGRAPLRHHGRWESSPAPGVVVRCTRGAPQVSGIEAASPDHAAATAVAAKAEGGDARPSLAERLRLGSLLGDGLSYKESFIVRCYEVGINKTATVETHRNLLPEVGCNHAQSVGFSTDGFAXTTXMRKLGTIWVTNRMHIEILQYPXWGDXVEIETWCPEDGKXVLVVMGPPRPVYW

SEQ ID NO: 44180 - DNA, 757 bp, Zea mays
  misc_feature: Ceres CLONE 1446032-F
  misc_feature: Translation starting site: 225
  misc_feature (435)..(435): n is a, c, t, g, unknown, or other
aagctggagctccccgcggtggcggccgctctagaactagtggatcccccgggctgcaggaattcgcacgagaccattacctagaacatcctaatcgaaaaaaccaccgcgctccggctctccccaattctaagcgagacggggcacaggaagaggagagcctaaaaccctaaccccccgaatcggatccggccgccggagcgcggaaccccaccccggccgccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaggtccgaacgggccccgacagcctcaagcttcttgaagatgcggaacccaactggaggaggcacttcnaattgatcccataagtccgatgcactctggtgcttgggaaatgctcagacctctcatggattcttcactccagacaatgcaatagctaatgagttctttacaaaggcaaccggatgttttcagaaggctgttgatgtgggccttgcaaatgagctgtacaggaagtctctaaactggtcaatgaaggcccctgaactgcatttggagatccggaggccaatggtttctcaagcggcaaaccaagcatcctcagccttcaaatccaaggaattcagggaaaaagaagacaatggacttctgggacgatgtttgtgggatgggt

SEQ ID NO: 44181 - DNA, 937 bp, Zea mays
  misc_feature: Ceres CLONE 1446033-F
  misc_feature: SWISSPROT Homolog: EC 3.3.1.1 Adenosylhomocysteinase
  misc_feature (1)..(1): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (48)..(48): n is a, c, t, g, unknown, or other
  misc_feature (49)..(49): n is a, c, t, g, unknown, or other
  misc_feature (427)..(427): n is a, c, t, g, unknown, or other
  misc_feature (428)..(428): n is a, c, t, g, unknown, or other
  misc_feature (448)..(448): n is a, c, t, g, unknown, or other
  misc_feature (482)..(482): n is a, c, t, g, unknown, or other
ntttgtcccctcggggcctctttattaaaccataccnncncccccccnntataactgggactccccgcggtggcggccgctctagaatagtggatcccccgggctgcaggaattcgcacgagaccattacctagaacatcctaatcgaaaactaaccgggtcattgcccaacttgaactgtggaacgacaagagctctggcaagtatgacaagaaggtgtatgtgctccccaagcaccttgatgagaaggttgctgctctccacttgggcaagcttggtgccaagtggaccaagctcaccaagtctcaggccgactacatacagcgtgtcgatcgagggtccctacaagccttgcccactaccggaactaagcacacggcttgtagctcactccggcccgttgtgtgctaagaagattggtaaaaannaaatggggagataaacaaanaccacccattttacaattaccaccccaccccccncttcacgtaaccaagggtttttccttcaagagcttaccccccttcgcgttattaacacgcgcgggcaggggtaagggaagcctcgctcccgcccattttgcgccgcacagtaactaaactgggctccggaacttacctgcgcttggtgcatatcaaatggtctgcaatgtcggccctctttgccctccagcataccgctttttttcgaccccaccccacatccctactccacccaagtggcttgtatgatatcaagttagggagaagacattactttgccgtgctagccctactagtggtgcccttacaataggacaacactttgctcattttcatacgcgtggacggatactcgtacaactgtttgtatgcctctcaacagagtataataacaaacagccgtctttttcacacctctctataccacctagcgcaggccctttggtctccaacat

SEQ ID NO: 44182 - DNA, 755 bp, Zea mays
  misc_feature: Ceres CLONE 1446035-F
  misc_feature: Encodes the peptide sequence at SEQ ID NO. 44183
  misc_feature (333)..(333): n is a, c, t, g, unknown, or other
  misc_feature (412)..(412): n is a, c, t, g, unknown, or other
  misc_feature (564)..(564): n is a, c, t, g, unknown, or other
  misc_feature (617)..(617): n is a, c, t, g, unknown, or other
ctggagctccccgcggtggcggccgctctagaactagtggatcccccgggctgcaggaattcgcacgagaccattacctagaacatcctaatccaaaaagaatgggcctactacggaagtcatttctccctatctaaggccacctttcactccgccgttctctgtcacgaccgggaaaaacctcgccgccgccggcctcctctctcttgccttccatcccccgttgcgtcgaaccgtccctctcggtaaacccgcatcgccttgaacccttaacctccaggcggaggatccgccgaaaggctggacccgttacccccatcctgcacggcgcangggagtagagagaggatgatggagtcggaggtggtgaggatggaaatggtgctggcgccaacgctgccgttcaagaagngcacacggcggacaagtatcccaagggccagtcccggggccgccagtggaaacacctgcgccacctgctccagtccgctgatgcatcctccatgcccccggaccgccccattatatgaatatccaatcgcccccatccattaacccaccaangagatactgtgacttaacaggttttgaggcacggtacgtgaatccgagacaangtggcgctactctgatccaaaggtgtcaagcaaatcggatgctcctgatgatacgtccaaggtacctggccttgagaatgcaccattatcctgcataacaatacctagggtagcatctttgtgcctactatgctgaaa

SEQ ID NO: 44183 - protein, 62 aa, Zea mays
  misc_feature: Ceres CLONE 1446035-F
  misc_feature (13)..(13): Xaa is any aa, unknown, or other
  misc_feature (31)..(31): Xaa is any aa, unknown, or other
MNIQSPPSINPPXRYCDLTGFEARYVNPRQXGATLIQRCQANRMLLMIRPRYLALRMHHYPA

SEQ ID NO: 44184 - DNA, 734 bp, Zea mays
  misc_feature: Ceres CLONE 1446040-F
  misc_feature: Encodes the peptide sequence at SEQ ID NO. 44185
  misc_feature (498)..(498): n is a, c, t, g, unknown, or other
  misc_feature (597)..(597): n is a, c, t, g, unknown, or other
  misc_feature (607)..(607): n is a, c, t, g, unknown, or other
tggagctccccgcggtggcggccgctctagaactagtggatcccccgggctgcaggaattcgcacgagaccattacctagaacatcctaatcgaaaaaactctgaaggcgctacagcaacgtcgccacttcactcacgattggagtttcacctcggcagcccagccagccagtggttcctcggctcggaggaacaggcgaacagcaagagcttctgaagatgaaggcaatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaacagcgccccnagtgcccctaggccctaccgctctaagggagggaggatgacccaggatttcgctcgcgatcctgcacagcttctagtcttgtactgctagtttagcgcngcgagcgtcngaaatgtcgcgacggtccttcccgtgctgtgtgctgtgtttctctccgacgtgctataacctagaaataatacccatgcactgtaaaaaaaaaaaaaaaaagcttatcgataccgtcgacctcgagg

SEQ ID NO: 44185 - protein, 122 aa, Zea mays
  misc_feature: Ceres CLONE 1446040-F
  misc_feature (1)..(91): Pfam Name: GASA Pfam Description: Gibberellin regulated protein
MKAIPVALLLLVLVAAASSFKHLAEAADGGAVPDGVCDGKCRSRCSLKKAGRCMGLCMMCCGKCQGCVPSGPYASKDECPCYRDMKSPKNSAPSAPRPYRSKGGRMTQDFARDPAQLLVLYC

SEQ ID NO: 44186 - DNA, 761 bp, Zea mays
  misc_feature: Ceres CLONE 1446041-F
  misc_feature: Encodes the peptide sequence at SEQ ID NO. 44187
  misc_feature (613)..(613): n is a, c, t, g, unknown, or other
  misc_feature (625)..(625): n is a, c, t, g, unknown, or other
  misc_feature (647)..(647): n is a, c, t, g, unknown, or other
  misc_feature (680)..(680): n is a, c, t, g, unknown, or other
  misc_feature (708)..(708): n is a, c, t, g, unknown, or other
  misc_feature (709)..(709): n is a, c, t, g, unknown, or other
  misc_feature (725)..(725): n is a, c, t, g, unknown, or other
  misc_feature (761)..(761): n is a, c, t, g, unknown, or other
ggagctccccgcggtggcggccgctctagaactagtggatcccccgggctgcaggaattcgcacgagaccattacctagaacatcctaatcgaaaactctttcgatagctggcgaaggcgcggcgcgcagggccagtagcaaccctcccatggcctacgctgcgcctcccatggcgtcgtccctcaccgcctcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcggtcggaggccgcgtcgtcgctggagagatacctctcggcgacggtgacgggagcggtgatgggaacgggggcggccccaccagcttcggccccgccgcgcgccccgccggcgatgaaggggggacggaagcagtatagcgcgttgggggctgtcacgctcgagaagggcaagctcgatctctcccagcgccgcaagaatatcatgcccgaagttgcgacaggtggtggtggtgagatatngaaaaaagatcngtcatggtgggggtgaatgtgntgaatgatgaagggggacaatgatgactacttngatgatttttgatgaagagaagaagaanngtggggctttcaggangcggatttgtgtacaggagctattcatagggagtcn

SEQ ID NO: 44187 - protein, 51 aa, Zea mays
  misc_feature: Ceres CLONE 1446041-F
  misc_feature (43)..(43): Xaa is any aa, unknown, or other
  misc_feature (47)..(47): Xaa is any aa, unknown, or other
MKGGRKQYSALGAVTLEKGKLDLSQRRKNIMPEVATGGGGEIXKKDXSWWG

SEQ ID NO: 44188 - DNA, 702 bp, Zea mays
  misc_feature: Ceres CLONE 1446044-F
  misc_feature: Encodes the peptide sequence at SEQ ID NO. 44189
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (391)..(391): n is a, c, t, g, unknown, or other
  misc_feature (394)..(394): n is a, c, t, g, unknown, or other
  misc_feature (395)..(395): n is a, c, t, g, unknown, or other
  misc_feature (702)..(702): n is a, c, t, g, unknown, or other
ctccccgcggtggcggccgctctagaactagtggatcccccgggctgcaggaattcgcacgagaccattacctagaacatcctaatcgaaaagactgcacactcgtctccgcagtttgaaacgaagcccgcggctactgcaagctactccgtctccgtagctaaaggagaggtaggtttttatttggcgacgacatgagcacgggcgtgcggccggggcggcggttcacggtggggcgaagcgaggacgccccgcacccggacaccatccgcgccgccatctccgagttgatcgccaccgccatcttcgtcttcgccggcgagggatccgtcctctccctcgggagatgtattattacccccccccgggggggtggggggggtttnnnncntgnncaccccccccccctgcccgggccggggcaatggcctccacactcggggggggacctaaacccggcgggacctttcgggggttcggtgggggcccttcttcctaagtcccgggggcttttaatgggccgccagttctgggcgcctccccccccattgttcttgaggttgacacaggggcaagccccccccggttccacccctccccggggagaggaatctacccccggccctggaggcctcattattttccccccttcccccactagccggtgtcaaccccacgcggggacgggtcccactccgctcn

SEQ ID NO: 44189 - protein, 169 aa, Zea mays
  misc_feature: Ceres CLONE 1446044-F
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
MSTGVRPGRRFTVGRSEDAPHPDTIRAAISELIATAIFVFAGEGSVLSLGRCIITPPRGGGGGXXXXHPPPLPGPGQWPPHSGGDLNPAGPFGGSVGALLPKSRGLLMGRQFWAPPPPLFLRLTQGQAPPGSTPPRGEESTPGPGGLIIFPPSPTSRCQPHAGTGPTPL

SEQ ID NO: 44190 - DNA, 791 bp, Zea mays
  misc_feature: Ceres CLONE 1446045-F
  misc_feature: Encodes the peptide sequence at SEQ ID NO. 44191
  misc_feature (264)..(264): n is a, c, t, g, unknown, or other
  misc_feature (266)..(266): n is a, c, t, g, unknown, or other
  misc_feature (382)..(382): n is a, c, t, g, unknown, or other
  misc_feature (449)..(449): n is a, c, t, g, unknown, or other
  misc_feature (481)..(481): n is a, c, t, g, unknown, or other
  misc_feature (484)..(484): n is a, c, t, g, unknown, or other
  misc_feature (488)..(488): n is a, c, t, g, unknown, or other
  misc_feature (755)..(755): n is a, c, t, g, unknown, or other
aaagctggagctccccgcggtggcggccgctctagaactagtggatcccccgggctgcaggaattcgcacgagaccattacctagaacatcctaatcgaaaagagaccaaaggaggatacctcccgcctgcgcggctgcccccaccatgaacgacgatgagtttcggcgcaggctcgacctcttcccggtcgtccgctccggagactactgctgctccgatcttggaacatccagcaaaggaaccagacagcgatcccgagttncngcagccaactaggggcgatcataacgactcgtccggtggaacgagatatgtttatgcccaaattgaagatgggctgcggagaataagattggaggggctaaggggtggagtgtgancagcaacactttcgcaagaagttgatgaggtaggttattcccccacacccaaattttggatgctggntaagagtttcctgcaccgccccccaccccccnaancaanaacaataaggaaactccctgcttacggggccggacagctgccccaggcttccggaaaagtgtctcacactctgttggggatttttgttcggccgccctcttttttacaccccctcggatgctattttaccccagactgtatacccccgaattgcgcaacgggtcccccgatgcgagtttggtcgccctcaccctgccgggggcttggtagtttgggaccaaaaagctgggtgcccccccctcactgtccggtacaccacgcgagcgngacgcacctgtccccccccccccttgcactccttag

SEQ ID NO: 44191 - protein, 43 aa, Zea mays
  misc_feature: Ceres CLONE 1446045-F
  misc_feature (40)..(40): Xaa is any aa, unknown, or other
MNDDEFRRRLDLFPVVRSGDYCCSDLGTSSKGTRQRSRVXAAN

SEQ ID NO: 44192 - DNA, 752 bp, Zea mays
  misc_feature: Ceres CLONE 1446047-F
  misc_feature: Encodes the peptide sequence at SEQ ID NO. 44193
  misc_feature (426)..(426): n is a, c, t, g, unknown, or other
  misc_feature (526)..(526): n is a, c, t, g, unknown, or other
  misc_feature (535)..(535): n is a, c, t, g, unknown, or other
  misc_feature (637)..(637): n is a, c, t, g, unknown, or other
  misc_feature (695)..(695): n is a, c, t, g, unknown, or other
tggagctccccgcggtggcggccgctctagaactagtggatcccccgggctgcaggaattcgcacgagaccattacctagaacatcctaatcgaaaaacgcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaggtccaccacttcgtcgcccggctcaaccaggacgtcctccagtgcgccgtctacgactcccgacagccctcggcccngctcatcggcgtggagtacatcgtctccgacaccatcttcgaggggctggccccggacgagcagaggctgtggcactcgcacgcgtacgaggtgaagccngggctgtgnaccgacgtcggcgtgcccgaagcgctgcaaaagctcgagatggcgagcctcgcaggacgtacggcaagttctggtgcacctggcaagcggaaccgcgcgacncgctgcccctcggcgcgccgggctcatggtggtcccgcaggccgcccaccccggcgcntgcccggcaagctggtgcccgccctgaccaaaggacgggatccacagctcggcaggg

SEQ ID NO: 44193 - protein, 203 aa, Zea mays
  misc_feature: Ceres CLONE 1446047-F
  misc_feature (23)..(202): Pfam Name: DUF1264 Pfam Description: Protein of unknown function (DUF1264)
  misc_feature (95)..(95): Xaa is any aa, unknown, or other
  misc_feature (131)..(131): Xaa is any aa, unknown, or other
  misc_feature (185)..(185): Xaa is any aa, unknown, or other
MSSSDQNPAATPASSGPAEPSPPGRPTAVSSRVLDMGAQLAQALKPVRQMKQHACSFALYAHDLHRQVEVHHFVARLNQDVLQCAVYDSRQPSAXLIGVEYIVSDTIFEGLAPDEQRLWHSHAYEVKPGLXTDVGVPEALQKLEMASLAGRTASSGAPGKRNRATRCPSARRAHGGPAGRPPRRXPGKLVPALTKGRDPQLGR

SEQ ID NO: 44194 - DNA, 762 bp, Zea mays
  misc_feature: Ceres CLONE 1446049-F
  misc_feature: Encodes the peptide sequence at SEQ ID NO. 44195
  misc_feature (338)..(338): n is a, c, t, g, unknown, or other
ctggagctccccgcggtggcggccgctctataactagtggatcccccgggctgcaggaattcgcacgagaccattacctagaacatcctaatcgaaaacctccagctgcatcttcctcacgctgtcgctgcgcctgctgccgtccccgtgcggcctgctcctgctcttcctccacgccctcaccgccgtcttctccgcggccggctgctcgggctccttcacggcgcccgccacgcccgcgcagtggcacaacgcgcacaccgcgggagccgcgctcaccgccatcttccagggcgccatcgcgctgctcgcgttcacccgcacctccgacttcctcngcgagctccagtcctacgtccgcgacgaggacggcgccgtcatcctcaagatggtcggagggctcggcaccgccatcttcgtcctcgagtgggccgcgctcgcgcttgccttctccctcccgctcgacgaagatgacgacgacgacgacctcccagccaagaactggcaatcgtaccatgtctgatcccatccactgctggcctgggctccttcaaaatgagaatctttgatgtcaattctattaatggactattgctgtcattcctttgtactacggtgtactgttatgactgttccaccaaataaataaatcccaagcaaataaaaaaaaaaaaaaaaagcctatcgaaaccgttcaacctccaggggggggcccggtaccaaattccgccttatagggaattcgtaattacgccgcctccc

SEQ ID NO: 44195 - protein, 44 aa, Zea mays
  misc_feature: Ceres CLONE 1446049-F
MVGGLGTAIFVLEWAALALAFSLPLDEDDDDDDLPAKNWQSYHV

SEQ ID NO: 44196 - DNA, 767 bp, Zea mays
  misc_feature: Ceres CLONE 1446051-F
  misc_feature: Encodes the peptide sequence at SEQ ID NO. 44197
  misc_feature (359)..(359): n is a, c, t, g, unknown, or other
aagctggagctccccgcggtggcggccgctctagaactagtggatcccccgggctgcaggaattcgcacgagaccattacctagaacatcctaatcgaaaagagcagtccccgcgctccgtcacgggcaccaaggccggcggccgagcacctggacccgccctggcctccacggacgcggcgtcggacggcgacgcggcgttctcgctggtgaggcggcagctggagtcgctgagcgtggacaacatgctgctccggcgcgccgtggaggacctccgcgcggaggtccgcagcagcaacagcagggccgcgccgcccgctgcttctgctgcgggggcccgtggcttgggcagggtggcngcgaccgcgccacaaatgcaggcgcagacgcagacgcagccttaccacgtgacgaagccggaccaccgcgcccggggcgccgcgagggaggctgcggccacgccggacgacgtcagcgaggagctgaagaaggcgttggaagccccgcctgcgctgagcagtcagccttggctgccaggctgcgtcgcgtgcgagcccggcagctcaccggcaccgctcgagtggaagtgaaatgctagtgtcgctggtaggcgttgaaatctgttggtgtcagcagcaatttggagctgctgatttctcccctgtgcttgcttaggtcgtaagtgttgtgaatgatcccctggaaaaaaggggatcggacttgtctttgccaaaaaaaaaaaaaaaaagtttatcgataccggtcca

SEQ ID NO: 44197 - protein, 195 aa, Zea mays
  misc_feature: Ceres CLONE 1446051-F
AGAPRGGGRSRTSGSPGLQEFARDHYLEHPNRKEQSPRSVTGTKAGGRAPGPALASTDAASDGDAAFSLVRRQLESLSVDNMLLRRAVEDLRAEVRSSNSRAAPPAASAAGARGLGRVAATAPQMQAQTQTQPYHVTKPDHRARGAAREAAATPDDVSEELKKALEAPPALSSQPWLPGCVACEPGSSPAPLEWK

SEQ ID NO: 44198 - DNA, 718 bp, Zea mays
  misc_feature: Ceres CLONE 1446054-F
  misc_feature: Encodes the peptide sequence at SEQ ID NO. 44199
  misc_feature (466)..(466): n is a, c, t, g, unknown, or other
  misc_feature (597)..(597): n is a, c, t, g, unknown, or other
  misc_feature (641)..(641): n is a, c, t, g, unknown, or other
  misc_feature (642)..(642): n is a, c, t, g, unknown, or other
  misc_feature (664)..(664): n is a, c, t, g, unknown, or other
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaaacaagccgcaccgcaattagccgcgaccctccgcagaatcggctcacgtttccgatccagaggtccagactgttccccgagttttcccactgtgtcctctcctcgcgagtcccggcgaagcaggcgaaccgcgaacatgtgccccaccggcaggtacctggggctcgacctctccggcgctggcggcgacctgaggccggcgttcgacgtgcttgacgcggaccgggacggccggatcagccgggacgacctcaagtccttctacgccgccgcggggcccgccgccggcgaccggttcgacgacgacgacctcgcggccatgatcgcggccgccgacgccgaccgcgacggcttcgtgcagtacnacaagttcaagcgcctgctggccggccgcgccggggcggccgccccccgccccgagaggcgctgggccccccctccgccatgtaaggcgcccttctggctcatggaccgggaccgggaccggatggtcggnttcgaagacctcaaggcctacctccactggggccgggatgcccnncggcggacaaggaggtcccccncnttaatccccgccccctgccgaggggaccggcgtaaaagcgtggggcctccag

SEQ ID NO: 44199 - protein, 160 aa, Zea mays
  misc_feature: Ceres CLONE 1446054-F
  misc_feature (18)..(46): Pfam Name: efhand Pfam Description: EF hand
  misc_feature (77)..(77): Xaa is any aa, unknown, or other
  misc_feature (135)..(135): Xaa is any aa, unknown, or other
  misc_feature (143)..(143): Xaa is any aa, unknown, or other
MCPTGRYLGLDLSGAGGDLRPAFDVLDADRDGRISRDDLKSFYAAAGPAAGDRFDDDDLAAMIAAADADRDGFVQYXKFKRLLAGRAGAAAPRPERRWAPPPPCKAPFWLMDRDRDRMVGFEDLKAYLHWGRDAXRRTRRSPXLIPAPCRGDRRKSVGPP

SEQ ID NO: 44200 - DNA, 768 bp, Zea mays
  misc_feature: Ceres CLONE 1446056-F
  misc_feature (453)..(453): n is a, c, t, g, unknown, or other
  misc_feature (456)..(456): n is a, c, t, g, unknown, or other
aaagctggagctccccgcggtggcggccgctctagaactagtggatcccccgggctgcaggaattcgcacgagaccattacctagaacatcctaatcgaaaaagagatggattcgtcttctatataagtgagatcgaagacggagattagaacaaacagagcatatattccctcttcactagctcgtggtaataagggaagcttgatcatctttccttatggcggtgatgaagagcagcacaatcgtcgcgcttctattggctgttgccattctgtctgtcagctgtctccatgctacgaagccggcgggtgcatcgggaaacccaagaagtcaccgccgccgccgagaaggacatacttctcgtcctattgcgaggaccaccataaggaccaccagaattgccgcttgatctgtatgtccaagggtattcaaggacggtggctggtgtgacnaangcgtggagcacagagtgtgctgctgctcccattacagaataatagcgtatgttatgtagatgcatatatatatgcatcgtgcatctacctctgtggtgcgaaaatctgaataaaatctggcttttttgcaagaaaaaaaaaaaaatgactatcgatactgtcgacctcgagggggggcccggcactaatttcgccctatagagaggcgtattacccgcggccattgcccgtcgttttacaacgccgagactggggaaaaccctgactttcccaacctaaatcgccttggaacaaatcaccctttcgccccgt

SEQ ID NO: 44201 - DNA, 748 bp, Zea mays
  misc_feature: Ceres CLONE 1446058-F
  misc_feature: Encodes the peptide sequence at SEQ ID NO. 44202
  misc_feature (407)..(407): n is a, c, t, g, unknown, or other
  misc_feature (492)..(492): n is a, c, t, g, unknown, or other
  misc_feature (493)..(493): n is a, c, t, g, unknown, or other
  misc_feature (500)..(500): n is a, c, t, g, unknown, or other
ctggagctccccgcggtggcggccgctctagaactagtggatcccccgggctgcaggaattcgcacgagaccattacctagaacatcctaatcgaaaaaacggaaagttcctccttgtcaatagcaaatcggaggcccaagcgctcccaatctctccgggtcctctctccgcattctccgtcatggctgagccgacgccgtcgcagtcgccagcgcagacgccgcccccgccgccgacgcagcagactcccgcggcgggtgggctcgaggacatgctggcgtgtgtggcggcgctggaggccgcgctgctgccgtgcctccccgcgcgcgagctccaggccgtcgaccgctccctccagtcctcccaccagattgatgtttgagagcacgcaagggatttcatggangctgcccagaagctccagtcttatttcatcagcctgcagcgtgaggaaccgcatctgcagaagagatgcttcgaaaggaattacnnacatggnagaaaagttgagaagcagtctgaactcattgccaagcccaaaagtgattgaagggtggcaaaggactgaaggagcccctgaccagcccatccgggaccttgaagggggggaggaggcgattcgggggtttccctggaggggccagaaccccgaggggacaaggtttttttttgccctaaaaacggggacctgggcttaaaaccggcccccgggttgggaaaaaaaaaaaaaaagttttccttcccccc

SEQ ID NO: 44202 - protein, 66 aa, Zea mays
  misc_feature: Ceres CLONE 1446058-F
MAEPTPSQSPAQTPPPPPTQQTPAAGGLEDMLACVAALEAALLPCLPARELQAVDRSLQSSHQIDV

SEQ ID NO: 44203 - DNA, 784 bp, Zea mays
  misc_feature: Ceres CLONE 1446060-F
  misc_feature: Translation starting site: 223
  misc_feature (1)..(1): n is a, c, t, g, unknown, or other
  misc_feature (244)..(244): n is a, c, t, g, unknown, or other
  misc_feature (279)..(279): n is a, c, t, g, unknown, or other
  misc_feature (310)..(310): n is a, c, t, g, unknown, or other
  misc_feature (312)..(312): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (390)..(390): n is a, c, t, g, unknown, or other
  misc_feature (397)..(397): n is a, c, t, g, unknown, or other
  misc_feature (399)..(399): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (447)..(447): n is a, c, t, g, unknown, or other
  misc_feature (478)..(478): n is a, c, t, g, unknown, or other
  misc_feature (532)..(532): n is a, c, t, g, unknown, or other
  misc_feature (551)..(551): n is a, c, t, g, unknown, or other
  misc_feature (553)..(553): n is a, c, t, g, unknown, or other
  misc_feature (565)..(565): n is a, c, t, g, unknown, or other
  misc_feature (572)..(572): n is a, c, t, g, unknown, or other
  misc_feature (584)..(584): n is a, c, t, g, unknown, or other
  misc_feature (585)..(585): n is a, c, t, g, unknown, or other
  misc_feature (591)..(591): n is a, c, t, g, unknown, or other
  misc_feature (613)..(613): n is a, c, t, g, unknown, or other
  misc_feature (635)..(635): n is a, c, t, g, unknown, or other
  misc_feature (637)..(637): n is a, c, t, g, unknown, or other
  misc_feature (684)..(684): n is a, c, t, g, unknown, or other
  misc_feature (714)..(714): n is a, c, t, g, unknown, or other
  misc_feature (729)..(729): n is a, c, t, g, unknown, or other
  misc_feature (736)..(736): n is a, c, t, g, unknown, or other
  misc_feature (737)..(737): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (771)..(771): n is a, c, t, g, unknown, or other
  misc_feature (772)..(772): n is a, c, t, g, unknown, or other
natagctggagctccccgcggtggcggccgctctagaactagtggatcccccgggctgcaggaattcgcacgagaccattacctagaacatcctaatcgaaaaaaaaagaggagtgacccggtctaccggagcgtacggtgccgatcccgtcgccgccgctacccctcaatcgcgagcaacttcttccggattcgcaccaagctctccacaattctatcgctatgctgcggaaggccgtcgtcnccttcatcgcctgcaccgccttcttcctcgacttntctgcctactcccgtcgcgagggggttgcanangttcaattttctttttttactcacagggtctaccctagatgnnnatttttttttccccccccccccggggaaagaaanaggggcncnatttnnnannncntcccccatttttttcaaaacaataaaaacatcttncccccggggggggggggcgcgggccccaggncaaccctctctcctcaaagcggaccccccccaccccggcgtatccccccgcctnccccaccaccccccggggncnccgttcctctgnaccattntcccgccaccgnnctcgancgccactaccccccccccaccnactggtaccccaaccctgatcncntccccacacccctcctggatctcctcactgcgcctcacccctccttnacccccactagccttttttgccacgttcantcacggccctccccnccccggnncgctctcnnnnnnntactcacctcccccccgggnnccgcccgccccc

SEQ ID NO: 44204 - DNA, 847 bp, Zea mays
  misc_feature: Ceres CLONE 1446063-F
  misc_feature: Encodes the peptide sequence at SEQ ID NO. 44205
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (432)..(432): n is a, c, t, g, unknown, or other
aagctggagctccccgcggtggcggccgctctataactagtggatcccccgggctgcaggaattcgcacgagaccattacctagaacatcctaatcgaaaaaaacacgccagaaactaatccagatagctagcctttgatttctcacttcaatctgacgaagtgcacacctaggcaacaaactcgaacgcgcgcggtagtggagccgagatgcatgtaggggcgacggccaaacatcaggggcgagacggtgaccgcggcgcgcccaagacaccaaccacggaggggaagggcgacgccgccggggcccaggctaacgccaacatggcgaaggggggacgccaccgtcaacaaggcttgttgggaaaaaaaaaannnaaggaaagggcgactaagcccccagggggggggaccgcccccctcccaccaccanacttgttggccgggggaggccaagggcacccccaaaacattccttccgcgcgtgcagctggccgggaaacccacaatgccgacccggggcggcggggataaccttcggagggaccacctttcccgaaaacccccggcgggaggagggcgtgggagttccggcacaacttactctcttggggccctagaaagacctggcgggcgctctttctctaactaccgatcttttacttggaggaacgcattccttcaccttgcccacagggaaggaccgaactctatgcggggagccctgtggggggtctccatatatttctaccgcccccgagaggaaccgaggtccctttaagtcgggcgcaccccctctttatacggcttcccagagagaagcgcccccttcctggggcccgcaaaaa

SEQ ID NO: 44205 - protein, 107 aa, Zea mays
  misc_feature: Ceres CLONE 1446063-F
  misc_feature (56)..(56): Xaa is any aa, unknown, or other
  misc_feature (75)..(75): Xaa is any aa, unknown, or other
MHVGATAKHQGRDGDRGAPKTPTTEGKGDAAGAQANANMAKGGRHRQQGLLGKKKXKERATKPPGGGTAPLPPPXLLAGGGQGHPQNIPSARAAGRETHNADPGRRG

SEQ ID NO: 44206 - DNA, 798 bp, Zea mays
  misc_feature: Ceres CLONE 1446066-F
  misc_feature: Encodes the peptide sequence at SEQ ID NO. 44207
  misc_feature (290)..(290): n is a, c, t, g, unknown, or other
  misc_feature (297)..(297): n is a, c, t, g, unknown, or other
  misc_feature (649)..(649): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaagagttttgtgggatcgcgaggaagaactagaaggatgtcgtgctgcggaggcaactgcgggtgcgggcgccggctgcaagtgcggcagcggctgcggagggtgcagatgtacccggacatggctgagcaggtgaccaccacccagactctcatcatgggtgttgcaccatccagggcgggttcgaggcngccgccngagctgagaacggcggttgcaatggggggccaactgccactgcgacccctgcacctggaattaaaccaccggccgcaatgaccctggagggtctgcacctgcagggcctgatgggccccctcgaagggaccctttacccctggcctaataaaaaaccggtcccggttttaaaatttcccacccggcccttttgttgttttttttcaaaaaaaaaaaaaatacaccccgcggccggggcccagggaaaaaaagccttggttttttttcccccttttttttaaaaaggttttttttttgggggggcccggggggggaaaaaaatattcccccatgtttggcccccccccttggngannnacctcttccccctttcccccgcggggacacaaaaaaaaaaaaagttttttttttttttttttggcaaaaggggaaaaaaaaaaaaggcccccccccctctctttcccaaaaaaaaaaaaaaattctttctccccccccccccgc

SEQ ID NO: 44207 - protein, 80 aa, Zea mays
  misc_feature: Ceres CLONE 1446066-F
  misc_feature (1)..(65): Pfam Name: Metallothio_2 Pfam Description: Metallothionein
  misc_feature (52)..(52): Xaa is any aa, unknown, or other
MSCCGGNCGCGRRLQVRQRLRRVQMYPDMAEQVTTTQTLIMGVAPSRAGSRXPPELRTAVAMGGQLPLRPLHLELNHRPQ

SEQ ID NO: 44208 - DNA, 747 bp, Zea mays
  misc_feature: Ceres CLONE 1446069-F
  misc_feature: Encodes the peptide sequence at SEQ ID NO. 44209
  misc_feature (309)..(309): n is a, c, t, g, unknown, or other
  misc_feature (359)..(359): n is a, c, t, g, unknown, or other
  misc_feature (363)..(363): n is a, c, t, g, unknown, or other
  misc_feature (365)..(365): n is a, c, t, g, unknown, or other
  misc_feature (367)..(367): n is a, c, t, g, unknown, or other
  misc_feature (375)..(375): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (406)..(406): n is a, c, t, g, unknown, or other
aagctggagctccccgcggtggcggccgctctagaactagtggatcccccgggctgcaggaattcgcacgagaccattacctagaacatcctaatcgaaaaactacgcgcgaggcacggcacggcacggcacgaccgagctccagtctgcccccgcccccgcccccatccgcacgtccgccttgatccggcaaatggcgtcgccggcgcggcggctcctgcagaccaactccgtgcagtacccgacgctccccgcggccgacccgccgagcgcgctggccgtcgactccgacgtggtggtcatcctcgncgcgctcctctgcgcgctcatctgcgtcgtggggctggcctccgtggccngtgngngngctcccgngcggggccnnncgcgcgcaggaggggctcangagaaggccctcagccctgccaacctccctacaaggaccctggcgccccgcccgggccgggaaggcccggggaaggcccccaaaccctggaaatgccccttcccctgcaaattccccccggaaaaagcccggtgttccaaaggggcccccctttccgggcccgggaaaaaaggggttgcccccctctcttgttccttgggggcgggttttttttggagaaaaaaacaaaaacccccccccccccaaaaactccccgaggggacgccgggagagaaccctctttttttttttccccgcgcccccctgtgtttttttcttttttagagggacgcccccccccc

SEQ ID NO: 44209 - protein, 178 aa, Zea mays
  misc_feature: Ceres CLONE 1446069-F
  misc_feature (39)..(39): Xaa is any aa, unknown, or other
  misc_feature (56)..(56): Xaa is any aa, unknown, or other
  misc_feature (57)..(57): Xaa is any aa, unknown, or other
  misc_feature (58)..(58): Xaa is any aa, unknown, or other
  misc_feature (61)..(61): Xaa is any aa, unknown, or other
  misc_feature (64)..(64): Xaa is any aa, unknown, or other
  misc_feature (65)..(65): Xaa is any aa, unknown, or other
  misc_feature (71)..(71): Xaa is any aa, unknown, or other
MASPARRLLQTNSVQYPTLPAADPPSALAVDSDVVVILXALLCALICVVGLASVAXXXAPXRGXXRAGGAXEKALSPANLPTRTLAPRPGREGPGKAPKPWKCPFPCKFPPEKARCSKGAPLSGPGKKGVAPLSCSLGAGFFWRKKQKPPPPQKLPEGTPGENPLFFFPRAPLCFFLF

SEQ ID NO: 44210 - DNA, 764 bp, Zea mays
  misc_feature: Ceres CLONE 1446070-F
  misc_feature (550)..(550): n is a, c, t, g, unknown, or other
  misc_feature (603)..(603): n is a, c, t, g, unknown, or other
ctggagctccccgcggtggcggccgctctagaactagtggatcccccgggctgcaggaattcgcacgagaccattacctagaacatcctaatcgaaaaacacacagacacacagttacaccgaggaggtttcctccctggctccctgtgaatctgcgatactgactctgccttcttcgttcagccagcgccgaaagagagggagagccaagtcgccttccgccgcgacgcacgatggatcgcgcgcagttgctcctcgtcggactcccggccttgctcttcttctccgacctcactcacatattcgcgccgccgcctccccacctccgccacccccatcaccaccctcctcaccaccaccatccgcatccgctgcatcatccccactcgcctcatccccacccgcacccgccgcatcatccccacccgcacccgccgcaccaccaccagcaccccgacccctccacggcaatcatacaggagccacgtgtggatgaggctggattcggcagcacagtggagctgcaattctgtgcctcctgctcgtacangggaactgcagtgaccatgaagcgcatgctggaaacctcatttcctggcattncatgtatctttgcatattatcctccctcattcccccagcgtgtactcagcaaagttatcccaatttgtcaggttggagcgttgcaacaataatggctggtgacagattttccccagaatggcatggttgctccctcatgggactactcgcttcgtgcaaaa

SEQ ID NO: 44211 - DNA, 819 bp, Zea mays
  misc_feature: Ceres CLONE 1446073-F
  misc_feature: Encodes the peptide sequence at SEQ ID NO. 44212
  misc_feature (276)..(276): n is a, c, t, g, unknown, or other
  misc_feature (350)..(350): n is a, c, t, g, unknown, or other
aagctggagctccccgcggtggcggccgctctagaactagtggatcccccgggctgcaggaattcgcacgagaccattacctagaacatcctaatcgaaaaacttctctagtctagcccctctgtcgctctcagacgacgggtgcgccgccgcggccgccctaagccaggtgctgactgctgaggctttctttggtctcttcgccggcgacgacacccgccagtatccacggtgtcattgcaagacaagatggtttccttcgagatgaatgacctncagaagattgggcttggcctgacaggctttggaatattcttctcatttctgggaattggtttttctcttgacanggggctcatcgcaatgggcaatattcttttcctgtcaggttggggttggaccattggtctgaaatcaacatatgcagtccttccccaacccaagaatttccagggacctacccccttgggggccgggtttttttcggggccccatggggggggccttttttgggcattcctttaaagggcaaagggcgtttttgccccctccacgggggtttggcgcccaactttttgggtttttggaaaagtatccctcaccccgcggggtttttccacaaacttttgggacccctcctccccgccccccaaaaaaaaaaagggtgccgcgaaaaccacttttttaaaaaaattgggggggggggaaaccacaacccctttttttttttttttaaaaaaaaaaaaaaaaaaaagggggcgcccccccccttttttttttttttttaagagggctcgcaaaaaaaaataaccacccccc

SEQ ID NO: 44212 - protein, 91 aa, Zea mays
  misc_feature: Ceres CLONE 1446073-F
  misc_feature (30)..(91): Pfam Name: Got1 Pfam Description: Got1-like family
  misc_feature (34)..(34): Xaa is any aa, unknown, or other
MVSFEMNDLQKIGLGLTGFGIFFSFLGIGFSLDXGLIAMGNILFLSGWGWTIGLKSTYAVLPQPKNFQGPTPLGAGFFSGPHGGGLFWAFL

SEQ ID NO: 44213 - DNA, 736 bp, Zea mays
  misc_feature: Ceres CLONE 1446081-F
  misc_feature: Encodes the peptide sequence at SEQ ID NO. 44214
  misc_feature (504)..(504): n is a, c, t, g, unknown, or other
  misc_feature (577)..(577): n is a, c, t, g, unknown, or other
  misc_feature (736)..(736): n is a, c, t, g, unknown, or other
ctggagctccccgcggtggcggccgctctagaactagtggatcccccgggctgcaggaattcgcacgagaccattacctagaacatcctaatcgaaaacacaatggccaaatcagcaggaagtacaaaatgtctcacaaccacaagatgaaacaaactatcagacatcccaatcagaccggactgttttacaacaaggcgctattaatactgatgagttgtcctcaaagccaagccaggatagtcagccagaccatcttaatgcccatgtgaaacaacagcagagccctgcaagtgcacctactgaatcaactcatgaacttactgttgttgaagcgaatgtagctgaacatgtatcttgtgacgaacaacaaaaaatcttaaacgaacaggattcactgtcaaatatgaacaaccatattggaatagttgagcatctagagcaaaataccgaatccaaggatgaaagagctgcatctgataagcaacctgaacctgtatctangcagcataaacatttgaactttcctcccgtcactacccagattcacttgaaaaagagtgcaacagagaatccntaatgttgtaatcaggttgatataatgaaaatcagtgcaggtggttttagttcgcagttacctcgtgcacaaaggaaactttctctctagagagagatctctattggcttgcattgtacgtgcagttcctgctgggactgagggtgggatccagataan

SEQ ID NO: 44214 - protein, 57 aa, Zea mays
  misc_feature: Ceres CLONE 1446081-F
  misc_feature (33)..(33): Xaa is any aa, unknown, or other
MNNHIGIVEHLEQNTESKDERAASDKQPEPVSXQHKHLNFPPVTTQIHLKKSATENP

SEQ ID NO: 44215 - DNA, 734 bp, Zea mays
  misc_feature: Ceres CLONE 1446083-F
  misc_feature: Encodes the peptide sequence at SEQ ID NO. 44216
  misc_feature (288)..(288): n is a, c, t, g, unknown, or other
  misc_feature (345)..(345): n is a, c, t, g, unknown, or other
  misc_feature (360)..(360): n is a, c, t, g, unknown, or other
  misc_feature (361)..(361): n is a, c, t, g, unknown, or other
  misc_feature (381)..(381): n is a, c, t, g, unknown, or other
  misc_feature (453)..(453): n is a, c, t, g, unknown, or other
aagctggagctccccgcggtggcggccgctctagaactagtggatcccccgggctgcaggaattcgcacgagaccattacctagaacatcctaatcgaaaaaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctggcgtcntacggcgggtcgccgccgccgcggagcccgcgggagctggcgcgcgccccgctgtcngtgagcgcggaacgnngccccccccccccttcgccnaaggttgggcccgctctgtgggggcccccccaaccgcaaaggcccccaaaaaaggggtcgggaatcgggttncggggtcggggttcggaaggtgccccgggaaaatgccctgaaaattgggcgaaaaggggggcacctccccaccgcccagaaaagccgcccggatggcccccggaaccccgctttacgggaccctcaaactggaaaatggggaacgccccgctcccaaaagaacactgcctccaagggctttcttccccgccctttaaacccggaacggggcccccttcgggggaaagggtctcaaaggtcccaaagttaccaaaaacgggctccggctttaaataaaggcg

SEQ ID NO: 44216 - protein, 204 aa, Zea mays
  misc_feature: Ceres CLONE 1446083-F
  misc_feature (83)..(83): Xaa is any aa, unknown, or other
  misc_feature (113)..(113): Xaa is any aa, unknown, or other
MAHPRSVAAAAPLLLLLAAAAAAAAGLVSAASPAASDFVRKSCRTTQYPSVCEQSLASYGGSPPPRSPRELARAPLSVSAERXPPPPSPKVGPALWGPPQPQRPPKKGSGIGXRGRGSEGAPGKCPENWAKRGAPPHRPEKPPGWPPEPRFTGPSNWKMGNAPLPKEHCLQGLSSPPFKPGTGPPSGERVSKVPKLPKTGSGFK

SEQ ID NO: 44217 - DNA, 738 bp, Zea mays
  misc_feature: Ceres CLONE 1446085-F
  misc_feature: Encodes the peptide sequence at SEQ ID NO. 44218
  misc_feature (663)..(663): n is a, c, t, g, unknown, or other
  misc_feature (666)..(666): n is a, c, t, g, unknown, or other
  misc_feature (669)..(669): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaaatgggatcccatgaccactacacctccgcctcgcaattcgtcttcgccgccgtcgattccaaccccaaccccaggcccagccacagccacaagcccaagaccaccgtgcaaatccccatcacgtctctaccagaacgggctcgggcgggaccgcccgacgcggcggcggcggccgctaagatccaggcggccttgcggggctacctggtcaggcggcacgccgcggccgtgcgcggggccgacgccgaggcgacgcggctcgagcggctgctccggcggcaggagaccgtggacgccgtccgcggcgacaagcgcgagcgggcccggttctccgaggcgctcatggccgtgctgctccgcctggacgccgtgccggggcgctacccggccgtgcgagacgcgcggcgcgccgtgagccgccgcgtcgtcggcctgcaggaggtgttcgacgctgttgtcgcggcacctgcagcgcagacttgcggggttccggctagcctggagcaggtcctcgaagggatctggggcgtcggagaagcgcctgttcccgtgcctccgtcnccngcnaatggcgcngcggaagaagaagttgagaggggcgggtcatactgggcaagtttttttggtggagggagg

SEQ ID NO: 44218 - protein, 212 aa, Zea mays
  misc_feature: Ceres CLONE 1446085-F
  misc_feature (76)..(153): Pfam Name: BAG Pfam Description: BAG domain
MGSHDHYTSASQFVFAAVDSNPNPRPSHSHKPKTTVQIPITSLPERARAGPPDAAAAAAKIQAALRGYLVRRHAAAVRGADAEATRLERLLRRQETVDAVRGDKRERARFSEALMAVLLRLDAVPGRYPAVRDARRAVSRRVVGLQEVFDAVVAAPAAQTCGVPASLEQVLEGIWGVGEAPVPVPPSPANGAAEEEVERGGSYWASFFGGGR

SEQ ID NO: 44219 - DNA, 910 bp, Zea mays
  misc_feature: Ceres CLONE 1446087-R
ttgggtaccgggccccccctcgaggtcgacggtatcgataagcttttttttttttttttttgaagattaacacccagcatttttcatatcagatgcctcatgaacgcgaacttttggaactaaacggaacggtctgggtaaatttaatccactagccggtaatcattatccctcccactaacaccacagcagaaatcaaactaccatgatgctacaccctacctgtttcagtttgataccccacgatattaccccacgaaaacctggtcttttgagaaccagaaatgagagctctcaaaaatcaagtaataacctgaacgacatcatcagtccccttcatgcggagactgctgctcttcaggaacttcctccagctgttcctgaagaatcctggccctgatacatcccccggtgggacttttttggggcgccatgaaccaattcccggtacctggggacctggctgcttttggcgtgtaaaaggtaagggatattccctttagccgggggggtttccctgtggtgggggaaaccccggggccttaagaaaaaaccaaaatttcccgggccctcccctgtgatccttaaaccccccttggggaaacaaaatgttccaaccccaaaaaagagccctttaaaaaattcccgttcccccccctttaataggggttgtcccgcaaaatatttaaaatttcttttttcccacaaagtgtgcccggaaatctttttgttctttccccccgggggtgtgtgcgtttccacaccaaaacctcctgggggggtcaaggagtccccagtttatggaaaaatacccccccgcaaaagactttttttgttcgaaaaaaagccacaagaggggagactttcctccgcgtggtgaaattattatggggggggacaaattcttttg

SEQ ID NO: 44220 - DNA, 760 bp, Zea mays
  misc_feature: Ceres CLONE 1446089-F
  misc_feature (623)..(623): n is a, c, t, g, unknown, or other
  misc_feature (629)..(629): n is a, c, t, g, unknown, or other
  misc_feature (644)..(644): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaataggaaggagaccagcaacagccgtgctctcttcttgctcaacctccccagcgcgctcacctcgtggacgcccaaattgttggtttcctggtgccggagtcctcttcgctagactgcagcgagcgccgtcatccaagctcatcgcgttggcacgtccttgctgtccccgcgccagcgtcccctcctgcttgttcggttgtcgagctcctccatcgatctctacctcgtcgtacaggccgtcagacgccgcgccttcatctctgatctcgcccgccctcgatgtcgcgctcggagccatctcgctcgcccagccgggtgtgcagcagcagtctcgtgctgctgccgtcgggtctcccagtgtgcgcagccccaccaccacgttggctcatcgttgatcgccctcgccgttgtgagtcgccgagccatgctcgcttgcgagcactgcacgccggagcaagctacgtcttcagcctcgcctcgcctcgccgtgcgtcatcgtgaagatcgcgatttgtttccnagcttncgagaatcgacgatncagcgttggcgaacaagtgatctggctctccgagtttacgaggntgaagaccctgagcatctgtttagtgaaggttgtccacattgcaccactgctcaggagaagagaaaccgtga

SEQ ID NO: 44221 - DNA, 744 bp, Zea mays
  misc_feature: Ceres CLONE 1446091-F
  misc_feature: Translation starting site: 198
  misc_feature (401)..(401): n is a, c, t, g, unknown, or other
ctggagctccccgcggtggcggccgctctagaactagtggatcccccgggctgcaggaattcgcacgagaccattacctagaacatcctaatcgaaaaattcctttctctccctctcgccgtcgtcgccacctccacttggccccgctcatcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgtttggagcggatggcgcaagatgcatgtctgcgagggcgccggcggtcaaagggtccgggcatctcgtccgcaagggcaccggaggnaggtcttctgtgagtgaattggtagccacgggtgtttggagctactgggtttcttgggcgctatcttgggcacaacttggcaagatggggtctcaagtgcttgtcccattcagaggtgtgaggattctcctcgccacctgaagattatgggtgacttggttcagattgtgcccatgaaatacaatccgagagatgttgattcatttaaggctgttatggcaagtcaaatgtggttattacctcttgggacgaaggttgaaacaagggactacaggcttcaagaagtaaacccccttttgcctggacagcttgcaacaattgctagggacttggggggttcata

SEQ ID NO: 44222 - DNA, 755 bp, Zea mays
  misc_feature: Ceres CLONE 1446092-F
  misc_feature: Encodes the peptide sequence at SEQ ID NO. 44223
  misc_feature (241)..(241): n is a, c, t, g, unknown, or other
  misc_feature (242)..(242): n is a, c, t, g, unknown, or other
  misc_feature (315)..(315): n is a, c, t, g, unknown, or other
  misc_feature (456)..(456): n is a, c, t, g, unknown, or other
ctggagctccccgcggtggcggccgctctagaactagtggatcccccgggctgcaggaattcgcacgagaccattacctagaacatcctaatcgaaaaccactcgctggacgctcctagctaggtcacccacttccccacccagcgccgccgcggaaagggaattgggcgatggcgatgtggatgtcggcggccacccgcgcgatgcgcgtccacgcgcgccgcacccccgcctcttcctnnctcgcgactccgcccggccgggacccaaccgggcgctgctgcagggccaagcgcccgcgccccgctggtactncggagcccgcgcgggcgccgatcccgcgtcgatcccattccagcgcaccttggcgtggccacagtgccggaccctacatgtgttcgtcgtcgagcgattcggcactaccacaagatcctgccctctggggtcacctcctcntgcccgtcgtcgaccgcatcgcgtacgtccactcgctcaaggtgaagcccatcgcatccccaactatctgcggtcacaaagataacgccttgatccagtttggaggattggctcctctacagatatcagatccggtccttgcctcctacgctgtggacggaaccccattcaccctgtcccccagctttgcaaaactggtcagatgaggggaatccggcagatgaccctggagagaagtttgaccagcgaagacagcctcgccgccacctttttgaggtcatgaatgaccccgcgggcgg

SEQ ID NO: 44223 - protein, 89 aa, Zea mays
  misc_feature: Ceres CLONE 1446092-F
  misc_feature (22)..(22): Xaa is any aa, unknown, or other
MCSSSSDSALPQDPALWGHLLXPVVDRIAYVHSLKVKPIASPTICGHKDNALIQFGGLAPLQISDPVLASYAVDGTPFTLSPSFAKLVR

SEQ ID NO: 44224 - DNA, 746 bp, Zea mays
  misc_feature: Ceres CLONE 1446093-F
  misc_feature: Translation starting site: 234
  misc_feature (365)..(365): n is a, c, t, g, unknown, or other
  misc_feature (457)..(457): n is a, c, t, g, unknown, or other
  misc_feature (460)..(460): n is a, c, t, g, unknown, or other
  misc_feature (746)..(746): n is a, c, t, g, unknown, or other
aagctggagctccccgcggtggcggccgctctagaactagtggatcccccgggctgcaggaattcgcacgagaccattacctagaacatcctaatcgaaaactcgccccccttcccctccgttgttatcttgtcaagttgcggttgtctccctcctccggcgcttccttccgcccctcccttcccgcctcctccgcgcagatcgccaggcgaggaaccagaccgcagggcaggatgcagtacaagaacctggggcggtcgggcctccgcgtcagccagctctcgtacggcgcgtgtgtcaccttcggggaaccagctggacgtgaaggaggccaggtgctactgcaggcgtgccgggacgctggngtaaacttcttccacacgccgaggtgtacgccacgggcgcgccaaccacacatgggcaggccatccgggacctgggctggcgcgctcccacntcntcatctcaccaagctcttctggggcggcagggccccaacgacaagggctctcccggaagccgtcgtcaagggctccgcgggtcgctccgcgcctcgcctggactacgtcgacgtctctactgccaccgccccgacgggtccactcccgtgaaggagacgggccccccatgaactgggtcaccaacaagggctgggccttttactggggcaccctccagtgggtcccgcaacaaaataccaaggcctggggccgtcacaaccgaatcgaactttgtcggacccattn

SEQ ID NO: 44225 - DNA, 770 bp, Zea mays
  misc_feature: Ceres CLONE 1446095-F
  misc_feature: Encodes the peptide sequence at SEQ ID NO. 44226
  misc_feature (349)..(349): n is a, c, t, g, unknown, or other
  misc_feature (431)..(431): n is a, c, t, g, unknown, or other
  misc_feature (494)..(494): n is a, c, t, g, unknown, or other
  misc_feature (498)..(498): n is a, c, t, g, unknown, or other
tggagctccaccgcggtggcggccgctctagaactagtggatcccccgggctgcaggaattcgcacgagaccattacctagaacatcctaatcgaaaaaaaccctagtccacagcggcgaggcgaccttgtgacctccgttcctctgtgctccgactgagttgctgatttgggataatcatgttctctctgagtgaatgaacatgtctgggaatgatgataagccacatgctgctgcagacagaataaaggcagccacgttatcagtgactaagggattgagcagggctcaagctgaatgggctgcgactgctgctgcccgcaatgtgaatgcctatgggcagaaagangagggaccaagccgctggcagggagagaaagaagccagagtcagatgtatctgatgagtacagagaaggttgcgaagctggncactatgaagccaaaagcttcagaaacttcttctgttggcacatatacccaatgccagaagtngttncagcatggtcactggacatatgagtgcaaaaagagcgggtgtacatatcacggcccctcaagaacgtagcagcttaagaaccccaagctgaggaaatgcgtacctgttttctattcgatttgaaaatcctggatgggatcggggaatcgtgagcctcccatattatgtggtggggaaacctgaagactttttataatgcctatatattgagatattgggcaattattatgaccgggatgaaatggtgtctaattatgactattggatgaaat

SEQ ID NO: 44226 - protein, 66 aa, Zea mays
  misc_feature: Ceres CLONE 1446095-F
  misc_feature (49)..(49): Xaa is any aa, unknown, or other
MSGNDDKPHAAADRIKAATLSVTKGLSRAQAEWAATAAARNVNAYGQKXEGPSRWQGEKEARVRCI

SEQ ID NO: 44227 - DNA, 763 bp, Zea mays
  misc_feature: Ceres CLONE 1446101-F
  misc_feature: Encodes the peptide sequence at SEQ ID NO. 44228
  misc_feature (327)..(327): n is a, c, t, g, unknown, or other
ctggagctccccgcggtggcggccgctctagaactagtggatcccccgggctgcaggaattcgcacgagaccattacctagaacatcctaatcgaaaaaaaattcccaaccgccgcacagcaacaccagcggtcggatcgggggagaaacggaagggcaacagcagagcgcgaattcctcagacaaatccaaggtttcgagcacagacacaggcgaaactcgatggcggaggggtccaagccggacgtgccgctgttccagctcctcagcgatcttctccagcaggtggagtcaatgagcaatcaggaagaagtagagctgcgcgcntagattgaagcattaggattagaagtcactaaggtaccagagcagcccgctaatcatctcagcgagctagaaatagctgcagagctggacaagctgtcatcgcggcttgataacgtcgacaagatgatatcatctgccatggcctcaaaatcagaagtggaagtcctctctgaccagcacatctgatttctggatgcccggcataacaccgtctgccaatgaaaggcgggggttttgtttggacaaccacccaaggccccccagaaaaaccgggaaatttccacgcaatcccgggaaatggggcgggaaaaaatttccttttggggggctggacccccctttttttttgttcttcaacctagtgttccctcgccaaaattttgggggaataaaaaaaaaaaccccggtcctttttctggatataaaaaaaaaaaaa

SEQ ID NO: 44228 - protein, 35 aa, Zea mays
  misc_feature: Ceres CLONE 1446101-F
MAEGSKPDVPLFQLLSDLLQQVESMSNQEEVELRA

SEQ ID NO: 44229 - DNA, 739 bp, Zea mays
  misc_feature: Ceres CLONE 1446102-F
  misc_feature: Encodes the peptide sequence at SEQ ID NO. 44230
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (662)..(662): n is a, c, t, g, unknown, or other
  misc_feature (677)..(677): n is a, c, t, g, unknown, or other
  misc_feature (739)..(739): n is a, c, t, g, unknown, or other
ggcggccgctctataactagtggatcccccgggctgcaggaattcgcacgagaccattacctagaacatcctaatcgaaaaagaagaggaaaaggaatccatggcggcgacgctggcgaggagggcggggcgctccgcggcaacgacgctatggggcgcggcgaggggcttcgcatcggtggggtccgacatcgtctctgcggctcccggcgtgtcgctgcagaaggcgcggtcctgggacgagggcgtcgccaccaagttctccaccacgcctctcaaggacatcttctacgggaagaaggtggtcatcttcggcttgcccggtgcatatacaggggtttgttcacaagcgcacnnncctagttacaagaagaatattgacaagttgaaagcaaaacgaatcgactctgttatctgtctagctgtgaatgatccgtatgtcctggatggatgggcaaaaaagctagacgctaaagatacaattgagttctatggtgactttgatgggagtttccacaaaagcttggatttggagatagacctttctgctgctttgcttggccgccgttctcacaggtggtccgcctttgttgacgatggtaagatcaagtctttcaatgttgaggaagcaacgttccgactttaagggttctggtggcgangggatcttggaccanatctgagctcccccatggacttccgcccatcctcacgttgtgcgggatactttctcttgcgn

SEQ ID NO: 44230 - protein, 181 aa, Zea mays
  misc_feature: Ceres CLONE 1446102-F
  misc_feature (26)..(181): Pfam Name: Redoxin Pfam Description: Redoxin
  misc_feature: SWISSPROT Homolog: EC 1.11.1.15 Peroxiredoxin
  misc_feature (86)..(86): Xaa is any aa, unknown, or other
MAATLARRAGRSAATTLWGAARGFASVGSDIVSAAPGVSLQKARSWDEGVATKFSTTPLKDIFYGKKVVIFGLPGAYTGVCSQAHXPSYKKNIDKLKAKRIDSVICLAVNDPYVLDGWAKKLDAKDTIEFYGDFDGSFHKSLDLEIDLSAALLGRRSHRWSAFVDDGKIKSFNVEEATFRL

SEQ ID NO: 44231 - DNA, 758 bp, Zea mays
  misc_feature: Ceres CLONE 1446105-F
  misc_feature: Translation starting site: 208
  misc_feature (608)..(608): n is a, c, t, g, unknown, or other
  misc_feature (751)..(751): n is a, c, t, g, unknown, or other
ctggagctccccgcggtggcggccgctctagaactagtggatcccccgggctgcaggaattcgcacgagaccattacctagaacatcctaatcgaaaaacaatctcacagccctcgaaggcaccacccgcgccgccgccaccgctccgaaattacagccatcgtagtgcggcggctaggtcggccggcgtttggaggagctccgaagatgtggtgccagtcgtgcaaggaagggtacgacgaggaggacgccgggacctgcaaggagtgctacgaggaggccagcgagacggaggaggagctcaagcgggagatcgacgacctccgctcccgcctcctcttcctccgcctcccctcccctaccctcgacgccgcatccgcccccaactgcgacctcctcctccacgccatcccctccaccggcgcgggaggcgaacgcgatgctgggcgcacccccgacacacccgccgtgcccgcccatcgcgtcatccttaagctcttctagacgaacagatggcatctgacctcttggtgttggctgagaagtacgaagtaaagcaccctgaggcatactgtgagaagttcatagcatccaaagtgaatgacgancatgctattacccactacgccttcgcgcaccgtcacagcgcaaagcagctgctgggagcctcgctttctgtgctcatggccacatgtctacgctatcggatcgtgaagatacaaggagcttgtggagaagacccaaggcttgntgtgaaa

SEQ ID NO: 44232 - DNA, 766 bp, Zea mays
  misc_feature: Ceres CLONE 1446112-F
  misc_feature: Encodes the peptide sequence at SEQ ID NO. 44233
  misc_feature (289)..(289): n is a, c, t, g, unknown, or other
  misc_feature (330)..(330): n is a, c, t, g, unknown, or other
  misc_feature (334)..(334): n is a, c, t, g, unknown, or other
  misc_feature (340)..(340): n is a, c, t, g, unknown, or other
  misc_feature (341)..(341): n is a, c, t, g, unknown, or other
  misc_feature (353)..(353): n is a, c, t, g, unknown, or other
  misc_feature (354)..(354): n is a, c, t, g, unknown, or other
  misc_feature (424)..(424): n is a, c, t, g, unknown, or other
  misc_feature (496)..(496): n is a, c, t, g, unknown, or other
agagctggagctccccgcggtggcggccgctctagaactagtggatcccccgggctgcaggaattcgcacgagaccattacctagaacatcctaatcgaaaaatcgctgccctcccctttcgtcatccatgacttccctccccgccgcggtcatggccaccgcgacgacgctgcccctaggcctcctcccctccaaaacgctgaccctctcccctctcccttctgcgcgccgatccctctccatcgccgccgtggagccccggcgctggctcctccgagccgccgctgnaagagcgcctgaggccgtggaggttgagttcgtgaaccccnagcngaagcnngagaagaacccnncgtacgggagcccgtagaggcgccactcgcggccgcggggggctgggaaggaccccaacatcctccctgntgccatgaatggttccaagacatacattgggatggcgggcgggtttttttcccccagaactgaaggggcccntggcatgttccaactttttaaacaggggctccggggtcactaagaaaaaccttactttggtggcccggggacccaaccctcctttccccctggtttaaaaaacgggcctttaaaaaaatttttcctcccccccacaaaaaaaaaaaactcccagaaaactttgtccccacccccaaaccggggtaaaaccccccgttttggggtaaaaaaaaccccctgacccaaaattgcccgcggggggtaaaaaaaattggtgtttttgctccccgc

SEQ ID NO: 44233 - protein, 72 aa, Zea mays
  misc_feature: Ceres CLONE 1446112-F
  misc_feature (46)..(46): Xaa is any aa, unknown, or other
  misc_feature (60)..(60): Xaa is any aa, unknown, or other
  misc_feature (61)..(61): Xaa is any aa, unknown, or other
  misc_feature (63)..(63): Xaa is any aa, unknown, or other
  misc_feature (68)..(68): Xaa is any aa, unknown, or other
MATATTLPLGLLPSKTLTLSPLPSARRSLSIAAVEPRRWLLRAAAXRAPEAVEVEFVNPXXKXEKNPXYGSP

SEQ ID NO: 44234 - DNA, 748 bp, Zea mays
  misc_feature: Ceres CLONE 1446115-F
  misc_feature: Encodes the peptide sequence at SEQ ID NO. 44235
  misc_feature (748)..(748): n is a, c, t, g, unknown, or other
ggagctccccgcggtggcggccgctctagaactagtggatcccccgggctgcaggaattcgcacgagaccattacctagaacatcctaatcgaaaactcccgattccaaagctgctctcgtccctagaaataaagcagctcctccgcggggcggcgaactgctactcatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgacctttccccagaactatcccaacagcccgccatcagtaagatttacttctgggatgtggcatccgaatgtttatccggatgggcgtgtttgcatttctattcttcatccacctggtgaagatcccagtggttatgagcttggcagcgaacggtggacaccagtgcacacggttgaaagtatagttctgagcatcatttcaatgctctctagtccgaatgacgagtctccagcaaatattgaagctgccagggattggagagagaaggcggatgagttcaagaaagaagttaggccatgtgtccgcaggtctcaggaaatgctgtgaaggaggaacatggggggagttn

SEQ ID NO: 44235 - protein, 169 aa, Zea mays
  misc_feature: Ceres CLONE 1446115-F
  misc_feature (11)..(162): Pfam Name: UQ_con Pfam Description: Ubiquitin-conjugating enzyme
  misc_feature: SWISSPROT Homolog: EC 6.3.2.19 Ubiquitin--protein ligase
MAGTPSQASLLLQKQLKDLAKNPVDGFSAGLVDDSNVFEWQVTIIGPPDTLYDGGYFNAIMTFPQNYPNSPPSVRFTSGMWHPNVYPDGRVCISILHPPGEDPSGYELGSERWTPVHTVESIVLSIISMLSSPNDESPANIEAARDWREKADEFKKEVRPCVRRSQEML

SEQ ID NO: 44236 - DNA, 755 bp, Zea mays
  misc_feature: Ceres CLONE 1446117-F
  misc_feature: Encodes the peptide sequence at SEQ ID NO. 44237
  misc_feature (403)..(403): n is a, c, t, g, unknown, or other
  misc_feature (407)..(407): n is a, c, t, g, unknown, or other
  misc_feature (410)..(410): n is a, c, t, g, unknown, or other
  misc_feature (493)..(493): n is a, c, t, g, unknown, or other
  misc_feature (558)..(558): n is a, c, t, g, unknown, or other
  misc_feature (662)..(662): n is a, c, t, g, unknown, or other
ctggagctccccgcggtggcggccgctctagaactagtggatcccccgggctgcaggaattcgcacgagaccattacctagaacatcctaattgaaaactcgttatttccgggctccctcctgtgtacaccactcccgccccgcctaccattttatccccgcctctcctggcctctgccgccccgtcgcacagaatcgcttggtgcaccctgcgagggcctcctcgaaaccctagcttgcccagcccctccgggccatgggcaagtacatgcgcaaggccaaggcttccagcgaggttgtcatcatggatgtcgccgccgctccgctcggagtccgcacccgagcgcgcgccctcgcgctgcagcgtctgcaggagcagcagacgcagtgggaagaaggtgcntgcngcnaccacctggagctaaggaacccggagctcgagaagctgccgccgcccgcggcgacccacgagaggtcaggcgggaggaaagcngcagccgaaggccgccgcactaaggaggctgaagcgtcgtacgggggaagacatgctcgagttgnaggccatggagaggattaccaggagacgacgccctgcagcttgattacacccagatgactagcactcctgggtccacagatccggccactcttgccacgcaggntgaacgctctccggtgcacgcctcccaagtctagggagatgatgaatacttgctgccgacagcgacggcacagcaggattctttgacagtaca

SEQ ID NO: 44237 - protein, 119 aa, Zea mays
  misc_feature: Ceres CLONE 1446117-F
  misc_feature (51)..(51): Xaa is any aa, unknown, or other
  misc_feature (52)..(52): Xaa is any aa, unknown, or other
  misc_feature (101)..(101): Xaa is any aa, unknown, or other
MGKYMRKAKASSEVVIMDVAAAPLGVRTRARALALQRLQEQQTQWEEGACXXHLELRNPELEKLPPPAATHERSGGRKAAAEGRRTKEAEASYGGRHARVXGHGEDYQETTPCSLITPR

SEQ ID NO: 44238 - DNA, 734 bp, Zea mays
  misc_feature: Ceres CLONE 1446120-F
  misc_feature (354)..(354): n is a, c, t, g, unknown, or other
  misc_feature (384)..(384): n is a, c, t, g, unknown, or other
  misc_feature (385)..(385): n is a, c, t, g, unknown, or other
  misc_feature (390)..(390): n is a, c, t, g, unknown, or other
  misc_feature (392)..(392): n is a, c, t, g, unknown, or other
ggagctccccgcggtggcggccgctctagaactagtggatcccccgggctgcaggaattcgcacgagaccattacctagaacatcctaatcgaaaaaattccagttgctcgctcgctccactcccctcccccggtcccgttgcgtcggcggccggacaaaaccgccagactctctcgtcccccggcccggccctcccagacccagttccatccttttgcttgcttgcggttgcgggcaaccgctgtgatagagcgagcgagcgacctgtagtacgggagagggttggaaggagcgaaaggagagagaggttggtggttgtttggtggaggagaatagttggttgtcttcagggnaggagagaggcaaccatgagcgcagggcgnntgtgntntccccccgtgtcccccccctcggcgtcctcgcggcggcgctcggcttcgcggcgaagccacccgcgtcaaggtttcggacgttcaaacagcggcagtcctgttgatgcatataccccagaaccccagccttggccctggggttaatatctgccgcctctccttatgctccccgtcccatcataaacgcaggggctggttccatctgtttgaagaagcatcctgttccctcagacactaatgggagcaaagccctgatttccttccaccaatcctgggggcactttccaaaatccccttcctttccccaatggactgggggcccccctgaacaaccagaaagg

SEQ ID NO: 44239 - DNA, 758 bp, Zea mays
  misc_feature: Ceres CLONE 1446122-F
  misc_feature: Encodes the peptide sequence at SEQ ID NO. 44240
aaagctggagctccccgcggtggcggccgctctagaactagtggatcccccgggctgcaggaattcgcacgagaccattacctagaacatcctaatcgaaaaattctcatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggaggctgccggtgctgctcgcgcgccgacgaggtcccggagcccatgtaccgcccggagcccaccgaggtccacaactgaagccgaagcacacatcgatctacaaagatgcatggacgacgactcttatcttagctaattaataagcactacatccatgcatgtccacaataggggcctaggcctactatactatacgtcgtcagcagaaagtctggttttgaattcaataataagatgcacctatatgtgtgtggtacatgaaaaaaaaaaaaaaaaagcttatcgataccgtcaacctcgagggggggcccggtacccaatttcgcctatag

SEQ ID NO: 44240 - protein, 116 aa, Zea mays; identical to SEQ ID NO: 40624
  misc_feature: Ceres CLONE 1446122-F
  misc_feature (1)..(93): Pfam Name: GRP Pfam Description: Glycine rich protein family

SEQ ID NO: 44241 - DNA, 744 bp, Zea mays
  misc_feature: Ceres CLONE 1446123-F
  misc_feature: Encodes the peptide sequence at SEQ ID NO. 44242
  misc_feature (412)..(412): n is a, c, t, g, unknown, or other
ctggagctccccgcggtggcggccgctctagaactagtggatcccccgggctgcaggaattcgcacgagaccattacctagaacatcctaatcgaaaatttatgctttcctttcggtcggcgacgcatacattcggcgagggagaggaagaagtcagtaaagtaaattctgttgctccaattcggacgaggagatgccgcggatccctctgatcaggttccccaagcggaatctcaaagccccatctccatccgcgccagcggcgtcgcaacccgcagaccagcacgcgaccctcatgttccggttaggggctaaagcagaggcaccatccttctggagagattaaaaattacccgctttagatctgatgtgccttgcccaccttctcatactgccgtaggaggtccagctncactcctccctaagcgcaaaccccctgactgaagaagagattgaggctattatgctgggggggctccatctgatatcccctcctatgaattggaaattcctagaacatcattaagattgtatggctggaccttattgcctttgccctctgaaggagtgttattgaaccctgtcgattggaagtggtttttttaattagccgggaagttggttgtgaaaactcctttcaggacccccccatgttattgaacaacccggaaccttttattcctttaaaaaggttgaatggaaagtttttcctttcgccccggtaaaaaaaaaaaaaaacttttt

SEQ ID NO: 44242 - protein, 50 aa, Zea mays
  misc_feature: Ceres CLONE 1446123-F
MPRIPLIRFPKRNLKAPSPSAPAASQPADQHATLMFRLGAKAEAPSFWRD

SEQ ID NO: 44243 - DNA, 778 bp, Zea mays
  misc_feature: Ceres CLONE 1446126-F
  misc_feature: Translation starting site: 180
tggagctccccgcggtggcggccgctctagaactagtggatcccccgggctgcaggaattcgcacgagaccattacctagaacatcctaatcgaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctggttggtggggccctccccctccagggacgtgcacatgaagatccccgtccaaccccccccaaacacctcccaaaactaccgcctttctcccgggccgtccccaaggggccccgcccctaataaaaaaagttcgtcgacgaaggcgcccaaacaggagctaaagacattttttacccggcaaaaccgcccccttttcgttcccaaaccccaggggcttgccaaccaaaaaacttcgggggtccccccccccccgcgcaggtgtccgaaaaccccccgttggggcccccgggtgcccccctctctccgacaccggaacccgggttgcccccaccttggccgtgcgagccccccgccccctcgccttatatttttgaccacccggaggctgtctacggggcccacaaaactaagacgcgggttac

SEQ ID NO: 44244 - DNA, 756 bp, Zea mays
  misc_feature: Ceres CLONE 1446127-F
  misc_feature: Encodes the peptide sequence at SEQ ID NO. 44245
  misc_feature (700)..(700): n is a, c, t, g, unknown, or other
aagctggagctccccgcggtggcggccgctctagaactagtggatcccccgggctgcaggaattcgcacgagaccattacctagaacatcctaatcgaaaacatgtcctggaatcaggatcaattgatacggttggcaccgttggtattctgcagttacatccaggagcaatcaatagcatcccaagcaaatcacacctagaaattgatgtaagagatattgatgagaagagaaggaatgatgtcattgagaagattcgccagtctgcagcacatatttcaaagaaccgtggagtagagctttcagaatttaagatcatcaaccaggacccacctgctctatctgacaaatcagtcgttgacgcaatggaatttgctgcaaaacagttaaacctggcatacaaaaagatgattagcagagcctaccacgattcactcttcatggccagagtatcaccaatgggtataatcttcattccctgggtacaaggttacagccacaagccggaaggagtatgcatcacccgaggacatggcgaatggggtgaaggtcctagcctttgacatggctacgctgtcgctggagtgacttgttagcgtttggaggaaatcagtcaccccgtgccaaaaagcaaaaacaaacacctggtgtatttctaatataagctgcatagcatgggcgtcatcttccctgcacaggnctgtatacaaacatcaatcatcagggtttaagataaagttgtcatctggatctgaa

SEQ ID NO: 44245 - protein, 186 aa, Zea mays
  misc_feature: Ceres CLONE 1446127-F
  misc_feature: SWISSPROT Homolog: EC 3.5.1.87 N-carbamoyl-L-amino-acid hydrolase
AGAPRGGGRSRTSGSPGLQEFARDHYLEHPNRKHVLESGSIDTVGTVGILQLHPGAINSIPSKSHLEIDVRDIDEKRRNDVIEKIRQSAAHISKNRGVELSEFKIINQDPPALSDKSVVDAMEFAAKQLNLAYKKMISRAYHDSLFMARVSPMGIIFIPWVQGYSHKPEGVCITRGHGEWGEGPSL

SEQ ID NO: 44246 - DNA, 735 bp, Zea mays
  misc_feature: Ceres CLONE 1446129-F
  misc_feature: Encodes the peptide sequence at SEQ ID NO. 44247
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (735)..(735): n is a, c, t, g, unknown, or other
ctggagctccccgcggtggcggccgctctataactagtggatcccccgggctgcaggaattcgcacgagaccattacctagaacatcctaatcgaaaaattttggctctggtcgtcacaaatctgtctgtgcatcgcggcggcgacaagggggcgacgaggcaggcgtagcgggcggcgactacagcggcagcagatctcacggaatggcggcgaaggcaatctcgagtcccgtgccggtggagtggtacccgacgctggccgtcgtcatggtatcagtaggcctcatgttcaccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgcttgtgttctgcatcccgagttgtagacttggttatgccagatcctcaaagctgttgtccctacgaatatagagcatttgaacttattctagaacgatgtatgggaacaccngnnagtaaagcacgttttcttccaggtctgcattatatatcatcaatctaaatcccctgtgcctaaaaaaaaaaaaaaaagcttatcgataccgtcgacctcgagggggggcccggtacccattcgccctatagtgagtcgtattacgcgcgctcactggccgtcn

SEQ ID NO: 44247 - protein, 76 aa, Zea mays
  misc_feature: Ceres CLONE 1446129-F
  misc_feature (2)..(76): Pfam Name: UPF0197 Pfam Description: Uncharacterised protein family (UPF0197)
MAAKAISSPVPVEWYPTLAVVMVSVGLMFTASFFIYEATSSRRSRSLSKEIATAVVASVFLGFGSLFVLLASGVYV

SEQ ID NO: 44248 - DNA, 760 bp, Zea mays
  misc_feature: Ceres CLONE 1446133-F
  misc_feature: Encodes the peptide sequence at SEQ ID NO. 44249
aagctggagctccccgcggtggcggccgctctagaactagtggatcccccgggctgcaggaattcgcacgagaccattacctagaacatcctaatcgaaaagtcatttaaaggccacgggtaccaccactctactcttcgtcctcctcgatcgtcccaacaaccgcaatggcgcagcagaggcttctcgctctcctcctggtggcggccctcctcgcgctctccttctcgcaagggcaggtggaagcgcggaaggtgcaggtgcggcgcgcgcccctcggcggcggcggccgcctgcttccggaggcgatgatggcgtacacgacgacggactacgggccccccacggccaacaccaacacccacggcggcatggtcccgtcgccggacgacccctcctcgccgccgacgcactgaccggccagtcgatctcaccggcaacaactgtgttgttctttgggattggagctttggaagagaagattggaggagaggatcggaagaagctggtcttgttcttctcccttattgggcgcgcgtgttgtgttgtgcgctgctgtgtctgtgtagtccagctgtagctgctgctgtgcttagctgattgaagttggaactgtagtgggtccacagtattatgcatgttttgtttgttgagacgtcagaaccccatctctatcgttgaatcttgtctgaatctagtcagctctatgtagcgatacatgaatgtacgtagtaaaatggaaaaaaaaaaaaaaaagctt

SEQ ID NO: 44249 - protein, 82 aa, Zea mays
  misc_feature: Ceres CLONE 1446133-F
MAQQRLLALLLVAALLALSFSQGQVEARKVQVRRAPLGGGGRLLPEAMMAYTTTDYGPPTANTNTHGGMVPSPDDPSSPPTH

SEQ ID NO: 44250 - DNA, 739 bp, Zea mays
  misc_feature: Ceres CLONE 1446139-F
  misc_feature: Encodes the peptide sequence at SEQ ID NO. 44251
  misc_feature (595)..(595): n is a, c, t, g, unknown, or other
tggagctccccgcggtggcggccgctctagaactagtggatcccccgggctgcaggaattcgcacgagaccattacctagaacatcctaatcgaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggtggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacgnaggggctcgtcccgcggcagcgggtccttcacactggctcccccattcacggtgctggttgcagggctacccttgacgcatcactaatgtatccgggaccctatgatgaaaaaggtgatttaccccaaccacttcctccttact

SEQ ID NO: 44251 - protein, 186 aa, Zea mays
  misc_feature: Ceres CLONE 1446139-F
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (139)..(139): Xaa is any aa, unknown, or other
MASRRVVSSLLRSASRLRAASPAAPRPRGAPHRPSPAGYLFNRAAAYASAAAAQVAPATPPPATGKTGGGKITDEFTGAGAIGQVCQVIGAVVDVRYDEGLPPILTALEVLDNDIRLVLEVAQHLGENMVRTIAMDGTXGLVPRQRVLHTGSPIHGAGCRATLDASLMYPGPYDEKGDLPQPLPPY

SEQ ID NO: 44252 - DNA, 736 bp, Zea mays
  misc_feature: Ceres CLONE 1446140-F
  misc_feature: Encodes the peptide sequence at SEQ ID NO. 44253
  misc_feature (20)..(20): n is a, c, t, g, unknown, or other
  misc_feature (56)..(56): n is a, c, t, g, unknown, or other
aagtaagagaggggtgtggngggtgggtgggacggaaagtggttttttttttaatntcaaactggagctccccgcggtggcggccgctctataactagtggatcccccgggctgcaggaattcgcacgagaccattacctagaacatcctaatcgaaaacagcccaactggtaccgtgccgtgccgtctcctctcctctctcctctctcatccccaggtctcagcccacctagcaatgttctcctcctccccttccacatgaccagcgccgcgccgcgcagcgcagccatccttgttctgtcccgggtacgccgccacacacatcgcttcaagcgcttccctccgtccctcctctttgtggattggaatcgacgcctgaaagtggatgacgatggcgggttcttgcgccgcgccgcccgttgcctgtcttccctcgttgaggacgctgccgccaactcacgtcagacttagcggcttcttgccctgttccgcggccgcgcggtgtcgcggcgacgccgtgctgggatgcgctctgggggccaagaggcaaacgccgggtgttctgaaccgggaacttgcttccctacgaaaaacttgaatttgttggttgggcctgcatgaatccgtggagtggaactagaacccttttcattttcctggcctttgttggctaaaactgatttccgtggcttttcccaaattagatttgcttaacgggtgaatgaccaaattttat

SEQ ID NO: 44253 - protein, 70 aa, Zea mays
  misc_feature: Ceres CLONE 1446140-F
MTMAGSCAAPPVACLPSLRTLPPTHVRLSGFLPCSAAARCRGDAVLGCALGAKRQTPGVLNRELASLRKT

SEQ ID NO: 44254 - DNA, 762 bp, Zea mays
  misc_feature: Ceres CLONE 1446143-F
  misc_feature: Encodes the peptide sequence at SEQ ID NO. 44255
ctggagctccccgcggtggcggccgctctagaactagtggatcccccgggctgcaggaattcgcacgagaccattacctagaacatcctaatcgaaaaacactcaataatactctactatcactgactagtattggtaccatcaattaaccaacgagacatcaatggcggtcgcaagtaatacaccagctaccactctactgcccctggcggcccttgtggccgtcgctggctccctcttcctcgccggcccggccgcggccacggtgaagaccggtcatgtgactgtcttctggagtcggaacaaggcctacggcacgctccgagaggcctgcgacacgggcacgtacaccatcgtcgtcatctccttcctcaacgactcgaccggccccgggaacagcccgccgagcctggacctctcgggccaccccgtcgccagcatcggcgccgacatcaagcactgccagtcgaagagcatcatggtgttcctctccctcggcggcggccagcactccctgccgagcgccgaggccgccgcggacctcgccgactacctctggtacgcctacttcccggcgccggccccgcgcgccggagtgcgccgcccgttcggcgacgcatacgtagactgcctcgacttcttcctcgaccgcggaggccgcccgacgacagaccactcgacgcgctagccacgcgcctgtagagctactaccgtgaattcagcgctgcacgcccgtgcatctgtcatcgactccacgttgct

SEQ ID NO: 44255 - protein, 174 aa, Zea mays
  misc_feature: Ceres CLONE 1446143-F
  misc_feature: SWISSPROT Homolog: EC 3.2.1.14 Chitinase
MAVASNTPATTLLPLAALVAVAGSLFLAGPAAATVKTGHVTVFWSRNKAYGTLREACDTGTYTIVVISFLNDSTGPGNSPPSLDLSGHPVASIGADIKHCQSKSIMVFLSLGGGQHSLPSAEAAADLADYLWYAYFPAPAPRAGVRRPFGDAYVDCLDFFLDRGGRPTTDHSTR

SEQ ID NO: 44256 - DNA, 694 bp, Zea mays
  misc_feature: Ceres CLONE 1446144-F
  misc_feature: Encodes the peptide sequence at SEQ ID NO. 44257
tggagctccccgcggtggcggccgctctagaactagtggatcccccgggctgcaggaattcgcacgagaccattacctagaacatcctaatcgaaaaattcttcaatcccgcgcgcgtcggctgtgttagccggtagccctccccccgtccgaggtccgagtccgaccgaaggagagaggcagcagccatggctaagggcgggctgagcaagctccggtgcatggtcaagaggaggtggcactcgtcgagccgcatcgtctcccgcgccccgtcgccaccggctcacgccgacgccgtcgccgtcgccgccacctccggccacgcgcgcggcgcgtcgtcccacggcgcggacgaggcgcccaagggcctgcacgcggtgtacgtcggcaggtcgcgccgccggtacctcgtcgcgcaggagctcgtgggccacccgatgttccagaccctcgtctaccgcactggcggcgtcgggggtcccgcgggtactgtcgtcgtcggctgcgaggtcgtcctcttcgagcacctcctctggatgctggagcacgccgactcgcagtctgaggtcctcgacgagctcgtcgactactacggctgctgacctgcgaattcgatgggagatagagtagaccaagctttgttgccactcatgaaaccctggttggcttggccccctgggtttgattttgggtt

SEQ ID NO: 44257 - protein, 137 aa, Zea mays
  misc_feature: Ceres CLONE 1446144-F
  misc_feature (24)..(119): Pfam Name: Auxin_inducible Pfam Description: Auxin responsive protein
MAKGGLSKLRCMVKRRWHSSSRIVSRAPSPPAHADAVAVAATSGHARGASSHGADEAPKGLHAVYVGRSRRRYLVAQELVGHPMFQTLVYRTGGVGGPAGTVVVGCEVVLFEHLLWMLEHADSQSEVLDELVDYYGC

SEQ ID NO: 44258 - DNA, 756 bp, Zea mays
  misc_feature: Ceres CLONE 1446151-F
  misc_feature: Encodes the peptide sequence at SEQ ID NO. 44259
  misc_feature (425)..(425): n is a, c, t, g, unknown, or other
  misc_feature (445)..(445): n is a, c, t, g, unknown, or other
  misc_feature (567)..(567): n is a, c, t, g, unknown, or other
  misc_feature (569)..(569): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaaactttcctaaaacatcctaatcgaaaacccacagccgccgccaaaagggttcctcaccatcttgaacgctcgccggaccaatcccaagcagtcctcgcagcagatggcagttcccggcggccgcaacggactcagggacgaggacgacgacatggcccagcacgccgaggccttcggcggcgtctctgacgacgaggacgtgcctccccaccttcgcgccctcgccaacgccgcccagtccggcgacgtccccgcccttgtggctgccctcgataatcatgatggcagtattgattgttccagttgaacatggtgatactttgctccatctggcatgcttatatggtcantcttccttgtgtgcagctanttgctggaacgtggagctagcttggaatgccaagacgaagaaggtgctattcctcttcaccgatgcgtgtgctggaggcttcactgagctggtcaatatattctcaactttgctgccaacangnatggnttgcgtagtgagaatgctcaacactattgattctgaagcgatacgccgctccatcatgctgctagaggagaacatttggatgttgtcaagcttcttctcagggctggggcgtcccccaagatgagaacactacgggcagaacccgctgatatgctgacaaaaacccgagtttcgaccctggt

SEQ ID NO: 44259 - protein, 67 aa, Zea mays
  misc_feature: Ceres CLONE 1446151-F
MAVPGGRNGLRDEDDDMAQHAEAFGGVSDDEDVPPHLRALANAAQSGDVPALVAALDNHDGSIDCSS

SEQ ID NO: 44260 - DNA, 704 bp, Zea mays
  misc_feature: Ceres CLONE 1446152-F
  misc_feature (477)..(477): n is a, c, t, g, unknown, or other
  misc_feature (507)..(507): n is a, c, t, g, unknown, or other
acccgcggtggcggccgctctagaactagtggatcccccgggctgcaggaattcgcacgagaccattacctagaacatcctaatcgaaaaagattcatagatccttcacactgatcggcaattgaaattattgaagatttccttctcaaaacagaagggaatacactgtaattgtcgatgggttccatgggccaaaaggtaaagtggagctggagctcagccttaatcggagcagcatctgcggcagcagcaacttctctcctcagcgccaagccaaaggatccaactttccaccttatctccatagacctaacctcactcaaactcaacctcccagtcctcgacgctgaattaatgctcaccgtacacgtcacaaaccctaacatcgcagccatccattactcctccacaacgatgtcgattctatacgacggcacggtccttggcacggcggaagtcaaagctggttcgcagccngcgagatcgtgtcagcttctttaggtaccngcacgtctcgacgggatgaagcttgcgcatcacgcccgaagtttctttgctgacctggccaaaagggaaaatgaaccttgaggcttaacttgaatttcaaaggaacggctaaggtttttgggggggaactataattttagggggccccgggaaaaattttgtaaccgggaaacccgccctttcccaaatttattggg

SEQ ID NO: 44261 - DNA, 721 bp, Zea mays
  misc_feature: Ceres CLONE 1446156-F
  misc_feature: Encodes the peptide sequence at SEQ ID NO. 44262
  misc_feature (377)..(377): n is a, c, t, g, unknown, or other
  misc_feature (386)..(386): n is a, c, t, g, unknown, or other
  misc_feature (387)..(387): n is a, c, t, g, unknown, or other
  misc_feature (522)..(522): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (554)..(554): n is a, c, t, g, unknown, or other
  misc_feature (555)..(555): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
gctctagaactagtggatcccccgggctgcaggaattcgcacgagaccattacctagaacatcctaatcgaaaaactgcgactgtgagcttcgttcgttcagttcatccgtgttcttgtttgcgaggtcaagagagagaggatgtcgtgctgcggaggcaactgtgggtgcggctccggctgcaagtgcggcaacggctgcggagggtgcagcaagatgtacccggacatggctgagcaggtgaccaccaccacccgggctctcatcatgggtgtcgcaccatccaaggcgtccgccgagggcgggttcgaggcggccgccggagctgagaacgggggtggaaatgcggcggaaattggcagtgcgacccctgaaantgttttccnncccctcgtggttcaaccctgtaggccggcccggagaaactcgctcattattacaaactaaataaacaataagggccgccccgggcggggttttccagtcatccgtcggtttattcgcgcccaggctgcagcttanagaaagcagggccgcggnnnnnnnnnnnncgnngctttcctcnncnggacatccctctataacgacctcaccgcctcgggatagtgctaatctcagaaatcgggatggaacgaccggacacgccagctccgccgagaacctcactctacaaggctgggactcccacacacaaggcctttttccccaccatcgtgtgccg

SEQ ID NO: 44262 - protein, 101 aa, Zea mays
  misc_feature: Ceres CLONE 1446156-F
  misc_feature (1)..(69): Pfam Name: Metallothio_2 Pfam Description: Metallothionein
  misc_feature (79)..(79): Xaa is any aa, unknown, or other
  misc_feature (82)..(82): Xaa is any aa, unknown, or other
MSCCGGNCGCGSGCKCGNGCGGCSKMYPDMAEQVTTTTRALIMGVAPSKASAEGGFEAAAGAENGGGNAAEIGSATPEXVFXPLVVQPCRPARRNSLIITN

SEQ ID NO: 44263 - DNA, 732 bp, Zea mays
  misc_feature: Ceres CLONE 1446158-F
  misc_feature: SWISSPROT Homolog: EC 4.1.1.20 Diaminopimelate decarboxylase
  misc_feature (400)..(400): n is a, c, t, g, unknown, or other
  misc_feature (429)..(429): n is a, c, t, g, unknown, or other
  misc_feature (488)..(488): n is a, c, t, g, unknown, or other
  misc_feature (491)..(491): n is a, c, t, g, unknown, or other
  misc_feature (543)..(543): n is a, c, t, g, unknown, or other
  misc_feature (578)..(578): n is a, c, t, g, unknown, or other
  misc_feature (591)..(591): n is a, c, t, g, unknown, or other
aagctggagctccccgcggtggcggccgctctagaactagtggatcccccgggctgcaggaattcgcacgagaccattacctagaacatcctaatcgaaaaagtcgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcnagggagtgcgggtggaggacgcgatgacngctgccgagcgcagcccctttctactctacagcaagccacagatcctccgcaacttcgnccngctacgcgatgctctccaggggctccgctccatcatcgggtatgccgtgaanggccaaacacaccttcccgtgctacgcgtcctgcntgagcttggtgcngggcccttcttcgttagggggaacgagctccgacctcgccctccagggggaatccgacccccccgggggcatttttacgggaaaggggaaaaccctcgaactccttaaattcctcggtgaaaagggagaattttggaaagg

SEQ ID NO: 44264 - DNA, 781 bp, Zea mays
  misc_feature: Ceres CLONE 1446163-F
  misc_feature: Encodes the peptide sequence at SEQ ID NO. 44265
  misc_feature (630)..(630): n is a, c, t, g, unknown, or other
  misc_feature (728)..(728): n is a, c, t, g, unknown, or other
caaagctggagctccccgcggtggcggccgctctagaactagtggatcccccgggctgcaggaattcgcacgagaccattacctagaacatcctaatcgaagaacttcgcttcgcttttccttcacgaaaacagagcaaatccggcgagccggtgcggcggagggagacgcctgctcgagaaggaggattagcaggaggcagcggagatggatccggacgcagtgaagtcgacgctctctaaccttgccttcggcaacgtcatcgccgccgccgcccgcgacatccagaaggaaatggtggctaaagacaaggctcaagcagcacctgcaagccatgatgaagttgatcttgatgagttgatggatgaccctgaacttgagaagttgcacgcggagagaattgctgcccttaagaaagaggttgagaagcgtgaagtgctaaaaaggcaaggtcacggtgaatacagggaggtaattgaaggggacttccttggggaggttactggcagtgaaagagtcatatgtcatttctatcaccgtgaattttaccgttgcaagatcatggataagcatttgaaggcccttgctcctgtctatgtgggagcaaaattcatcaagcttgatgctganaatgctccattctttgtggccaaactggcaatcaaaacccttgccgtgtgtaatattgttcaagaagggtattgctgttgaccggttagttgggtttncagatctcggaagtaaagacgatttttccagcagagcgttggaaaacattctc

SEQ ID NO: 44265 - protein, 167 aa, Zea mays
  misc_feature: Ceres CLONE 1446163-F
  misc_feature (141)..(141): Xaa is any aa, unknown, or other
MDPDAVKSTLSNLAFGNVIAAAARDIQKEMVAKDKAQAAPASHDEVDLDELMDDPELEKLHAERIAALKKEVEKREVLKRQGHGEYREVIEGDFLGEVTGSERVICHFYHREFYRCKIMDKHLKALAPVYVGAKFIKLDAXNAPFFVAKLAIKTLAVCNIVQEGYCC

SEQ ID NO: 44266 - DNA, 811 bp, Zea mays
  misc_feature: Ceres CLONE 1446167-F
  misc_feature: Encodes the peptide sequence at SEQ ID NO. 44267
ctggagctccaccgcggtggcggccgctctagaactagtggatcccccgggctgcaggaattcgcacgagaccattacctagaacatcctaatcgaaaaatcccgaagtcaccgagctgagctccaaagaatctagcagctaggagcaggccgtgtatacgccatccaccacggcaacatgtgctccggctcctggtcctggagcagcagcaagaagcgcaagcgcccgtctcttgttgtcgtcaacctcaagcggcgccagctgcagaagacgccgccgccgaacgccacctcgttcctcagttgctatcaggaggaagaggctgaggctgaagaggttgcgagccggagcagaggccatggagatggtgaacctgaagctcctaccctggaagaaccggtgcatccatcccggagaaaccaaaagccgccgggaagaaggcccagcgccgccttcccgccccgccgaagaaccctccgccgctgccttcccaggacccttgtccccaaaaccccccggcccgtgcccagaagccaggaaccgggaaccttggaacctgccgtgaaaataattgcctttcctccttgctgccctgcctgaaccatggaagtacctagctttaaccttgcgttccctcccctggcgccttgtgctagttgcgtgggcaggacagccgaactcctaggtatcctatctgcttggctgctcccccctgtctgtgctctgctgtcctgctcaacatcaccggctcctgagctctcctggtgctctgtgccatggtgtttgacttatatatagtgcgcgaatact

SEQ ID NO: 44267 - protein, 140 aa, Zea mays
  misc_feature: Ceres CLONE 1446167-F
MCSGSWSWSSSKKRKRPSLVVVNLKRRQLQKTPPPNATSFLSCYQEEEAEAEEVASRSRGHGDGEPEAPTLEEPVHPSRRNQKPPGRRPSAAFPPRRRTLRRCLPRTLVPKTPRPVPRSQEPGTLEPAVKIIAFPPCCPA

SEQ ID NO: 44268 - DNA, 685 bp, Zea mays
  misc_feature: Ceres CLONE 1446168-F
  misc_feature: Encodes the peptide sequence at SEQ ID NO. 44269
ctggagctccccgcggtggcggccgctctagaactagtggatcccccgggctgcaggaattcgcacgagaccattacctagaacatcctaatcgaaaaactatccctctggcctcgtctcgtcttctcttctcgcgaatggcggcgctgtgcgatctccgtcgctgccccctccgccagtgatttctgggacgcgcgacgaacacgagttggaaggaggtggtcgtgctttgggcggcgaaggacctgggcgctagcagcctcagaccctgacagatcacaacctgacagatcacagagtgctgagtggaagcaacatatgaagctgacacggaaaaggaaaatggatgatctccttggttatgtttccctgtcttgtgcatgctgcatttcctgctaccgtgaagaccggggtccaggagagtaggagactgaaagcactgtcgagaagactgaaattatcacattgacatgaagaccaaagccatctcttacctacttatctttgtagcttacgtttctattttattctgtcatgaaaactaaagtcttatgtatggtcattatgtactattttggttctgaaaatatttgtttatgttatgaaaactattggttgaaagaaaaaaaaaaaaaaaaaagcttatcgataccgtcgacctcgagggggggcccggtacccaatt

SEQ ID NO: 44269 - protein, 35 aa, Zea mays
  misc_feature: Ceres CLONE 1446168-F
MKLTRKRKMDDLLGYVSLSCACCISCYREDRGPGE

SEQ ID NO: 44270 - DNA, 671 bp, Zea mays
  misc_feature: Ceres CLONE 1446169-F
  misc_feature: Encodes the peptide sequence at SEQ ID NO. 44271
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaaataagccggcactccggcaggatcacgcagctgcctggtgcccacgataacccagaggcctcgagaacggctggaagaaccgagagcgctccggaaatgtcggcgggtgagctgcggtcggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcacgcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaacaaggaaattgttcctgagaaatgtaaggttgtggtgaaaccaaccagggttgttgttactcttttcaaggcttctaaaggcaactggttagn

SEQ ID NO: 44271 - protein, 157 aa, Zea mays
  misc_feature: Ceres CLONE 1446169-F
  misc_feature (73)..(150): Pfam Name: CS Pfam Description: CS domain
MSAGELRSELDELRRLESLAKHPRVQILLANEIRNVEAKLAKATEPSPEPLAAASAPAPAPAARPVLSYVTLGSFSWEQDNEKIRIYVSLEGVEQEKVETTFKPTSVDIKFHDVKGKNYRCAIPKLNKEIVPEKCKVVVKPTRVVVTLFKASKGNWL

SEQ ID NO: 44272 - DNA, 643 bp, Zea mays
  misc_feature: Ceres CLONE 1446176-F
  misc_feature: Encodes the peptide sequence at SEQ ID NO. 44273
ctggagctccccgcggtggcggccgctctagaactagtggatcccccgggctgcaggaattcgcacgagaccattacctagaacatcctaatcgaaaaaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaaatttctggcttttcacaacacacactgcagtcatttacagtggagagattgcgtgcacttctacgacaaagtggtcgatcgaccaaaggcaaaaaggat

SEQ ID NO: 44273 - protein, 174 aa, Zea mays
  misc_feature: Ceres CLONE 1446176-F
MPTEEGSDGGGGAGAGAGEKKSSQAPAKPGACGAAKFLAGLPSRGNFSSGSAPSNLGGFRVYVCEHSTDPPEGQVIKTDSTNILIRHLQLNKQKTEGKDVDSRTVGENNRGKRSAARSLDVNNSAKKANLGTSSGSSAYEEISGFSQHTLQSFTVERLRALLRQSGRSTKGKKD

SEQ ID NO: 44274 - DNA, 758 bp, Zea mays
  misc_feature: Ceres CLONE 1446184-F
  misc_feature: Encodes the peptide sequence at SEQ ID NO. 44275
  misc_feature (316)..(316): n is a, c, t, g, unknown, or other
  misc_feature (319)..(319): n is a, c, t, g, unknown, or other
tccccgcggtggcggccgctctagaactagtggatcccccgggctgcaggaattcgcacgagaccattacctagaacatcctaatcgaaaacttttttcttttcagccgccacaccgcagctccggaaccgctgctgcccggcccattttaccaccgatccatggcggaggattcggcggcggcggccacgtggggcggcggcgacaagctcatcctgcgcggccttcagttccacggcttccatggcgtcctgcgggaggagaagacgctggggcagaagttcgtcgtcgacatcgacgcctggatggacctcgnccngcgcggcgagtccgactgcatcgctgacaccgtcagctacaccgatatctacagcattggcaaaggatgttgtcaaaggcaccccaccgcaactccttgggagtcgggagcccactccgatcgcaaaggccccgctggtcaagttccctccagggccccccaactccggggggaaggtggggaaaccccccccccccggggggaaggggttccgggaaacccggggggggggaaaaaaaggggcgcaaaaaaaaaaaaaagaaaacccttccacccctgtgtcggagaaaacaaattttttgggcccccccccccggggggccgaaaaaaaaaaaaccaccaagtttgggggcccggggcaccaattttttcctcctccctcccaaacaaatggggggccccctttttgaaaaaaaaaaggggtggcggtggtgggggg

SEQ ID NO: 44275 - protein, 199 aa, Zea mays
  misc_feature: Ceres CLONE 1446184-F
  misc_feature: SWISSPROT Homolog: EC 4.1.2.25 Dihydroneopterin aldolase
  misc_feature (52)..(52): Xaa is any aa, unknown, or other
  misc_feature (53)..(53): Xaa is any aa, unknown, or other
MAEDSAAAATWGGGDKLILRGLQFHGFHGVLREEKTLGQKFVVDIDAWMDLXXRGESDCIADTVSYTDIYSIGKGCCQRHPTATPWESGAHSDRKGPAGQVPSRAPQLRGEGGETPPPRGEGVPGNPGGGKKRGAKKKKRKPFHPCVGENKFFGPPPPGGRKKKNHQVWGPGAPIFSSSLPNKWGAPFLKKKRGGGGGG

SEQ ID NO: 44276 - DNA, 734 bp, Zea mays
  misc_feature: Ceres CLONE 1446189-F
  misc_feature: Encodes the peptide sequence at SEQ ID NO. 44277
ctggagctccccgcggtggcggccgctctagaactagtggatcccccgggctgcaggaattcgcacgagaccattacctagaacatcctaatcgaaaaaaaccttgaagcgccccgtagtgcagtgcagcagtgtgctacctcctcagtcctctcactccatcgcaaacgctagtcttcctctaaagctcggagcgagtctcagaagcgatggcggcgtccaagaggctgctgctggcggcgctgtgcgtggtggccgcggcgctgctcgccgtgcggtcggagtcccacggcctggaggaattcgcaagcagcgacgcgacgcccgagatgcagaccttcttcaagcccgaggccgcggcgctcccggaggccctggacgcgtcctccatgcccgccgccaccatggccgcgaagccggaggccacgtcgatcccgaccaccaccggcaccacgacgacggcggcggccacctccgccgcggcaggcactactgctgcgtcgccgccgcgcaggtccgtgtccgtggccgccggcgtggcctgcggcgtggctgccgtggccgtggtcggcatcgcggccgccgtggcgtacgtggtgcgcggcaggcgcagcagggaggtgcagctcggctcctccccgtgagcacgcgcccagcgccccggcccgctttacagacaggccgtcatcgccattaggatctgggtaagcgcgtcgtctagctctgcgatttgg

SEQ ID NO: 44277 - protein, 144 aa, Zea mays
  misc_feature: Ceres CLONE 1446189-F
MAASKRLLLAALCVVAAALLAVRSESHGLEEFASSDATPEMQTFFKPEAAALPEALDASSMPAATMAAKPEATSIPTTTGTTTTAAATSAAAGTTAASPPRRSVSVAAGVACGVAAVAVVGIAAAVAYVVRGRRSREVQLGSSP

SEQ ID NO: 44278 - DNA, 656 bp, Zea mays
  misc_feature: Ceres CLONE 1446203-F
  misc_feature: Encodes the peptide sequence at SEQ ID NO. 44279
  misc_feature (484)..(484): n is a, c, t, g, unknown, or other
  misc_feature (496)..(496): n is a, c, t, g, unknown, or other
ggagctccccgcggtggcggccgctctagaactagtggatcccccgggctgcaggaattcgcacgagaccattacctagagcatcctaatcgaaaaagtcacccaccccatccaaggccctcccaaagtcccaaaggccgccgccgcccgccagcccaccatggccgcgcagtccttcctcctcgccgccactgccgccgccaggtcccccgcggtcttcgccgctccctattcctccgcacgccctttccactcggtccacttcgtcgccggcccgtggggcgccgccgccgccagggcgctcgtcgtcgcggacgccactaagaaggccgtagccgtcctcaagggcgcgtctgaagtcgagggcgtggtcacgctcacgcaggacgacgatggacctacaactgtgaatgtccgtatcactggacttacccctggacttcatggcttcaccctccacgagtttggtgatactaccaatggntgcatatcgacnggaccactttttattcaaaacatctgacgcacggtgcacaaagaacaatttcgccggcggggaactgggaaactggttgcaaatctaagggctaacccaagcacccttggtgatccccaattctttgaatgcccaaattatttgtggaaaaacatttggg

SEQ ID NO: 44279 - protein, 120 aa, Zea mays
  misc_feature: Ceres CLONE 1446203-F
  misc_feature (54)..(118): Pfam Name: Sod_Cu Pfam Description: Copper/zinc superoxide dismutase (SODC)
  misc_feature: SWISSPROT Homolog: EC 1.15.1.1 Superoxide dismutase
MAAQSFLLAATAAARSPAVFAAPYSSARPFHSVHFVAGPWGAAAARALVVADATKKAVAVLKGASEVEGVVTLTQDDDGPTTVNVRITGLTPGLHGFTLHEFGDTTNGCISTGPLFIQNI

SEQ ID NO: 44280 - DNA, 734 bp, Zea mays
  misc_feature: Ceres CLONE 1446221-F
  misc_feature: Encodes the peptide sequence at SEQ ID NO. 44281
aaactggagctccccgcggtggcggccgctctataatagtggatcccccgggctgcaggaattcgcacgagaccattacctagaacatcctaatcgaaaagctcttatcctatcctgcttttcttcgcttctctcttccccgctctctcattcttctcatacaagtctgttgttggagggacacacgtatccagcccaccaaagatttactcaatttatcccagacgagacacacactcgcaacgaccggaccgtcgaatctcgcgactccggcgacatgtcgacggcggtggcagaggtgcggccgccctacgggttccccggatccgggaaggggagcggcggcgggtatgggaaggaggcgcacttggccgcggccgggaagaggaggagcgacggcttcttcatagaggaggaggaggttgaagaagacgtgctgactgacaactcgtcgatcggggcgccgtctccctcgggatcgtcgatcggtgagaactcgtcgtcggaggccgcgggggacgacggggaggaggaggtcgagagcaagctcaaggagggtgatgtgctcggctgcttggacgcgctcgaggactccttgccgatcaagaagggcctctcgagcttctactccggcaagtctaagtcgttcaccagcctcgccgaggccacagcggcggcggcggcggtcaaggaggtgctggccaagccggagaagcccttcaacaagcgccgcc

SEQ ID NO: 44281 - protein, 152 aa, Zea mays
  misc_feature: Ceres CLONE 1446221-F
MSTAVAEVRPPYGFPGSGKGSGGGYGKEAHLAAAGKRRSDGFFIEEEEVEEDVLTDNSSIGAPSPSGSSIGENSSSEAAGDDGEEEVESKLKEGDVLGCLDALEDSLPIKKGLSSFYSGKSKSFTSLAEATAAAAAVKEVLAKPEKPFNKRR

SEQ ID NO: 44282 - DNA, 668 bp, Zea mays
  misc_feature: Ceres CLONE 1446226-F
  misc_feature: Encodes the peptide sequence at SEQ ID NO. 44283
ggagctccccgcggtggcggccgctctagaactagtggatcccccgggctgcaggaattcacacgagaccacttaccttgaacgtcctagtcgaaaaagtcgtccatgctgcatcagcatgacggatctctccccatagtccctttagagaacttaatcttccatggcgagtcggcctaatctctggattctctccacgatctctcagcgaggccaggagagtgtgcgggagatggcggagaccccgccggtgactgactatcggcatgccggactgattctgcagagagacggtcccctccgtctgggacggtggctgagttcctgggcatacagatccctgctgctcctgtgagagcatgtgaaaacaaaatggacaatttacttgtcccatgtttagatcactgtttgttgccaactagcctgcggtctacttacttgcttctgatctgacactgtagttggtgaatgccgagaattccattctcgcctagtatttcactgcaagcagatctacggattgcgggagcctatcgaccctgacaagcaaaaaaggtgcctggactcgagtctgatcttagatattttggacaaagaagactgctgtgctgcattgtgttcatctcttgctataactgactgcatctgtgcggcgctccaatgagttc

SEQ ID NO: 44283 - protein, 63 aa, Zea mays
  misc_feature: Ceres CLONE 1446226-F
MASRPNLWILSTISQRGQESVREMAETPPVTDYRHAGLILQRDGPLRLGRWLSSWAYRSLLLL

SEQ ID NO: 44284 - DNA, 785 bp, Zea mays
  misc_feature: Ceres CLONE 1446231-F
  misc_feature: Encodes the peptide sequence at SEQ ID NO. 44285
  misc_feature (427)..(427): n is a, c, t, g, unknown, or other
  misc_feature (437)..(437): n is a, c, t, g, unknown, or other
  misc_feature (458)..(458): n is a, c, t, g, unknown, or other
aaagctggagctccccgcggtggcggccgctctagaactagtggatcccccgggctgcaggaattcgcacgagaccattacatagaacatcctaatcgaaaaatccaaagctgtagttgctgcaaagctctcgcaaaatcctactcccaccgccgactcgaacagtcgaacctcggctcccctcctccccaatccgtcatcttccttctacacttgtttctgcgggagcgggagagaaggcaccagggaggccgcccccgtcacccatagccaaagtcacgcgccaccaaactttgttctctcacccagtcgctttcgcgttcagcgcgagccgagcccagccggtgggtcggtcgctgaaagcggagccataaaggcgtcggcgacggcaggatgatgagcggcagatcgggcggcagggacggcnaagcgccggnccccgtcatcaggatcagggnttcccacgggagccaccttccgcgaagtcgtcgtggcggcgcaggctaccttcgggggagttgaaaaggaatcttgtgtacaactactggcttgggaccctgaaaggcaaaagcctcttctcccgggggaagagaaaaaatgacaaaaaatttccccccccccgaggggtttaagagtggggcaaatttcctttccctgtgaaaaccttcccccgggccaaataaaacaaaaaggtggaccccggtttttagaaaaaaaccgtaaaaaaccgtgggggcgttttcccccttaaaaaacaaaaaaaaaagggctcccccacaaggggg

SEQ ID NO: 44285 - protein, 42 aa, Zea mays
  misc_feature: Ceres CLONE 1446231-F
  misc_feature (12)..(12): Xaa is any aa, unknown, or other
  misc_feature (15)..(15): Xaa is any aa, unknown, or other
  misc_feature (22)..(22): Xaa is any aa, unknown, or other
MMSGRSGGRDGXAPXPVIRIRXSHGSHLPRSRRGGAGYLRGS

SEQ ID NO: 44286 - DNA, 721 bp, Zea mays
  misc_feature: Ceres CLONE 1446232-F
  misc_feature: Encodes the peptide sequence at SEQ ID NO. 44287
  misc_feature (448)..(448): n is a, c, t, g, unknown, or other
  misc_feature (484)..(484): n is a, c, t, g, unknown, or other
ctggagctccccgcggtggcggccgctctagaactagtggatcccccgggctgcaggaattcgcacgagaccattacctagaacatcctaatcgaaaagtaggtttttatccacgtgccgccgcaccggccaaccccgcgcccctcgaccgtctccgtcgccgcgccacccgcaccgggacccagtatggccgcctccggcgcatatccgggcacggcgttcaagatactcctctcctgccccgacggcctccctcgctcccgcgtttcggtgaagtttggtcggtcattcgacaggattccccatcctgatgcagccttggaggaatctataagtgaggtgtgggaccaaagccttcagcggaacccatatctatacagcggtacaaagtttcggtatggggagaatgccttgcactacaaagatgactcagatcatgatcttgagnactgtgtctcacttcattggggtctcacagactacnggaaattggtggaaacaaatttcaatcattggggggatttttttttggtcccaccggaaaaggaatcggacattgcccaacctttgccaaagccttgggaaagggggcttattttaaaacttcgaaaaaaatattttggtttgcaaaggccccaaggggggggaatctccgaaaaaatttttttcctcggggaaaacctcgcccccaaaaaatgaacagggggccacaaaagggaaa

SEQ ID NO: 44287 - protein, 170 aa, Zea mays
  misc_feature: Ceres CLONE 1446232-F
  misc_feature (88)..(88): Xaa is any aa, unknown, or other
  misc_feature (100)..(100): Xaa is any aa, unknown, or other
MAASGAYPGTAFKILLSCPDGLPRSRVSVKFGRSFDRIPHPDAALEESISEVWDQSLQRNPYLYSGTKFRYGENALHYKDDSDHDLEXCVSLHWGLTDYXKLVETNFNHWGDFFLVPPEKESDIAQPLPKPWERGLILKLRKKYFGLQRPQGGGISEKIFFLGENLAPKK

SEQ ID NO: 44288 - DNA, 739 bp, Zea mays
  misc_feature: Ceres CLONE 1446253-F
  misc_feature: Encodes the peptide sequence at SEQ ID NO. 44289
  misc_feature (499)..(499): n is a, c, t, g, unknown, or other
  misc_feature (500)..(500): n is a, c, t, g, unknown, or other
aagctggagctccccgcggtggcggccgctctagaactagtggatcccccgggctgcaggaattcgcacgagaccattacctagaacatcctaatcgaaaattactcggttcttcctactcccgatccatccgcagagggcggtgtccgcctcctctccacccgacagcttggccggcgacgagcaccaccaggacaccagattcttgattaccttggcaagtcctctgatagtgacccgtcttcaccagtggagcacttggcctccagatcaagccggaaaacattgatatatctagttctcactcttggccacatatatccagattatgatttcagtgctgttcgggcacacttgttcttccaagaagaggagttggaaagtttcaggcagatggtagacacctacttatctgatgcctctaggcaatgggcagccacaaatgaaggcagttctcttctggacagtatgactaaagcaattgatgagggtatcaaanntcaagagtgtgacatctacggctataatcaagactctgacgcagattccgttcttgaagaagggcccaaatgggcgttcactcctactcctccataaggacctaaagcgaggcttgggcctccaatgttctgcgcctccaatttcccggagaagcttctaaccggggttctcctctaagggaaaaaagaaaaaccttttttttaccggaaaaatagagaaccgggttcggaaccccccg

SEQ ID NO: 44289 - protein, 67 aa, Zea mays
  misc_feature: Ceres CLONE 1446253-F
  misc_feature (36)..(36): Xaa is any aa, unknown, or other
MVDTYLSDASRQWAATNEGSSLLDSMTKAIDEGIKXQECDIYGYNQDSDADSVLEEGPKWAFTPTPP

SEQ ID NO: 44290 - DNA, 722 bp, Zea mays
  misc_feature: Ceres CLONE 1446257-F
  misc_feature (488)..(488): n is a, c, t, g, unknown, or other
  misc_feature (508)..(508): n is a, c, t, g, unknown, or other
  misc_feature (511)..(511): n is a, c, t, g, unknown, or other
tggagctccccgcggtggcggccgctctagaactagtggatcccccgggctgcaggaattcgcacgagaccattacctagaacatcctaatcggaaaacttcgtcttgatgacctgtatgtggactccttcgagatcaaggatgtgaagacacttcgaggggagcatctgtcgcgtgccattggccgcctatcagggaaaggaggcaagaccaagtatgccattgagaactctaccaggactcgcatagttatcgctgatacgaagatccacatacttggatcctttgttaacatcaaggttgccagggattcactctgtagtcttatcttaggttctcctgccggaaaggtctattcgaagctaagggctgtatctgctaggatggcagaaaggtattagttgagtctgggtcacattatatagctgcagttttggccttgtaaggtgttgtatccgctgaattgtgtccctgtgctatgcattgtnctgaatgaagaacaacttgnaantgccgaaagatctggggggaaattcctggggtctgttcccggctttttctgggaaaatgcggtctgaaacatgtaaaagtttgcttcaacacatttttaattgccaaacctattggggaaaaaaaaaaaaaaagttttccatcctcccacctcaggggggcccgggaccaatttcctttaaagggcgttaaacccgcgcccaggggccctt

SEQ ID NO: 44291 - DNA, 688 bp, Zea mays
  misc_feature: Ceres CLONE 1446261-F
  misc_feature: Encodes the peptide sequence at SEQ ID NO. 44292
aagctggagctccccgcggtggcggccgctctatactagtggatcccccgggctgcaggaattcgcacgagaccattaactagaacatcctaatcgaaaagatccgacggccgtcgcccccgctcccgacgcatcgtagccgcccagcagccgagaaggaggacggaaggccaccgcgcatttttacgagtcgtcgcacgccccgcgccccgcgcgcggggtgtcgggcaaggtgcccccacgcgcggcggttggcgccgccgtcgtccaccgccgcccgcgtgcgcccaccgccacctgttaccgcctaaggggaacgcctccgttataacccacggcaccatccatgccgtcctccaccaccgcttcaccatccccgccaggcccaccaccaccatggcctctccttcccccgcccgcgcctccgtccggcgcgtgccgcccccgtgctggacgaccgacgagaccctcgcgctcgcgcgggcctacaccgcgcgccgcctcgccgtcggccgtgagcacctgacctccgctgactgggccgccgtcgccgcggccgctccgtccaagacggccaggcagtgccgccacaaggtcgagaagctccgccgacgcctccggtccaaccgccgccgcccgtgcccgctcctcgacgccatcgacctcctcgacgtcccttccccgccct

SEQ ID NO: 44292 - protein, 97 aa, Zea mays
  misc_feature: Ceres CLONE 1446261-F
MASPSPARASVRRVPPPCWTTDETLALARAYTARRLAVGREHLTSADWAAVAAAAPSKTARQCRHKVEKLRRRLRSNRRRPCPLLDAIDLLDVPSPP

SEQ ID NO: 44293 - DNA, 743 bp, Zea mays
  misc_feature: Ceres CLONE 1446265-F
  misc_feature (1)..(1): n is a, c, t, g, unknown, or other
naaaactggagctccccgcggtggcggccgctctataactagtggatcccccgggctgcaggaattcgcacgagaccattacctagaacatcctaatcgaaaacccgcatcccaccaacttccattccctaacgacagcccaccccagtccactccgctcctcccactcgagccatcatggccctcgcctcccgcgccgccgcagccgccgtggcgtgcgtccacctggcgctcgcacgcctccgccgcgggggcgggctccaactcccctgcaccggcgccgtcagtggactgtatctcccaggccgccagcctgatcgactgcatcaactacgaccagaacggaagcagcgcgcgacgtccgtccgctgttctgctgcggcgaggtcaagaccgcaatggccagtttcttcacccccccctgcctctgctccctcggcggctccaactccagtaacctgggctttcccatcgacatgaagcagcgtgctggcgctccccggcgcgtgcggcacgaccaacgccgccttcagcaagtgcaacatttccgcgctttccccaaccgaagcacctgctacgtccgccgccggggggtcatcaagcggtggcgcggcggcatcttcaccgcgcaccgcgacggctatctctcctccgatgacggcgaccaccctgttggctgccgtggaggctaccctgctcgcctactactgctgctacctcttctgaaggtttccatctgctgg

SEQ ID NO: 44294 - DNA, 706 bp, Zea mays
  misc_feature: Ceres CLONE 1446268-F
  misc_feature: Encodes the peptide sequence at SEQ ID NO. 44295
  misc_feature (514)..(514): n is a, c, t, g, unknown, or other
  misc_feature (527)..(527): n is a, c, t, g, unknown, or other
  misc_feature (603)..(603): n is a, c, t, g, unknown, or other
  misc_feature (622)..(622): n is a, c, t, g, unknown, or other
  misc_feature (640)..(640): n is a, c, t, g, unknown, or other
  misc_feature (706)..(706): n is a, c, t, g, unknown, or other
ggagctccccgcggtggcggccgctctagaactagtggatcccccgggctgcaggaattcgcacgagaccattacctagaacatcctaatcgaaaactaaaaaatcaattttctctcgccgcgatcgcgagactgcgagagccttccgcccttccccttccccggccctgccgcgctgttcggcccgtcctcctcggtccttccatccactcacgcgaagcttccagcagaggcgaccgccgcatcgagtctcggctgccgaggagtcgagtcatggaagtggtggcgtcggcgccggggaaggtgctcatcgcgggaggatacctcgtgctggagcgccccaacgccggcctagttctcagcaccaccgcccgcttctacgccgtcgtccgccctctccgcgacagcctcccagccgactcctggacctgggcatggacggacgtcaaagtgacttcccctcaactctcgcgggtggccacatataaattgtccctaaataaaacgacgctgncattgacgtcttncagggaatcgacaaacccttttgtggagcaggccatacaattctccgtagcagctgctaaagcgaccattattgantaggagaggaaggatgtantagataagttactgctgncaggtctgaacattacaattattggtcacaatgatttctattcttatagaaagcagattgaagccn

SEQ ID NO: 44295 - protein, 109 aa, Zea mays
  misc_feature: Ceres CLONE 1446268-F
  misc_feature: SWISSPROT Homolog: EC 2.7.4.2 Phosphomevalonate kinase
  misc_feature (81)..(81): Xaa is any aa, unknown, or other
  misc_feature (85)..(85): Xaa is any aa, unknown, or other
MEVVASAPGKVLIAGGYLVLERPNAGLVLSTTARFYAVVRPLRDSLPADSWTWAWTDVKVTSPQLSRVATYKLSLNKTTLXLTSXRESTNPFVEQAIQFSVAAAKATII

SEQ ID NO: 44296 - DNA, 777 bp, Zea mays
  misc_feature: Ceres CLONE 1446273-F
  misc_feature: Translation starting site: 216
  misc_feature (286)..(286): n is a, c, t, g, unknown, or other
  misc_feature (587)..(587): n is a, c, t, g, unknown, or other
  misc_feature (588)..(588): n is a, c, t, g, unknown, or other
tggagctccccgcggtggcggccgctctagaactagtggatcccccgggctgcaggaattcgcaagagaccattacctagaacatcctaatcgaaaaccgttctccactgaactcctcgccctcgtcgacccgtgacccgtgagcctcttccactgccgccgtcgacgagagctgcgttagccgctagggacaggtgatttcggctgcttccctcatggcgaccgcgctcaagtcgttcttgaacagccccgttggcccccagacacccacttctggggccctggntgccactggggcttcgtcgtcgcgggcttggtgacatgaaacagccttctgaaatgatttcggccaacatgacagcaaccatgtgcgtggaattctggactgttcttgaagtttgcatggaatgtaacccccccgaaatttttggttttaagagggcaggggtttcaagaaagagggtccactctaacaattgttccccgggggtaggggcccggggggccccggaaaaaaaaaacccccaaacccccccccaaaaggggggggcccccccgggggggttttttttttttttcccaccccnntccgcgaaaaaaatttttattttaagcggcgcaaaaaaatgcgttgggtttattttttttggggggggtgtttttaacagggggagagaggagggcccccccccccccccccggggggggggggggtttttttttttttcatcccccccgcccccccccctttgttaaaaaaaaacacagctctttttc

SEQ ID NO: 44297 - DNA, 691 bp, Zea mays
  misc_feature: Ceres CLONE 1446276-F
  misc_feature: Encodes the peptide sequence at SEQ ID NO. 44298
aaagctggagctccccgcggtggcggccgctctagaactagtggatcccccgggctgcaggaattcgcacgagaccattacctagaacatcctaatcgaaaaatgagagtccggcccattgtagcgctgtcagcctgtcactgagactacctgtgtccggacgcccggtctagcaactagcaagcgccgcatccctcgcctcttcccgacttgccccctcgattcgatccgagcttacttctagggttcttggccccgctccaccgtcgcccatggcagacgatgccaactgagcggccttcatggagctgcagtcctggatgatagataccaccgcgaagaatcagcaggtacaaacccaaatgcgttctaaaaaagggaaaagaaagcgtgctactttacttggaaggaacttccccggtggccgatgaatccaaccttacaaaattgccgaaaaggttattttgaacccaagtccgttgggttcatgggccgggccaaactttgggacggggagaggggaattttttggggaaattccaaaaaattctttttaaaacaccggggggaagggggaaaaatattttggggggtgttttaaaagaccccaaaattggggggaaaaaccctttaagggggcttaagaagaaagggtttttccccccccttttttttttaaaaaatttggggg

SEQ ID NO: 44298 - protein, 42 aa, Zea mays
  misc_feature: Ceres CLONE 1446276-F
MELQSWMIDTTAKNQQVQTQMRSKKGKRKRATLLGRNFPGGR

SEQ ID NO: 44299 - DNA, 633 bp, Zea mays
  misc_feature: Ceres CLONE 1446283-F
  misc_feature: Encodes the peptide sequence at SEQ ID NO. 44300
gctctagaactagtggatcccccgggctgcaggaattcgcacgagaccattacctagaacatcctaatcgaaaaatatcctccactaaaattactgacttcgggcaatccctgcaacgccttgggggcctgaccaggttgactaagcttgactgctaaatgaatgcgctggcaggagacgcgcctactggaattggaggcctgacagtgcttgatgtgcttaacctctcataaaatacactgtctggggctctgcccacaacaagagtcccaggagcattacctggaaactcacgaatttgcagtgggaaagggtgctctgagaatgaaacgactcctcaacgcaaaatggaaggtagccatcacctccgctagcattgcgagccgacacggagagaatggatggctatctcttggtacatattgtatcagaacaatgactagctactatgtatcattagcaacattactatgctcctctaatgcaagaaacttcctgtttcgacctgtgagggatgaatattaaccagaggggagattgcataatcaagttgttttgaaattcaagcgactctggacctcagctgattacccataaatatgagcttatgaaatggatatcttcagccaagag

SEQ ID NO: 44300 - protein, 51 aa, Zea mays
  misc_feature: Ceres CLONE 1446283-F
SRTSGSPGLQEFARDHYLEHPNRKISSTKITDFGQSLQRLGGLTRLTKLDC

SEQ ID NO: 44301 - DNA, 746 bp, Zea mays
  misc_feature: Ceres CLONE 1446286-F
  misc_feature (288)..(288): n is a, c, t, g, unknown, or other
  misc_feature (328)..(328): n is a, c, t, g, unknown, or other
  misc_feature (393)..(393): n is a, c, t, g, unknown, or other
  misc_feature (547)..(547): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (630)..(630): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
ggagctccccgcggtggcggccgctctagaactagtggatcccccgggctgcaggaattcgcacgagaccattacctagaacatcctaatcgaaaagcacccctcgtgttcccttttcgtccttgttcctcaacgtcgccggtgcgcccgcctcctgcctctctccccctgcgagcgatcgtgaggggatcgggatggcctcccaccattccgagcccctcgaccccgccgacgctgacgacccctcagataaacacccagaattacatgcccctcctatcatatcgntaccaaacctggtcaactcccagtcgagtttcttgacccntcagctgcccagaaagtgggaatttggatttgactgggaaggggttgattctctgccccaatgtntgctctctggattaaggcacttggcatccccggaggcggttaaccaaattgaggcttttggaggggggaaaaaaaattttccaccttggaacccccccctttggtttggaatttttcccaaggttttttttgtttttaaaggggacgggggttncnnnnnnnttgcgtggaaacggggggcagttttttcaaaaaaggggggaaaaaagcgaaaaattattggaggagaaacccctntttttaagaaaaataaatttcttttaatttaaaagacncnnnnnnannnccaaaaccacaaagggttctcctatcccccggaccagaaagagaaagccgggatggtttagccccca

SEQ ID NO: 44302 - DNA, 897 bp, Zea mays
  misc_feature: Ceres CLONE 1446294-F
  misc_feature: Encodes the peptide sequence at SEQ ID NO. 44303
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (715)..(715): n is a, c, t, g, unknown, or other
ggtacccccccattatcctaaaaaaacaacatccgatatttatcnnnnnccaaactggaactccccgcggtggcggccgctctatatctagtggatcccccgggctgcaggaattcgcacgagaccattacctagaacatcctaatcgaaaatcaacgaatcaccagttgaggttgttaaggaacaagataaagagtttaataaactggcaactgatgccataattccttctatgcctggacatgtggttcaagctttttacattgctggaatcaagcacagaggctcatagtgttgtcgccttccttgcatcagataaaaatgtctggggagcaatattgaaaaatgagaaaggtatggaattttaaaagactcaccataaaaattccggttaagaactttccctgaggaaaaagccaaaaaaatagtccccatgggaaaagtctgaggaatgccccccccctggaaaattggaatgcaacccaccccaacctccccatcggtgctccaaggagacaaggttttcaacaagattttcggttggaacaatggctaagataaaaaaaaagcgaataggaattgggggtccacaaagatttattatcgtaaacttttttccccaggggactcttgctgccaatatgtgacccacgggtcgaaagtgtcccaaggagcgggagtgatcagggtccgattttaaggttgtaagaagagngggtttatatcttgggtactgcttaaaacattggtctttttctacaagaggatgtcctttcggtgggggcggtatgtaccacaaatcaggggtgatatccctaaacgcatgtgtccggtgtattacaaggtggaggcggcacgtgagttgggttgtccagatagcgctctgtgctgcctcca

SEQ ID NO: 44303 - protein, 41 aa, Zea mays
  misc_feature: Ceres CLONE 1446294-F
MWFKLFTLLESSTEAHSVVAFLASDKNVWGAILKNEKGMEF

SEQ ID NO: 44304 - DNA, 660 bp, Zea mays
  misc_feature: Ceres CLONE 1446298-F
  misc_feature: Encodes the peptide sequence at SEQ ID NO. 44305
tggagctccccgcggtggcggccgctctagaactagtggatcccccgggctgcaggaattcgcacgagaccattacctagaacatcctaatcgaaaactgtcgctcgctctccctgtctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcgggaaaaggtacgaagacatatcggttttggggcagaggccagctgaggaatgataaattttggtcaccagtttgcttcggtttgaccgtttcattttggcacagtaataaacgatgtaaacttacgctgctcctatgacctccttctcattcgtttactctgaaaatgcttttgtggggatttcgtggtgcatgattgaaacctgttagggcttgttcggttagctctcaatccacatccatgtggattgagtgggattggatagttttgaatcccaaacaagtcaaacttcttctcaattttttccaatctcatccaatccatatgtattaggaataaccgaacaagcccttatatagaacatgcaa

SEQ ID NO: 44305 - protein, 63 aa, Zea mays; identical to SEQ ID NO: 7503
  misc_feature: Ceres CLONE 1446298-F
  misc_feature (4)..(58): Pfam Name: UCR_UQCRX_QCR9 Pfam Description: Ubiquinol-cytochrome C reductase, UQCRX/QCR9 like

SEQ ID NO: 44306 - DNA, 751 bp, Zea mays
  misc_feature: Ceres CLONE 1446301-F
  misc_feature: Encodes the peptide sequence at SEQ ID NO. 44307
  misc_feature (399)..(399): n is a, c, t, g, unknown, or other
  misc_feature (505)..(505): n is a, c, t, g, unknown, or other
  misc_feature (669)..(669): n is a, c, t, g, unknown, or other
taactggagctccccgcggtggcggccgctctagaactagtggatcccccgggctgcaggaattcgcacgagaccattacctagaacatcctaatcgaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtggatgtttggtgaagcccaccaggggggggggagggcctanaacatgggacttgactgcccccccccctgagggcccccaccaaaataatgacgagcaaacagcctgatcgaatacccgccaacctcgacgggggggggcccggganccccaattcggccctataagtcgaagcggaaataccggcccctcaactggccggggggtgtagaaacggtgtacgacttgggaatgacccccgcgccgcacccacacgtgtaaaccaattgttgtggctaacttccccctccacaccactgccggcgcgttttncgcgaaaacacggccagatcgtcattcggcccccccgcggacctattcccccaacctcgggtcgcacccgcactcagcgcag

SEQ ID NO: 44307 - protein, 87 aa, Zea mays
  misc_feature: Ceres CLONE 1446301-F
  misc_feature (78)..(78): Xaa is any aa, unknown, or other
MSKLQSESVKDAISQIVGDAKEKNRKFTETVELQIGLKNYDPQKDKRFSGSVKLPHIPRPKMKVWMFGEAHQGGGRAXNMGLDCPPP

SEQ ID NO: 44308 - DNA, 688 bp, Zea mays
  misc_feature: Ceres CLONE 1446305-F
  misc_feature: Translation starting site: 212
  misc_feature (1)..(1): n is a, c, t, g, unknown, or other
  misc_feature (248)..(248): n is a, c, t, g, unknown, or other
  misc_feature (250)..(250): n is a, c, t, g, unknown, or other
  misc_feature (272)..(272): n is a, c, t, g, unknown, or other
  misc_feature (314)..(314): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (413)..(413): n is a, c, t, g, unknown, or other
  misc_feature (449)..(449): n is a, c, t, g, unknown, or other
  misc_feature (450)..(450): n is a, c, t, g, unknown, or other
  misc_feature (474)..(474): n is a, c, t, g, unknown, or other
  misc_feature (475)..(475): n is a, c, t, g, unknown, or other
naaggctggagctccccgcggtggcggccgctctagaactagtggatcccccgggctgcaggaattcgcacgagaccattacctagaacatcctaatcgaaaaactctcgtctcctgttcgccagagccaagcccctagtagccacctcgctccagaagctttcctcccctagatgtccctcccgtgcccgggcgcgctgccgacccggccatggcgaccaaggggaagctcggggagctagtgtggnancaccgggtgcaggcggccccancggtggctttcttggtcgcccccgccgggcggggctccaccntcgggtcttgtttcgcgccgaggagtctttcttctggccgttttttttttcccccccccccggggaaaagaaaagggggnnnnnnnnnccnnnnnnncnccccccccctcttttaaaaaaaaataaattcctttnnttatttggggggggtgggtctccnnttccccccccaaaccccctcgtgccgggaggcggccccccccggccgccctaccccccggggaggtttccgccccgatcggcaaattaaacgtgctggccggggggaggacgcgaccctcgtccggctcggcgcgcggtgcggctccgggggtttgtcccgctcccttcccgggggatctctcttcccgcggctcgcggggggggtccggctc

SEQ ID NO: 44309 - DNA, 625 bp, Zea mays
  misc_feature: Ceres CLONE 1446308-F
  misc_feature: Encodes the peptide sequence at SEQ ID NO. 44310
tccccgcggtggcggccgctctagaactagtggatcccccgggctgcaggaattcgcacgagaccattacctagaacatcctaatcgaaaaactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaaccagcgccccaagtgcccctaggccctaccgctctaagggagggaggatgacccaggatttcgcttcgcgatcctgcacagcttctagtcttgtactgcctagtttagcgcgcccaagcgtccgaatggtccgacggttcccttccgtggttggggtcgtgggtttcccctcgggac

SEQ ID NO: 44310 - protein, 96 aa, Zea mays
  misc_feature: Ceres CLONE 1446308-F
  misc_feature (1)..(96): Pfam Name: GASA Pfam Description: Gibberellin regulated protein
MKAIPVALLLLVLVAAASSFKHLAEAADGGAVPDGVCDGKCRSRCSLKKAGRCMGLCMMCCGKCQGCVPSGPYASKDECPCYRDMKSPKNQRPKCP

SEQ ID NO: 44311 - DNA, 864 bp, Zea mays
  misc_feature: Ceres CLONE 1446326-F
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gattctccccccggggggcccctcaccggcatnnnataagagaaannnnctaaaactggagctccccgcggtggcggccgctctagaactagtggatcccccgggctgcaggaattcgcacgagaccattacctagaacatcctaatcgaaaagtttctcatagtcttctcttctgccgtccatccggcctgcgcgctcgctctcctgctctcctgcgccaactgggcgaccgccgacgccgacgccaacgccgacgacctacgccaggtgctgggatttttgtcggttccttccgtccttcggcagctttcggcccgtccttcgccggcgacgagcactcaccaggtccgctcctgaagaagactgggatattttgcatacacagaggatcatctgtgtagaggacattcagttttctccagttccccagttcctggatagcaagtggcaaatgagtttttcctgaaccaccttcctcaaaatctgtttttccccattgctcgggagggtaaaaaatcctacatatcccggcattgcctttggtatgcccgttcaatgggccaatgaaaattccgcacaaggggatgaatttacttttcctggacaaaatgcttttttggctcccaacggcaaagagggcccccagtccaattttggataaaacaaggccgccccttctctgggcggcgaatatttatcaaaaaaagctgtttacctttaaacccttctctccataagaccccccggggaaagatgcgcataaaacctttcacctggagggcccaagggcttttacactttctcgaaggatatatgggggttctgccgacactgggcaataagtggcggcccttcaaagagat

SEQ ID NO: 44312 - DNA, 691 bp, Zea mays
  misc_feature: Ceres CLONE 1446327-F
  misc_feature: Encodes the peptide sequence at SEQ ID NO. 44313
  misc_feature (691)..(691): n is a, c, t, g, unknown, or other
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgacctaggtgctccaccctgcaggccggccggaggaagctagctaattattataagctaaataaagtatagcggcgtcgctgtgtgtgtttcgagtcagccagtcagttagttgcgtgccatggctgggattgttctgagtctgagatgaagataatgcctgaatgcggccgtcggggcctggagccctcccctgccccctcgggcgcttcttggcgccaaaccaaggggttgtgttggagttgggggggcgcacccacgggaaccgggctacccctttcn

SEQ ID NO: 44313 - protein, 82 aa, Zea mays; identical to SEQ ID NO: 43085
  misc_feature: Ceres CLONE 1446327-F
  misc_feature (1)..(80): Pfam Name: Metallothio_2 Pfam Description: Metallothionein

SEQ ID NO: 44314 - DNA, 702 bp, Zea mays
  misc_feature: Ceres CLONE 1446331-F
  misc_feature: Encodes the peptide sequence at SEQ ID NO. 44315
aagctggagctccccgcggtggcggccgctctagaactagtggatcccccgggctgcaggaattcgcacgagaccattacctagaacatcctaatcgaaaacctgcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcaagcagctatggtgttgcatgttggctacttccaaacttatatctggtttgggttgggatgggatgaactaatggctctttgaatttaaaaaaaaaaaaaaaaaagttttccgataccgtcgacctcaaggggggggcccgggaccccaatttccccctatagggaggc

SEQ ID NO: 44315 - protein, 86 aa, Zea mays
  misc_feature: Ceres CLONE 1446331-F
  misc_feature (30)..(84): Pfam Name: Ribosomal_S27e Pfam Description: Ribosomal protein S27
MVLQNDIDLLNPPAELEKLKHKKKRLVQSPNSFFMDVKCQGCFSITTVFSHSQTVVVCPGCQTVLCQPTGGKARLTEGCSFRRKGD

SEQ ID NO: 44316 - DNA, 743 bp, Zea mays
  misc_feature: Ceres CLONE 1446340-F
  misc_feature: Translation starting site: 180
  misc_feature: SWISSPROT Homolog: EC 2.7.11.23 [RNA-polymerase]-subunit kinase
aagctggagctccccgcggtggcggccgctctagaactagtggatcccccgggctgcaggaattcgcacgagaccattacctagaacatcctaatcgaaaagcaccaaatttatatgtacaccatatatgttctctcggtcaaaatagaatacaaatccttttcccaaatcccacacctatggcgatcgtcggcggcggcgggagctggagcatccacggccgcgctgatgtcacatcccgctacgaggtcctcggccgcgcgggctccggttcctatgctgatgtctaccgcggccgccgccgatccgacggtgctgctgtcgcgctcaaggaggtccacgacgctgtcagcgctcgcagcgaggtcgaggctctcctcgccattcccccttcccccaacgttgtcgcactcatcgaccacttccccggcggcgattgcgacgacgacgtcctcgtcctcgagtggctcccgctcgacctcgccgccgttgtgcgtgacgcgagaggcgcgcgggcgggggcgagggaggggaaagcatccccgcctcgcaactcaaacggtggatgctgcaggtgcttgagggggtcgccgcgtgccacccgcgccgcgtcgtgcaccgtgacctgaagcctgagaacctgctcatctccgaagacggggtgctcaaagtcgccgattttggtcagttaacatctctgaaccttaattagcctcaattcgtcggttgaactggtgccttta

SEQ ID NO: 44317 - DNA, 779 bp, Zea mays
  misc_feature: Ceres CLONE 1446341-F
  misc_feature: Encodes the peptide sequence at SEQ ID NO. 44318
  misc_feature (366)..(366): n is a, c, t, g, unknown, or other
  misc_feature (444)..(444): n is a, c, t, g, unknown, or other
  misc_feature (451)..(451): n is a, c, t, g, unknown, or other
  misc_feature (537)..(537): n is a, c, t, g, unknown, or other
  misc_feature (557)..(557): n is a, c, t, g, unknown, or other
aaagctggagctccccgcggtggcggccgctctagaactagtggatcccccgggctgcaggaattcgcacgagaccattacctagaacatcctaatcgaaaaatactacaactcacgctcctactcatttcatgtagcctttacagcatgctgcattcttcttcttcttcttctccttcctcctcctcctcctcctcctcctcggcaccgtcctcgctcgcgttgctggtgctgctggtcgtctccacctgcctctccttgctcttcgccagcctcaaaaggctactcagagacaccaccgcccacagaggagctaacaacagggcgccagctccttccatggaggaagctgcggctgcggctgcngctgtgtttccggagaagaagcgtgtgtcgtcgtcgccactgccacaggacgaaggcgcggaagaattcacgtgggcnggaagcngaaaaagcccgtcagattcctcggagtgggcgaagaacaacgacgacgaagaacaaggccccaaagaaaaaagctccgtttaaaanaaaccgaacccgaaaacganaaaaaaaacaaaaaaaaaacccccttggaaatcccccttggcaagggcccaaatggggcccaaagaaagccccgggtaaaatgtgaataaaaaaaaggaccccccgggaaacttgggggaaatttgctccaagaggaaaaaattctcttacaattttggaaaaaaacgggagaaaaaacacccttttaaaaaacccccccgggaagggccctgggggggccc

SEQ ID NO: 44318 - protein, 177 aa, Zea mays
  misc_feature: Ceres CLONE 1446341-F
  misc_feature (151)..(151): Xaa is any aa, unknown, or other
KAGAPRGGGRSRTSGSPGLQEFARDHYLEHPNRKILQLTLLLISCSLYSMLHSSSSSSPSSSSSSSSSAPSSLALLVLLVVSTCLSLLFASLKRLLRDTTAHRGANNRAPAPSMEEAAAAAAAVFPEKKRVSSSPLPQDEGAEEFTWAGSXKSPSDSSEWAKNNDDEEQGPKEKSSV

SEQ ID NO: 44319 - DNA, 748 bp, Zea mays
  misc_feature: Ceres CLONE 1446343-F
  misc_feature (291)..(291): n is a, c, t, g, unknown, or other
  misc_feature (343)..(343): n is a, c, t, g, unknown, or other
  misc_feature (373)..(373): n is a, c, t, g, unknown, or other
  misc_feature (451)..(451): n is a, c, t, g, unknown, or other
aaagctggagctccccgcggtggcggccgctctagaactagtggatcccccgggctgcaggaattcgcacgagaccattacctagaacatcctaatcgaaaagaaccgaggcggtcaggctccctcctccttcctcctccctgcaaatcctgcaggcaccaccgctcgttttcctgtccgggggacaggagagaaggggagagaccgagagagggtgaggcgcggcgtccgcccgatctgctccgccccccgaagcagcctgtcacgtcgtcctcactctcaggtacccgncatttagccttcctggattgttatggatcactagtgccccccctgccactgntccatagatttgtccgaatggattggtgangaatcgaccggcgttcggttctggggtgctgagcccggcacgggctcgtgccggccgtcgatttcgcagcggcactcnccgtcccgccccccgtcgggtcgggtcggttccttgaaatcccctaaccccctgccgtcgaacttttaacccgacttcccggggggatcccgggccttgcaaaggaatttcggttttgccccaaaaaaccaccttgtcccccccaattttgggtttatttcccgggggggccccaaaaatttttgccccggggaggggccgtgtttttttcccccccccggggagaaccttttttgggaaagggggggccccttttccccccccaaaaagaaaaatttttctcccccccaaaaaaaa

SEQ ID NO: 44320 - DNA, 739 bp, Zea mays
  misc_feature: Ceres CLONE 1446347-F
  misc_feature: Encodes the peptide sequence at SEQ ID NO. 44321
taagctggagctccccgcggtggcggccgctctagaactagtggatcccccgggctgcaggaattcgcacgagaccattacctagaacatcctaatcgaaaagcgctccctctctctggattaggcaaagcatcctcctgtttggatcggcatggagaagacgacgacgacggcgcagccggtctgcgcgcaggagtcgctggctctgctcaactgcgtcgcctcggtcccctacgaccgggataggtgcctcgccctcgtcgacgccctccgtgaatgcatcgtgcgcaagagggtgaagaagttttcgctggcagaaccaagctccaccacaaccaccgaagctctgaagagcgatacgaagccctgagcattctgcaaagaaaactgtatcatctgattgggcgcggttgatgataagtctatgcctgttaatgtagcgttagatttgtacttttgaacccatgccagatgtacttgtgccagatatcaccaatctgttgaactgcaaacgttacccgatgtccacacaaatgatacagtccatgatgccatttccataagaaaggcaccatccatccaggttttctaacattttgctgcgctgttgcttgaccgatggatgttatgctgggcccatgcatgcaactcaaatttgcaaaaaaaaaaaaaaaacttatcataccgtcgacctcgagggggggcccggaccccattcccctaagtggggggattcccc

SEQ ID NO: 44321 - protein, 72 aa, Zea mays
  misc_feature: Ceres CLONE 1446347-F
MEKTTTTAQPVCAQESLALLNCVASVPYDRDRCLALVDALRECIVRKRVKKFSLAEPSSTTTTEALKSDTKP

SEQ ID NO: 44322 - DNA, 764 bp, Zea mays
  misc_feature: Ceres CLONE 1446348-F
  misc_feature: Encodes the peptide sequence at SEQ ID NO. 44323
aagctggagctccccgcggtggcggccgctctagaactagtggatcccccgggctgcaggaattcgcacgagaccattacctagaacatcctaatcgaaaaaaaccctagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcgagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttgatatcggcgtgaaagacattgagggatggactgcaaggctgctcccgtccaggcagttcggatacatcgtcctcacaacttcggcaggcatcatggaccacgaggaggcccgccggaagagcgtaggaggcaaggttctaggtttcttctattgagaagctgagaatctttgttatggcctgcctgcctgtcttactctctcagactagagtacctgttattttactttaatatgtctctctcagactagagcgcctttctttacttgaaatatggtgactgcattggtctttcactttaaaatcgtgactgcattgatcgaaaaaaaaaaaaa

SEQ ID NO: 44323 - protein, 130 aa, Zea mays
  misc_feature: Ceres CLONE 1446348-F
  misc_feature (5)..(130): Pfam Name: Ribosomal_S8 Pfam Description: Ribosomal protein S8
MVRVSVLNDALKSMYNAEKIGERQVMIRPSSKVIIKFLTVMQRHGYIGEFEYVDDHRSGKIVVELNGRLNKCGVISPRFDIGVKDIEGWTARLLPSRQFGYIVLTTSAGIMDHEEARRKSVGGKVLGFFY

SEQ ID NO: 44324 - DNA, 767 bp, Zea mays
  misc_feature: Ceres CLONE 1446354-F
  misc_feature: Encodes the peptide sequence at SEQ ID NO. 44325
  misc_feature (368)..(368): n is a, c, t, g, unknown, or other
aagctggagctccccgcggtggcggccgctctagaactagtggatcccccgggctgcaggaattcgcacgagaccattacctagaacatcctaatcgaaaaaagccccaatacacagcacaggagcatcaacacaacctcagaggagcactactgcgagtcaatcagcgaccagcacagcaaccgaactcaaaagcaagagcccaagatccgagcggtaggagaatccggacatggcggcggcagcgagggcgtcgtggatggtggcaatgagcgtcggcgcggtggaggcgctcaaggaccaggcaggcctctgccgctggaactacgccggcgtggtcggtggaggagtggacgtggaacacgaanagctcctgcgcgaagagcgctgccaggaggagcatggagagcgcccccggcgccggcgcccctgccgcggtcgtcgtcgtcgtccaagtatatgttggagctggtgtaaacgaggagcgaggcgtagatgatggctggctcttggttcgccagccgctcaggccggatggaagcctccggccgaaacggcctcggggagtagggcagccttcgggggggcccgcccgaaccccccccccggccatttggggaaggggtctaagggggcaaccccccggggggcccgggaacctgggttcccgggcaaggaacaaaaaccccccacaaaaaaaaaacacgggtctgggggaagggaaaacaaaaaccctcccgggggttaaagaggggcccccggcgcgg

SEQ ID NO: 44325 - protein, 88 aa, Zea mays
  misc_feature: Ceres CLONE 1446354-F
  misc_feature (46)..(46): Xaa is any aa, unknown, or other
MAAAARASWMVAMSVGAVEALKDQAGLCRWNYAGVVGGGVDVEHEXLLREERCQEEHGERPRRRRPCRGRRRRPSICWSWCKRGARRR

SEQ ID NO: 44326 - DNA, 760 bp, Zea mays
  misc_feature: Ceres CLONE 1446359-F
  misc_feature: Encodes the peptide sequence at SEQ ID NO. 44327
  misc_feature (390)..(390): n is a, c, t, g, unknown, or other
  misc_feature (587)..(587): n is a, c, t, g, unknown, or other
  misc_feature (588)..(588): n is a, c, t, g, unknown, or other
  misc_feature (635)..(635): n is a, c, t, g, unknown, or other
  misc_feature (636)..(636): n is a, c, t, g, unknown, or other
  misc_feature (662)..(662): n is a, c, t, g, unknown, or other
  misc_feature (664)..(664): n is a, c, t, g, unknown, or other
  misc_feature (703)..(703): n is a, c, t, g, unknown, or other
  misc_feature (706)..(706): n is a, c, t, g, unknown, or other
  misc_feature (707)..(707): n is a, c, t, g, unknown, or other
  misc_feature (735)..(735): n is a, c, t, g, unknown, or other
  misc_feature (741)..(741): n is a, c, t, g, unknown, or other
  misc_feature (744)..(744): n is a, c, t, g, unknown, or other
  misc_feature (748)..(748): n is a, c, t, g, unknown, or other
ggagctccccgcggtggcggccgctctagaactagtggatcccccgggctgcaggaattcgcacgagaccattacctagaacatcctaatcaaaaacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggacgtggagggcgacggcgaggtgcangaactcggccggttctccgtcgccgagtacaaccggcagctcctaaaaggtggcggcggcggcggcaggctccagttcggcaaggtggtggcggcgcaccggcacgtggtgtcggggctcaagtactacctccacctcctggccgtggaggagggcggctcctggtaacggcggcaagcgcgtgttccaccccctcnncctcatcaagacctggcacgacatcccaaaccttgatacagatatgnnccggaggcccccaaaaaaactccggngnttaccgccggtgcaaaccgtctaagggcaaaaccccccnggnnctcccccttctcaggaaaacaatgggangccttnaanaaangtcttgggatcg

SEQ ID NO: 44327 - protein, 119 aa, Zea mays
  misc_feature: Ceres CLONE 1446359-F
  misc_feature (64)..(64): Xaa is any aa, unknown, or other
MARALGACVLLAVLLGALAPAAAARAHDDQGSGAGIRQPSGEYRGRKVGARTEVRDVEGDGEVXELGRFSVAEYNRQLLKGGGGGGRLQFGKVVAAHRHVVSGLKYYLHLLAVEEGGSW

SEQ ID NO: 44328 - DNA, 760 bp, Zea mays
  misc_feature: Ceres CLONE 1446361-F
  misc_feature (335)..(335): n is a, c, t, g, unknown, or other
  misc_feature (393)..(393): n is a, c, t, g, unknown, or other
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaagcgactagccgaagcggccgcggcggaacacctcggcgatcggcgtgcgtaccttccacgcgggggtgcgggaccgttgctgcgacgctgcgtcagatcgacgcgcggcgcgtccgccccccaccctctcgccgcctatataactcgcgcccgaatcggcggctccctcctttgccctctccgcgcaccttccacacgctctggaagctgtttcccctttctcgagagtttanaaagctggtgcaaagatggccggggagagctgcttccccaaggcccctgttcggcggngncattcttcacaaccttcccccgaccgtttcagggagtggagcaacttcggggaggtccccgaaaatcggatgaggtcccgttgatccatcccgggaccaaggccctccttttcaggtctatttggcctccaggggcaagggggaaaaaccccgggagccccttttgggttcttgaaaaaaattccccaaaaaaaaaaacccccgggaaaattttgggggggagaaaattttcgtggaccctttaaaggggggttttttttctcccaaaagaaaccccccgcggatggggccaacgcgtttttggccccctgggcgctctcccaaggggggggggggggaaaaaaaaaacaaaattattttttttt

SEQ ID NO: 44329 - DNA, 704 bp, Zea mays
  misc_feature: Ceres CLONE 1446370-F
  misc_feature: Encodes the peptide sequence at SEQ ID NO. 44330
  misc_feature (323)..(323): n is a, c, t, g, unknown, or other
  misc_feature (339)..(339): n is a, c, t, g, unknown, or other
  misc_feature (366)..(366): n is a, c, t, g, unknown, or other
  misc_feature (396)..(396): n is a, c, t, g, unknown, or other
  misc_feature (406)..(406): n is a, c, t, g, unknown, or other
  misc_feature (409)..(409): n is a, c, t, g, unknown, or other
  misc_feature (422)..(422): n is a, c, t, g, unknown, or other
  misc_feature (459)..(459): n is a, c, t, g, unknown, or other
  misc_feature (499)..(499): n is a, c, t, g, unknown, or other
  misc_feature (563)..(563): n is a, c, t, g, unknown, or other
  misc_feature (564)..(564): n is a, c, t, g, unknown, or other
tggagctccccgcggtggcggccgctctatactagtggatcccccgggctgcaggaattcgcacgagaccattacctagaacatcctaatcgaaaaaacatcgcaggcagagctatcccccaacacgatgctgatccgcccattcacgagatccttctcactggagcccggtcggctcgtttcactagttgacagcgacgggaaggaggttggcaggggcaagatattccaagcgccagggaagagcccagccccagtggagagccgcatctgcacggttgatgtcaccgagctcaggaccgagaagtggagggagctcccancacccttctgaggcantctgggaggacctttccaccagctcangcgaggaatggtggaaatcatgagggtctncttgggactnccngcaggctggtttngccttgtagtgtagcaaggcaaaaacttttttccccnccgggttgctgtatacccgcggggcacagggagcagaggnagcctttggttagggcaagactgatcatggattctggggccctataccctgtaaacctgtggtnnactggtgtgatccatcaactatgtctcagccatgcaggtagagttagttctattttaaaaaaaaaaaaaagctatcataccgtcaactccagggggggccccgtaccatttcccctatagggaggcgattaccccgtccg

SEQ ID NO: 44330 - protein, 68 aa, Zea mays
  misc_feature: Ceres CLONE 1446370-F
  misc_feature (66)..(66): Xaa is any aa, unknown, or other
MLIRPFTRSFSLEPGRLVSLVDSDGKEVGRGKIFQAPGKSPAPVESRICTVDVTELRTEKWRELPXPF

SEQ ID NO: 44331 - DNA, 759 bp, Zea mays
  misc_feature: Ceres CLONE 1446380-F
  misc_feature: Encodes the peptide sequence at SEQ ID NO. 44332
aagctggagctccccgcggtggcggccgctctataactagtggatcccccgggctgcaggaattcgcacgagaccattacctagaacatcctaatcgaaaaacacacactcacagacagaaaactgagtcagagaggtgcagatcaatgcagcggtggtggtgcgccggcggggggctcgcccgctgcgtcctctcgtcctccacctccgccataacatcacatggccggccgctgccggcacccctgatgcccaaatctccctcctttaccgtccctttctccttgtcctgtcacatgcaccactctctccagggattcttccagctggtcatcgcttcttccttccgacctccgtcggggcatcatcaacaagagcaggactacggccacaacgaagagacgcgtcggcccccccacctctcacttaatctcacgtccagaaatccaagatgaaggcccccctcgtccatgaagttcggatttcctaatcctggaaagacggacagggtcctcaagtggaggggccggcaacctcccccaaggacaacctcaaggttaagggaggcaaaacggaaactctccgaaagcttggtttggggggaatttggcctactgcaaggggtattaacgaagcttcaacttttggggggttgctaatttacaacaacttttccggaattttgggcttgggaaacttttttaggtgagttttgaccgcccaaccggtggaaattagcttgtaaagggctggaaactt

SEQ ID NO: 44332 - protein, 102 aa, Zea mays
  misc_feature: Ceres CLONE 1446380-F
MQRWWCAGGGLARCVLSSSTSAITSHGRPLPAPLMPKSPSFTVPFSLSCHMHHSLQGFFQLVIASSFRPPSGHHQQEQDYGHNEETRRPPHLSLNLTSRNPR

SEQ ID NO: 44333 - DNA, 791 bp, Zea mays
  misc_feature: Ceres CLONE 1446385-F
  misc_feature: Encodes the peptide sequence at SEQ ID NO. 44334
aaagctggagctccccgcggtggcggccgctctagaactagtggatcccccgggctgcaggaattcgcacgagaccattacctagaacatcctaatcgaaaagaatccgcgccgtgccacccgagtccaggccggcaggcccccagggtgcgagggcggcaccggcgcaggcgaaccgcagtccgcgcctccgcactccgccccatccgaagctccgagcagagcaggagcagcaaagcaagcgagcgtcagactggctgaatcgagaggtggaggcagcaaccaacaaggtagcactatgaaggtcaagattcttcagtggcatgcagtggctttctggacgtgggatgcacaggatgagacatgtggcatatgcaggatggcttttgatggctgctgtcctgactgtaactccctggtgatgattgcccatcctttgggggtgctgcaaccatgcttacaactccactgaaacggaaaggggccaattccaaaaatcccaacccttttccccattggccaaaaaaggggcctttttaggggtaagggccttgggactctaaaacgccccgggggccctctttttccaaaaaaaaagtggtttctgggggcccccgggggctttttttaaaccccacaaaagttttccccgcctttaaaaaaacccgggcggcccccccccccccttgtcctccccccccgtggggaaaaaaaaaaaatattttttttttgggggggccttcctccaaaaaaaaaaaaaaaaaaatttttcccccccccaacgggggggg

SEQ ID NO: 44334 - protein, 57 aa, Zea mays
  misc_feature: Ceres CLONE 1446385-F
MKVKILQWHAVAFWTWDAQDETCGICRMAFDGCCPDCNSLVMIAHPLGVLQPCLQLH

SEQ ID NO: 44335 - DNA, 731 bp, Zea mays
  misc_feature: Ceres CLONE 1446386-F
  misc_feature: Encodes the peptide sequence at SEQ ID NO. 44336
  misc_feature (314)..(314): n is a, c, t, g, unknown, or other
  misc_feature (413)..(413): n is a, c, t, g, unknown, or other
  misc_feature (433)..(433): n is a, c, t, g, unknown, or other
ctggagctccccgcggtggcggccgctctagaactagtggatcccccgggctgcaggaattcgcacgagaccattacctagaacatcctaatcgaaaaatcccaaatctcaacccaagaacaaaaatggccaccgccaccactgaagccgaagtccgtgagtccctcggcacgaagttcggtcgcctcaaggaacaggcgaaagacatggcctccaggcaccccgtcgctggagccgcggccgtcatcgctgtcagcgccgtgggcgcctacttcttgtggcccgtggcagccccggccgtggccatgatgaangcgcctggatccggcggtgtgctcgtctcccgcgcggcgtttctcgcgaagaaggagctgtactttcagctcttgcgcaccggggacgttgcggcggcnggtcgcccgctttggcgtanctgcccatgcagtagtggtacatgcctgtcgtgaacaagcggcgggccggacttttcagggttgatgttgacccaaggggttataaggactttcctttccttggggttgatccccactcccaggttgggttatccgtgaaaaaccttgtttgcgggctgacccttggagaaaaaaggaacctttttaaaaaaaagcggttagggcccaaaaaaaaaaaaaaaactttttctcccccgcccccggggggggggccgggccccatttcccctaaaggggggttatacccccccccccggg

SEQ ID NO: 44336 - protein, 113 aa, Zea mays
  misc_feature: Ceres CLONE 1446386-F
  misc_feature (63)..(63): Xaa is any aa, unknown, or other
  misc_feature (103)..(103): Xaa is any aa, unknown, or other
MATATTEAEVRESLGTKFGRLKEQAKDMASRHPVAGAAAVIAVSAVGAYFLWPVAAPAVAMMXAPGSGGVLVSRAAFLAKKELYFQLLRTGDVAAAGRPLWRXCPCSSGTCLS

SEQ ID NO: 44337 - DNA, 735 bp, Zea mays
  misc_feature: Ceres CLONE 1446391-F
  misc_feature: Encodes the peptide sequence at SEQ ID NO. 44338
aaagctggagctccccgcggtggcggccgctctagaactagtggatcccccgggctgcaggaattcgcacgagaccattacctagaacatccaatcgaaaaattctttctctctcacgctaaatggatgggcacgctacgccgcattcctcccccgcagccgcttcttcgcccacacgctcgcgcgctcggaatactccgaggagggtgctcgaggagggcgacgatccggccacttcctgctcgcctcgccgccggtcccgcgccccggagccctagagctctccccgcggcgggaccgccagagtcctcgggcgcgtggagaaaatggaggcggcgctggaggcggcgcgcgccaaggacaccaaggagcgtctggccggggtcgagcggctgcacgaggtgcttgacgtcgcgacgcgtcgcgggctgacggcggccgaggtcaccgcgctggtggacccctgcatggatctgacgcgggatgccaacttccgcatcgcccagggcggcctccaggcgctctccgtcgccgctgtcgtcgccggcgaccacttcaagatccacctcaactccctcgtctccgccgctgtcgagcgcctcggcgacagcaagcagcccgtccgcaacgccgcgcgccagctcctcatcacgctcatggaggagatgtacaagcacatgggatcacaatttcatgaagcattgcagcgccataatctgccttcgtacatgctaa

SEQ ID NO: 44338 - protein, 136 aa, Zea mays
  misc_feature: Ceres CLONE 1446391-F
MEAALEAARAKDTKERLAGVERLHEVLDVATRRGLTAAEVTALVDPCMDLTRDANFRIAQGGLQALSVAAVVAGDHFKIHLNSLVSAAVERLGDSKQPVRNAARQLLITLMEEMYKHMGSQFHEALQRHNLPSYML

SEQ ID NO: 44339 - DNA, 726 bp, Zea mays
  misc_feature: Ceres CLONE 1446396-F
  misc_feature: Encodes the peptide sequence at SEQ ID NO. 44340
  misc_feature (301)..(301): n is a, c, t, g, unknown, or other
  misc_feature (330)..(330): n is a, c, t, g, unknown, or other
  misc_feature (359)..(359): n is a, c, t, g, unknown, or other
  misc_feature (371)..(371): n is a, c, t, g, unknown, or other
  misc_feature (401)..(401): n is a, c, t, g, unknown, or other
  misc_feature (407)..(407): n is a, c, t, g, unknown, or other
  misc_feature (408)..(408): n is a, c, t, g, unknown, or other
  misc_feature (414)..(414): n is a, c, t, g, unknown, or other
  misc_feature (435)..(435): n is a, c, t, g, unknown, or other
tggagctccccgcggtggcggccgctctagaactagtggatcccccgggctgcaggaattcgcacgagaccattacctagaacatcctaatcgaaaagcgtttccgtttactccggctcacgctcaccccgcctgctctctcattctcgacgatggctgggcgaccgccgccgtcctacgccaggtatcccgcgcttcaaggcggcaggcccttcgccggcgaagagcacccatcagattcccgagttgtttatcccagttatcttgcacccgagggctccgtagcatcttattatgcttncagacctgttctacctgttggatcagatngtcttagaaacgatgtaatttctcaaccnagaacgcatggntatgatggtcccagcagagtgaccaatccntgcttnngctggnctgactggactacctgctggnagtaccgccacgggggcctagtgctctggaagacccgtctttgggctggcttgaagggataacctccagtcgggcaacagggggaacctacgcaccaaggttctggggctttggaaaacccgcctttggcgggctaaggggaatattcccgcccggggcttgggacctaaattttaaaaaaaactggagttattgggaaaaatcttccgaggggaaagggcttctttccaagtgtggccccccccccttttccattttgggggccccccaaaagggcccccttttttttgt

SEQ ID NO: 44340 - protein, 114 aa, Zea mays
  misc_feature: Ceres CLONE 1446396-F
  misc_feature (50)..(50): Xaa is any aa, unknown, or other
  misc_feature (60)..(60): Xaa is any aa, unknown, or other
  misc_feature (85)..(85): Xaa is any aa, unknown, or other
  misc_feature (86)..(86): Xaa is any aa, unknown, or other
  misc_feature (88)..(88): Xaa is any aa, unknown, or other
  misc_feature (95)..(95): Xaa is any aa, unknown, or other
MAGRPPPSYARYPALQGGRPFAGEEHPSDSRVVYPSYLAPEGSVASYYAXRPVLPVGSDXLRNDVISQPRTHGYDGPSRVTNPCXXWXDWTTCWXYRHGGLVLWKTRLWAGLKG

SEQ ID NO: 44341 - DNA, 696 bp, Zea mays
  misc_feature: Ceres CLONE 1446398-F
  misc_feature: Encodes the peptide sequence at SEQ ID NO. 44342
  misc_feature (500)..(500): n is a, c, t, g, unknown, or other
  misc_feature (507)..(507): n is a, c, t, g, unknown, or other
  misc_feature (508)..(508): n is a, c, t, g, unknown, or other
  misc_feature (539)..(539): n is a, c, t, g, unknown, or other
acccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggacgatgatgaccttgatctttttggtgatgaaactgangaggacnnagaagcagctatgagcgtgcccgcgctgccnaggcctcttctaaaaagaaagaagtggtaaatcctccgtccttatggatgtcaaccatgggacgatgaaactggatttgaaaaacttgaggaggttgtccccattgtcaaaaggaagtcttgacttggggaacctcaaagcttggcccggttgaaac

SEQ ID NO: 44342 - protein, 128 aa, Zea mays
  misc_feature: Ceres CLONE 1446398-F
  misc_feature (106)..(106): Xaa is any aa, unknown, or other
  misc_feature (109)..(109): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPAAAAPADEAEDDDDLDLFGDETXEDXEAAMSVPALPRPLLKRKKW

SEQ ID NO: 44343 - DNA, 691 bp, Zea mays
  misc_feature: Ceres CLONE 1446399-F
  misc_feature: Encodes the peptide sequence at SEQ ID NO. 44344
  misc_feature (402)..(402): n is a, c, t, g, unknown, or other
  misc_feature (549)..(549): n is a, c, t, g, unknown, or other
cgcggtggcggccgctctataactagtggatcccccgggctgcaggaattcgcacgagaccattacctagaacatcctaatcgaaaaatatcagctgcgagctagtatacatcgatcggaccgaccgcaggagtagcaagtcgggctagctcactcgctcgctcgcaatggcttccatcatcgtgcatgcggtgatcatcctcctggacatcatcgccttcggcctgagcgtcaccgccgagcagagccgtagctgggtgaccatcacctcggacgccaccaaggagtagtattactgcgtctaccactcagacatcgccacgagctacggagtccgcgcgctggtcatcatcgccgccccgcaggtcgtgctcatgcacgccaggcgatgcttcccccgcngcctcggcctcaagcagggaggctcccgcgcctgcctcctcatcatcatcctcatcacataggtgaccttcctcatctcggaggcgtgcctgctggcgggatcagtacgcaacgcataccacacccggtacaggggcgtattctacngagagtcactctcatgcaacatcgtgcgtaaaggcgtcttccctgctgacgagggatttagcttcttcacagccgtctagggcgagtgaactaccctcactactctaaatcctaaatgcccctggtggtgctggctgcagaa

SEQ ID NO: 44344 - protein, 40 aa, Zea mays
  misc_feature: Ceres CLONE 1446399-F
MASIIVHAVIILLDIIAFGLSVTAEQSRSWVTITSDATKE

SEQ ID NO: 44345 - DNA, 704 bp, Zea mays
  misc_feature: Ceres CLONE 1446400-F
  misc_feature: Encodes the peptide sequence at SEQ ID NO. 44346
  misc_feature (504)..(504): n is a, c, t, g, unknown, or other
ctggagctccccgcggtggcggccgctctagaactagtggatcccccgggctgcaggaattcgcacgagaccattacctagaacatcctaatcgaaaaaccgcagccctagcgcgccgccaccttcaccttcgcagccctagccgccgccgccgcctccattgctgctatacccacaaccatgggtcccgtgctgaagcgcccgaccccgggcacagtgcagtgtttcgggcgcaagaagacggccgtggccgtggcctacacgaagccaggccgagggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcatactaccagaagtacgtcgacgaggcggcgaanaaggagatcaaggacatcttcatgcgctacgagcgcaccctcctcgtcgccgacccccgccgctgcgagcccaagaagttcggcggccgcggcgcccgcgccaggttccagaagtcctaccgctgagcgccagcacctgccggaccgctgtcgtggctccgtttagctacgactttacagaactctgataataacatggt

SEQ ID NO: 44346 - protein, 149 aa, Zea mays
  misc_feature: Ceres CLONE 1446400-F
  misc_feature (17)..(149): Pfam Name: Ribosomal_S9 Pfam Description: Ribosomal protein S9/S16
  misc_feature (108)..(108): Xaa is any aa, unknown, or other
MGPVLKRPTPGTVQCFGRKKTAVAVAYTKPGRGMIKVNGVPIELLRPEMLRLKAMEPVLLAGRSRFKDIDMRIRVRGGGKTSQIYAIRQAVAKGLVAYYQKYVDEAAXKEIKDIFMRYERTLLVADPRRCEPKKFGGRGARARFQKSYR

SEQ ID NO: 44347 - DNA, 752 bp, Zea mays
  misc_feature: Ceres CLONE 1446402-F
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
tggagctccccgcggtggcggccgctctatcactagtggatcccccgggctgcaggaattcgcacgagaccattacctagaacatcctaatcgaaaccatcaaaataggacgaagaaaatctaagaaactgaaatccaacaggggaatttccctttcggctgctgcgaaactgcagccaaccaaggagtggaggagtaggagtagcggcagtcaaagcgtggcgggcggacgggcgggcaagctggaacccattggatcggtggtatcaaggaatcggaagaaggacccggctctcacctcctcaccccgcgtcccacgtcggttcccctaatctgcgtccgcggcgtgatatgagacggttctgtaattgctgatcggcgtgatgaattttaggccaataagtcccaccttccctctggctctggctcattgtcccatccaagtttggatggaaacacccttatgggggagggtgagggaaacccaacctcctccccaagggaggccaccggccctttgtaaaggaagaaatctttttaaaaaaaaagtaaaattttggcccaaaaaaaaaaaattttcccccctttataggagctttttcaaaagccctcccctttccacatttgggttgcgcgggggaaaaaaaaaatttttggtaaaaacccccctttcgccccnnnaaaaaggggggggcacaaaaaatggtgggggggaaaaaaaccctccccccccccccccccccggggggaaa

SEQ ID NO: 44348 - DNA, 734 bp, Zea mays
  misc_feature: Ceres CLONE 1446403-F
  misc_feature: Encodes the peptide sequence at SEQ ID NO. 44349
  misc_feature (378)..(378): n is a, c, t, g, unknown, or other
  misc_feature (379)..(379): n is a, c, t, g, unknown, or other
  misc_feature (398)..(398): n is a, c, t, g, unknown, or other
  misc_feature (406)..(406): n is a, c, t, g, unknown, or other
  misc_feature (407)..(407): n is a, c, t, g, unknown, or other
  misc_feature (482)..(482): n is a, c, t, g, unknown, or other
  misc_feature (487)..(487): n is a, c, t, g, unknown, or other
  misc_feature (505)..(505): n is a, c, t, g, unknown, or other
acccgcggtggcggccgctctagaactagtggatcccccgggctgcaggaattcgcacgagaccattacctagaacatcctaatcgaaaaagaaccctcgatttccctttttttcccccttgcccaggaccaggagcaagatccatccatccatctccgattccccaaccctaagcagcagccatggccgcgccgccgcccacgggctgcttcaagtgtggccgccccggccactggtcccgcgactgcccctcctccgcctccaccaaccctcctgccgccgccgacgcgcccaccaaccctagccacccctccggcgccgcctcccgcttcaacgcaagcccaggctccctcgcgcggcggtggatgggcgagacnngcaggggaagaagaagaanggagaggnncacgcgccccaagctcacgccggaactgcttctctccgacggcggcatcggctttcgtgctccgctacttccccnaagcngtttagcccccgggccgncccagggcaacgaggtggacgacctcgccaaacctcataaaggtttaagcgggactggcaatcccgcctggatcccctaataattcctttgaaaaagtttggggcaaaaaccaaaaaaattggggggcggggacccgcctctcggaaaatggtgttcccaaaatccggggaaaggggcccccaaagggggggatacctatttttttgtgggaaaacccgcggttccaaa

SEQ ID NO: 44349 - protein, 133 aa, Zea mays
  misc_feature: Ceres CLONE 1446403-F
  misc_feature (7)..(24): Pfam Name: zf-CCHC Pfam Description: Zinc knuckle
  misc_feature (66)..(66): Xaa is any aa, unknown, or other
  misc_feature (72)..(72): Xaa is any aa, unknown, or other
  misc_feature (75)..(75): Xaa is any aa, unknown, or other
  misc_feature (100)..(100): Xaa is any aa, unknown, or other
  misc_feature (102)..(102): Xaa is any aa, unknown, or other
  misc_feature (108)..(108): Xaa is any aa, unknown, or other
MAAPPPTGCFKCGRPGHWSRDCPSSASTNPPAAADAPTNPSHPSGAASRFNASPGSLARRWMGETXRGRRRXERXTRPKLTPELLLSDGGIGFRAPLLPXSXLAPGPXQGNEVDDLAKPHKGLSGTGNPAWIP

SEQ ID NO: 44350 - DNA, 729 bp, Zea mays
  misc_feature: Ceres CLONE 1446407-F
  misc_feature: Encodes the peptide sequence at SEQ ID NO. 44351
  misc_feature (515)..(515): n is a, c, t, g, unknown, or other
  misc_feature (542)..(542): n is a, c, t, g, unknown, or other
  misc_feature (543)..(543): n is a, c, t, g, unknown, or other
  misc_feature (547)..(547): n is a, c, t, g, unknown, or other
  misc_feature (550)..(550): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (562)..(562): n is a, c, t, g, unknown, or other
  misc_feature (564)..(564): n is a, c, t, g, unknown, or other
  misc_feature (565)..(565): n is a, c, t, g, unknown, or other
gggagctccccgcggtggcggccgctctagaactagtggatcccccgggctgcaggaattcgcacgagaccattacctagaacatcctaatcaaaaaatcgtcagcctgcctcgcgtctcgtcgaccatccaaatccactcccttctctagtccaaggagctcaggaggtcgaggaagaaggaatggcgccgtcgtaccggccctaccacgtcgccggcgaggatcagcagcgtaaggtgaaggcgggtgggaagtggttggccgcgtggagcgtgctgggtgttggcggcgacccggcggagatgaagcggcggaggcgggtggccagctacaaggcgtacgcggtggaaggcaaggtgaaggcgtccatccgccggggcatccgatgggtcaaggtccagtgcgaccgcatcgcccgcatttcacactagctagtaaagcagagctgagctgagcatgtcgtcggttcttttccttgtgcgcttgcattgcattgcattggggttttacttgntcaggatccatttccatttaccagctnnctgntgntgntnngtgtgntnngtgccactgtatgggcatgatcccatctgaaaaaaaaaaaaaaaaagcttatcgaatccgtcaacctcgagggggggcccgggacccaattccccctaaaggggggcgaattccccggttcccgggcccgcttttttaaaccgcggggcggggaaaaccctggg

SEQ ID NO: 44351 - protein, 82 aa, Zea mays
  misc_feature: Ceres CLONE 1446407-F
MAPSYRPYHVAGEDQQRKVKAGGKWLAAWSVLGVGGDPAEMKRRRRVASYKAYAVEGKVKASIRRGIRWVKVQCDRIARISH

SEQ ID NO: 44352 - DNA, 711 bp, Zea mays
  misc_feature: Ceres CLONE 1446411-F
  misc_feature: Encodes the peptide sequence at SEQ ID NO. 44353
  misc_feature (670)..(670): n is a, c, t, g, unknown, or other
  misc_feature (677)..(677): n is a, c, t, g, unknown, or other
tggagctccccgcggtggcggccgctctagaactagtggatcccccgggctgcaggaattcgcacgagaccattacctagaacatcctaatcgaaaactctagcttcccactccgctcggccaccagctttgaccgcctcccctcccctccgctccgctcctgttcctccataccccactcccccgcaggagcggcgcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtggtggtggatcccatgctgatccatttgacattttctcatcattctttggaccctcttttggaggaggtggtggaagcagcaggggaagaaggcaaaggaggggagaagatgtagtccactcacttaaagtttctctggaagatcttttacatggaatctcaaagaagctctctctttcgcgcaatgtcatctgctccnagtgcangggcaagggctcgaagtctggtgctttcatgagg

SEQ ID NO: 44353 - protein, 163 aa, Zea mays
  misc_feature: Ceres CLONE 1446411-F
  misc_feature (13)..(71): Pfam Name: DnaJ Pfam Description: DnaJ domain
  misc_feature (150)..(150): Xaa is any aa, unknown, or other
  misc_feature (152)..(152): Xaa is any aa, unknown, or other
MFGRAPKKSDNTKYYEILGVPKSASQDDLKKAYRKAAIKNHPDKGGDPEKFKELAQAYEVLSDPEKREIYDQYGEDALKEGMGGGGSHADPFDIFSSFFGPSFGGGGGSSRGRRQRRGEDVVHSLKVSLEDLLHGISKKLSLSRNVICSXCXGKGSKSGAFMR

SEQ ID NO: 44354 - DNA, 735 bp, Zea mays
  misc_feature: Ceres CLONE 1446414-F
  misc_feature: Encodes the peptide sequence at SEQ ID NO. 44355
  misc_feature (170)..(170): n is a, c, t, g, unknown, or other
  misc_feature (719)..(719): n is a, c, t, g, unknown, or other
acccgcggtggcggccgctctataactagtggatcccccgggctgcaggaattctcacgagaccattacctagaacatcctaatcgaaaaaagctacgtgaagaagatggttgggctcctccgtccactctccgccgccgccaccttactcctcgcccccgccgaggcantcactggttcctcagtctccgctagttccgtcggcgggaggcggtggagaaacttgagggcggacctccgccggcgctggctatccgggttgatgtccggcatgggcggcgggggcgatcccatcattatcctccactcttttttaacacaaaagtcgctcaaagtcgtgcgggcctttttttttttccctaagagggggagaagaaagggcactcccaacaataaaaccttccccccccactcgtctgatatacaaaatccaaagttaataatgtggtgccctcgccttacccctcggccctaggggcttcccccgccgttattacagatccctcattaccaattttatgctatgtatcaacgacccctttatgtttaaaaccgctcattgagcttatcgttcccccgatttgttattctccggttcttttcctcaccgtcttcctatcatttacacgaggaaccaacttagccaaaaagatcccactcacataacaatccccgctccatttccattacaggcaactattaagacttctaccataggncgttctttagagtccc

SEQ ID NO: 44355 - protein, 122 aa, Zea mays
  misc_feature: Ceres CLONE 1446414-F
  misc_feature (22)..(22): Xaa is any aa, unknown, or other
MVGLLRPLSAAATLLLAPAEAXTGSSVSASSVGGRRWRNLRADLRRRWLSGLMSGMGGGGDPIIILHSFLTQKSLKVVRAFFFFPKRGRRKGTPNNKTFPPHSSDIQNPKLIMWCPRLTPRP

SEQ ID NO: 44356 - DNA, 721 bp, Zea mays
  misc_feature: Ceres CLONE 1446417-F
  misc_feature: Encodes the peptide sequence at SEQ ID NO. 44357
cagagctggagctccccgcggtggcggccgctctagaactagtggatcccccgggctgcaggaattcgcacgagaccattacctagaacatcctaatcgaaaattcgagagagggcaaaaaccggcaaggggagcgaagcggagagtctcgagagcaagggagcgcggtgacgtcatcgttttccaaggtttctcgatcggctgctatggcgaccagggcggcgtcgagattcctgcagcgcaggctcctgtcttccggcggcaaggtcctcatcgagtaggagaaggccgcggagaaagtgtccatcaagaaaatggaacaagagaagctggagaagctcgcacgcaaggtccccagctcaggagagcaaccttcgtcgactacagtctctgcagcaagtgatgtgaacaccccccccccggccaacagagtcagcgtctgcaaacgtgtctaccgacaagaacaggaactacgctgtcctggcaggcacaattgctgctctgaatggcctgggttggtatctattgtcaagcccaataagctctcagaagttttttgacctgcccacggggttaccaatgccgccgctgtgatggctgggctttatttttcaccctggttttcctttctgccgcaacccttcgggaaaataatttttgcaacattcgtctccagttctacaatatactcgattctaaaggatttgttggcctaccccga

SEQ ID NO: 44357 - protein, 81 aa, Zea mays
  misc_feature: Ceres CLONE 1446417-F
MEQEKLEKLARKVPSSGEQPSSTTVSAASDVNTPPPANRVSVCKRVYRQEQELRCPGRHNCCSEWPGLVSIVKPNKLSEVF

SEQ ID NO: 44358 - DNA, 707 bp, Zea mays
  misc_feature: Ceres CLONE 1446418-F
  misc_feature: Encodes the peptide sequence at SEQ ID NO. 44359
  misc_feature (301)..(301): n is a, c, t, g, unknown, or other
aagctggagctccccgcggtggcggccgctctataactagtggatcccccgggctgcaggaattcgcacgagaccattacctagaacatcctaatcgaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgccggccacgcagttctgggatcttgccntccctccctaaccttttctttggggttaacatccccgggggattatttttcggccttttttgccccttcaccccaaaaacaccagggaggggctccctggccgaaaaaaaacccggtgttttgaatcgggggcgggccccttgccccaaaccccacctttgggccgtattagatggctcgagaacaaaggggggtttttggacccttccccccccccggtgtttttttgtccccccccccgctggtaccgcgggagtttaaacccggggcaaaaaaatgttttctccaaaaaaaaaaaaaaaaaaatttttttttcccccccacaccccccgtgggggggggcgggcccccccccccccccccccaaaagaagggagggtataaacccccccccttggggcgtgtt

SEQ ID NO: 44359 - protein, 123 aa, Zea mays
  misc_feature: Ceres CLONE 1446418-F
MSEGTANCVDILIAIILPPLGVFLKYGCRPRSSGILPSLPNLFFGVNIPGGLFFGLFCPFTPKTPGRGSLAEKKPGVLNRGRAPCPKPHLWAVLDGSRTKGGFWTLPPPRCFFVPPPAGTAGV

SEQ ID NO: 44360 - DNA, 748 bp, Zea mays
  misc_feature: Ceres CLONE 1446421-F
  misc_feature: Encodes the peptide sequence at SEQ ID NO. 44361
aaagctggagctcaccgcggtggcggccgctctagaactagtggatcccccgggctgcaggaattcgcacgagaccattacctagaacatcctaatcgaaaagttttttgttagaggtacgccgattcgaaccatccagtctccgtgtccagtcgagtctcagcaaggaagatgtgggggaaaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaaaactctccccacccgcaaaagtatatcactccaccccacatcagtggaagatactggaaggacaacctcaaaggcataaatgaggcaatcgagggaaattacctgaaggggagccgccaagcagtcccttgacggggcgagcttttgcttctcccccggtttgaaggcctgatgtaacggaagaaggttttgggtgcccccattggcgccgggttggcttttggccccttggaccccccttttttttacgggggcccctatgggcaaaagggttgggttttccccccccggcctcaaagaaaatttaaaacgtgcgagacgaaaacagaactttccccccaatattttgggggcccaaaaacctctgt

SEQ ID NO: 44361 - protein, 95 aa, Zea mays
  misc_feature: Ceres CLONE 1446421-F
  misc_feature (1)..(89): Pfam Name: PC4 Pfam Description: Transcriptional Coactivator p15 (PC4)
MWGKGKKRFGGGGSGEPAAKRQAARDDGPSESAEDGTVVAEISKNKKVSVRSWKGRVFVDLREFYFKDGKTLPTRKSISLHPTSVEDTGRTTSKA

SEQ ID NO: 44362 - DNA, 594 bp, Zea mays
  misc_feature: Ceres CLONE 1446427-F
  misc_feature: SWISSPROT Homolog: EC 6.3.2.19 Ubiquitin--protein ligase
agagctggagctccccgcggtggcggccgctctagaactagtggatcccccgggctgcaggaattcgcacgagaccattacctagaacatcctaatcgaaaatcatctgcgtcgtggggctggcctccgtggcccggtgcgcgcgctcccgcgccgcgcccgccgccgccaggagggggctcaggaagaaggcgctcagggcgctgccgagcctcgcgtacgaggacgccgtggcggcccgggccggggacggggcggcggaggtcctggcggagtgcgccatctgcctctcggagttcgcgccacgggaggaggtccgcgtgctgccgcagtgcggccacgccttccacgtcgcctgcatcgacacctggctcgccgcccactcctcctgtccctcgtgccgccgcgtcctcgtcgtcggcgacgccgccagtaagcgcccgccccagcctaagcgctgccgcaagtgcgaagcggccatggaccaaacccttctccgtcgtccgggtccgcccggcgacccgggtacccgggttccggacccttcttacggaaggccccaagcccccgcccgccccccaattttcttaaaat

SEQ ID NO: 44363 - DNA, 697 bp, Zea mays
  misc_feature: Ceres CLONE 1446437-F
  misc_feature: Encodes the peptide sequence at SEQ ID NO. 44364
  misc_feature (214)..(214): n is a, c, t, g, unknown, or other
  misc_feature (216)..(216): n is a, c, t, g, unknown, or other
  misc_feature (222)..(222): n is a, c, t, g, unknown, or other
  misc_feature (223)..(223): n is a, c, t, g, unknown, or other
  misc_feature (228)..(228): n is a, c, t, g, unknown, or other
  misc_feature (232)..(232): n is a, c, t, g, unknown, or other
  misc_feature (266)..(266): n is a, c, t, g, unknown, or other
  misc_feature (285)..(285): n is a, c, t, g, unknown, or other
  misc_feature (287)..(287): n is a, c, t, g, unknown, or other
  misc_feature (288)..(288): n is a, c, t, g, unknown, or other
  misc_feature (296)..(296): n is a, c, t, g, unknown, or other
  misc_feature (299)..(299): n is a, c, t, g, unknown, or other
  misc_feature (394)..(394): n is a, c, t, g, unknown, or other
ggagctccccgcggtggcggccgctctagaactagtggatcccccgggctgcaggaattcgcacgagaccattacctagaacatcctaatcgaaaaaaaacacgcgaatcgtaccggtacgaacactgagcacgcacgcacgcacgcaaactcaaaggagtgtgaccacggaactgaagccatggcggttacagttgagaagggctctatgggngnggaagnnccagnccgnccaggcctgggcttggggaaagcccggccaaaangcgccgggggaggccccgngnnggaaaccnaancggcgagagaaacaaaagacccacaccccacacccacaaaaggaggagggggtgggccacacacccgaggaaaaagacaaccccagacacaggcncccaaggcaacaacaaaccaaccacaggcaaaacaaaccggccgaactggaggggcagcgcaagggggaggggccggcgcggacagagcaccaggaaccaccagccccgagcccccccccgcggggcgatggaacaagaaccggaacacgacaagcacaaaaaaacagcgacttaggatactccgagtgcagtggatgctcgacggatatgggaggcaaaaacccccgcccctcgatgcctttgtattcctccacatgctagggacttttggcctactctttgtacccacaaaattttgtcaa

SEQ ID NO: 44364 - protein, 172 aa, Zea mays
  misc_feature: Ceres CLONE 1446437-F
  misc_feature (12)..(12): Xaa is any aa, unknown, or other
  misc_feature (14)..(14): Xaa is any aa, unknown, or other
  misc_feature (16)..(16): Xaa is any aa, unknown, or other
  misc_feature (29)..(29): Xaa is any aa, unknown, or other
  misc_feature (35)..(35): Xaa is any aa, unknown, or other
  misc_feature (36)..(36): Xaa is any aa, unknown, or other
  misc_feature (39)..(39): Xaa is any aa, unknown, or other
  misc_feature (40)..(40): Xaa is any aa, unknown, or other
MAVTVEKGSMGXEXPXRPGLGLGKARPKXAGGGPXXETXXARETKDPHPTPTKGGGGGPHTRGKRQPQTQAPKATTNQPQAKQTGRTGGAAQGGGAGADRAPGTTSPEPPPAGRWNKNRNTTSTKKQRLRILRVQWMLDGYGRQKPPPLDAFVFLHMLGTFGLLFVPTKFCQ

SEQ ID NO: 44365 - DNA, 714 bp, Zea mays
  misc_feature: Ceres CLONE 1446450-F
  misc_feature: Encodes the peptide sequence at SEQ ID NO. 44366
  misc_feature (32)..(32): n is a, c, t, g, unknown, or other
  misc_feature (416)..(416): n is a, c, t, g, unknown, or other
cagagctggagctccaccgcggtggcggccgnctctcactagtggatcccccgggctgcaggatatcgcacgagaccattacctagaacatcctaatcgaaaaacgtacacaccacaccagcacccagcctccccaacgatgacggcggcggcggcaccggcggtcgctagcagggtgtgggagtgggaagggaaggtggcgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccaccgccgccgacggcgagccggcgcccgactgggcgcacgagacgctgctggagcacaacnccgagcgccgcttcttccgctacgagatgaacgacaacaacatgggcttcggcctcttcttcgccacgttccgcgtcgtcccggtcgccgccggcgggtgcgagctgcgctgggagttcgagtgcgagcccgtgcgcggcactcccatggacgcgctcgtggcgcgcctgccggccgggctcgacggcatggtggcccgcgtgcgtgacctctttcttccttttcatgcctctcccctgccttggtgcctgtcggttcaccctgttatgatttcctcatccgattcgtcgatgcctcg

SEQ ID NO: 44366 - protein, 191 aa, Zea mays
  misc_feature: Ceres CLONE 1446450-F
  misc_feature (93)..(93): Xaa is any aa, unknown, or other
MTAAAAPAVASRVWEWEGKVASAVAEATADEAWALLSDFLAFHRWHPRVAACRLASGTPRAPGCVRYCEGTATAADGEPAPDWAHETLLEHNXERRFFRYEMNDNNMGFGLFFATFRVVPVAAGGCELRWEFECEPVRGTPMDALVARLPAGLDGMVARVRDLFLPFHASPLPWCLSVHPVMISSSDSSMP

SEQ ID NO: 44367 - DNA, 688 bp, Zea mays
  misc_feature: Ceres CLONE 1446452-F
  misc_feature: Encodes the peptide sequence at SEQ ID NO. 44368
ctggagctccccgcggtggcggccgctctagaactagtggatcccccgggctgcaggaattcgcacgagaccattacctagaacatcctaatcgaaaaggcgtgctcccgagccctgaaccctgtccctgacccgttcacccgtcgcacgccagcagcacacagccagaggagacgtcgcgcctgtgcctaccatggacgagaaggagttctggcgcatgctcgacctcttccccgtcgtccgctcccgtgactattgcgctgatcctggaacatctatcagaggaaccagacagcgatcacgagttcaggaggcagcgaagggcaatgacaaggactcatccgacgcacaagatttgtttatgcacaagttgaagatggctgctgagaaaaagattggaacaacaaaagcagagttcttctgcaaggcatttgaagaaactcatgagaagcttgtttacaaagagctgaatttggatgctgctaacaagtttctgagcgcatatgagagctgatgatgaacagtatgtagatgctgctcaaggatcggcacgtgccaatgatcctagaaagttgttgaagctgtcgagattctgatcattgacaaacttgtgttgtgtgcagacagtagacatccctttttggtcagctacacttcttttttcggagaagcttttgaagttgtccaa

SEQ ID NO: 44368 - protein, 106 aa, Zea mays
  misc_feature: Ceres CLONE 1446452-F
MDEKEFWRMLDLFPVVRSRDYCADPGTSIRGTRQRSRVQEAAKGNDKDSSDAQDLFMHKLKMAAEKKIGTTKAEFFCKAFEETHEKLVYKELNLDAANKFLSAYES

SEQ ID NO: 44369 - DNA, 710 bp, Zea mays
  misc_feature: Ceres CLONE 1446457-F
  misc_feature: Encodes the peptide sequence at SEQ ID NO. 44370
  misc_feature (667)..(667): n is a, c, t, g, unknown, or other
caaagctggagctccccgcggtggcggccgctctagaactagtggatcccccgggctgcaggaattcgcacgagaccattacctagaacatcctaatcgaaaaagacgactccagacgcagcgtcaacctctgcggcgaagatgggaaagatgaaggcagtggcgtgcgtcgcctgctgggcggcattgtcactgatcaatgtcgtgatggccgtcgattacgtcgtcggcaacccggccggcggctgggacgggaggaccgactaccagtcttgggccgcagccgagacttttgctccgggagataccctaagtaagtgtcatcaccaggtttcagctcgtattttgttgccatcagctcgtatgcatagactttgtcggctgtcaatgtcattgtgcgttgcgttgcatctcggggaattctcatcgcgttgactattcctatatgcacatgcaacacgtacgacgtgcgatgcatgcagccttcaagtacaactcataccacagcgtcatggaggtgaccaagagcgccttcgaggcgtgcaccacgaccgacccgatcttgtacgacaacagcggcagcaccaccgtcgcgctcaccatgccggggacgcgctacttcatctgcggcgcgccgggacactgcctgggcggcatgaagatgcangtgcaagtcgccgaacgacctcacccatcacatccagttcgcc

SEQ ID NO: 44370 - protein, 79 aa, Zea mays
  misc_feature: Ceres CLONE 1446457-F
  misc_feature (1)..(62): Pfam Name: Cu_bind_like Pfam Description: Plastocyanin-like domain
  misc_feature (65)..(65): Xaa is any aa, unknown, or other
MHAAFKYNSYHSVMEVTKSAFEACTTTDPILYDNSGSTTVALTMPGTRYFICGAPGHCLGGMKMXVQVAERPHPSHPVR

SEQ ID NO: 44371 - DNA, 705 bp, Zea mays
  misc_feature: Ceres CLONE 1446459-F
  misc_feature: Encodes the peptide sequence at SEQ ID NO. 44372
  misc_feature (370)..(370): n is a, c, t, g, unknown, or other
  misc_feature (659)..(659): n is a, c, t, g, unknown, or other
ctggagctccccgcggtggcggccgctctagaactagtggatcccccgggctgcaggaattcgcacgagaccattacctagaacatcctaatcgaaaaaggagagcactggcttgtatccctctggcctctctcgtctccagcgacggcagcgggcgagggttacgcgaaggcgaagcggagtagtggaagcagaggcggcagccatggcggtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtnggttgcaggtgtcaccggcaagaaaaagtagtaaacttgcattgttttctcatgccaatattgccccacatttttcttccccgtgttttttcttgcgaccagattggaaggctttttccccaagagtgtcttggacttctagatggtatccgcggaaataatcattgtaccctgaatcatattactggccatggtggcgagtattaaaaaatctcgcccctccctaccaaagggttgatagaatggcaaaaaaaaaaaaaaaaagcttatcgataccgtcgaacctcgnaggggggggcccggtacccccattcgccctattagtgagtcgtatt

SEQ ID NO: 44372 - protein, 123 aa, Zea mays
  misc_feature: Ceres CLONE 1446459-F
MAVMEKLKIFVVKEPVVAASCLIAGFGLFLPAVVRPILDSWQTAEQVPPPLLNDVGCRCHRQEKVVNLHCFLMPILPHIFLPRVFSCDQIGRLFPQECLGLLDGIRGNNHCTLNHITGHGGEY

SEQ ID NO: 44373 - DNA, 718 bp, Zea mays
  misc_feature: Ceres CLONE 1446460-F
  misc_feature: Encodes the peptide sequence at SEQ ID NO. 44374
aaagctggagctccccgcggtggcggccgctctagaactagtggatcccccgggctgcaggaattcgcacgagaccattacctagaacatcctaatcgaaaaacattcacatcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgccaccccttcgtggacctcggcgagttcagggcgttccacgcgcgcggcggcggcggcgtggacgacgacgccgagctccgcgctgccttcgacgtctacgacgtcgacggcgacggccgcgtcacggcggccgagctgggcaaggtgctcgcgcgcatcggcgagggcggatgcagcgccgaggagtgcgagcggatggtcgccggcgtcgacgccgactgctgcgtcgggttcgaggacttcaagaagatgatgtgcccccagccgcaagccgaagccggcgccgccgggcgggacaaggcagaggcc

SEQ ID NO: 44374 - protein, 184 aa, Zea mays
  misc_feature: Ceres CLONE 1446460-F
  misc_feature (106)..(134): Pfam Name: efhand Pfam Description: EF hand
  misc_feature (29)..(57): Pfam Name: efhand Pfam Description: EF hand
  misc_feature: SWISSPROT Homolog: EC 2.7.11.1 Non-specific serine/threonine protein kinase
MSNSAASEKQSQQAGHRQRPPAASAADAEMQRVFCRIDADGDGRISASELAAVTRAISPPASSSHGRREVAAMMDELDTDRHPFVDLGEFRAFHARGGGGVDDDAELRAAFDVYDVDGDGRVTAAELGKVLARIGEGGCSAEECERMVAGVDADCCVGFEDFKKMMCPQPQAEAGAAGRDKAEA

SEQ ID NO: 44375 - DNA, 704 bp, Zea mays
  misc_feature: Ceres CLONE 1446461-F
  misc_feature: Encodes the peptide sequence at SEQ ID NO. 44376
aagagctggagctccccgcggtggcggccgctctagaactagtggatcccccgggctgcaggaattcgcacgagaccattacctagaacatcctaatcgaaaagttgcacataaaaattcccacgccccgcacccacccaacgacctccgcgtccgcccccaaaacccccgcaaaccctagccgccgccagcaaggaatggccgccctcctgcggctcgccgccgcgcgatccgccctccccaggcgcgccctcgccccacaccggaggctcgcggcggccgtcgcgatggaggagtggtggtccgactgggagcaggacggcgaggaggaggcgcgcgcctcggcgccggccgccggccttgaccccgccggcggggggcctgggggcgtgcagtgggtcgtcatgggccgccctggcccgcagaagcacgcccacgccgcgcgcctcgccgaggtgctcgccgtgccctacatctccatgggcgcgctcctcaggcaggagctcaaccccgcctcgcaactctacaggaagattgcaaactctgtgaatgaagggaggcttgtgccggaggacatcatatttgggttgctgacgaagcggcttgaggacggatacaacaagggtgaaaatgggttcattcttgatgggattccacgcacccgtatgcaagctgagattcttgacgagattgtggatgttgat

SEQ ID NO: 44376 - protein, 139 aa, Zea mays
  misc_feature: Ceres CLONE 1446461-F
  misc_feature (39)..(139): Pfam Name: ADK Pfam Description: Adenylate kinase
  misc_feature: SWISSPROT Homolog: EC 2.7.4.3 Adenylate kinase
MEEWWSDWEQDGEEEARASAPAAGLDPAGGGPGGVQWVVMGRPGPQKHAHAARLAEVLAVPYISMGALLRQELNPASQLYRKIANSVNEGRLVPEDIIFGLLTKRLEDGYNKGENGFILDGIPRTRMQAEILDEIVDVD

SEQ ID NO: 44377 - DNA, 676 bp, Zea mays
  misc_feature: Ceres CLONE 1446464-F
  misc_feature: Encodes the peptide sequence at SEQ ID NO. 44378
  misc_feature (520)..(520): n is a, c, t, g, unknown, or other
caaagctggagctccccgcggtggcggccgctctagaactagtggatcccccgggctgcaggaattcgcacgagaccattacctagaacatcctaatcgaaaaagtgcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgnactaagcccagaagcagaggcgccgcacctaccgtgctcacggacgcattaacccctacatgtcctccccttgcacattgagctgattctgtcagaaaaagaaaaagcctgtgaagaaagaggctgacaactttgtcccggcaggaaaccatgaaa

SEQ ID NO: 44378 - protein, 120 aa, Zea mays
  misc_feature: Ceres CLONE 1446464-F
  misc_feature (17)..(120): Pfam Name: Ribosomal_L22 Pfam Description: Ribosomal protein L22p/L17e
MVKYSQEPGNPTKSAKAMGRDLRVHFKNTRETAFALRKLPLTKAKRYLEDVIAHKQAIPFRRYCGGVGRTAQAKSRHSNGQGRWPVKSARFILDLLKNAESNADVKGLDVDNLYVSHIQV

SEQ ID NO: 44379 - DNA, 682 bp, Zea mays
  misc_feature: Ceres CLONE 1446471-F
ctccccgcggtggcggccgctctataactagtggatcccccgggctgcaggaattcgcacgagaccattacctagaacatcctaatcgaaaaattcgcgtttgtggagctggcgagaccgtgagggcgaggctgcgcttgcgcgcgagcgagcggcggccgaggggctgtgcggcggcgggcagccggctggggcactcgcgtaggcgcacgtagtactcgcgcagcggctcatgcgcggacggggcttgcttaggaggcgctgctggcgtgctgctgctacgcgctcggggccggcggctcgtcccctcagcagcgcgctggtgctggcttgctgctgctaggcgctggcaggagcgcgagggcgctgggttgctgctcggcgcttagaaattgaagtgacccccgtgaggaacggaggattaacttgctcctttgttgccgacagattaattcagcccggctgctgcaaaggggacccaacaaagggagatgaagctcacaatcgtgtcgcacgaagctgcatgactatgcgcggtatgacctcaatgagatagccttcccgtcgtcactgccggaccctccgtacatctagaagcggacccagctctcatggcatgaacgctggcgcatcctcaatgaggccacccggatgtaccgtgcgtcacgggtccgggacatcc

SEQ ID NO: 44380 - DNA, 636 bp, Zea mays
  misc_feature: Ceres CLONE 1446475-F
  misc_feature: Encodes the peptide sequence at SEQ ID NO. 44381
ctccccgcggtggcggccgctctagaactagtggatcccccgggctgcaggaattcgcgcgagaccattacctagaacatcctaatcgaaaagtacccggacgctcttgggatccattcggtctgcctccgatcgaagaacgccgacccgtttgatggggatatgacttcgaagggagagtaccgagggcgtattttccaagagttggatgaaaaggttcgtgatgcacttcatctttacattgaagcccgcggcataaatgagaagctcttccgttttctccaagcttggctttatgtaaaggatcaccgcaatcttgtacgctggttcaagagcgttggttcattcatcagtgaccaaagccaaagcaagatgtcaagaaccccgcgctgaagatgatcatctgaaaccccctcgtggagcagttttctccaggatggataattgtcctaggataaagtgaattatatgcaaagtcgcgccagcgaggagttttggtttatctttagtttttattcgccggggaatcagtgggtctggtggttgaattagttatcatcagcccttgtgatctgctaccctatcatgctgaggagcttgtcacattcctcattattcaaacttcacattttccct

SEQ ID NO: 44381 - protein, 76 aa, Zea mays
  misc_feature: Ceres CLONE 1446475-F
MTSKGEYRGRIFQELDEKVRDALHLYIEARGINEKLFRFLQAWLYVKDHRNLVRWFKSVGSFISDQSQSKMSRTPR

SEQ ID NO: 44382 - DNA, 656 bp, Zea mays
  misc_feature: Ceres CLONE 1446483-F
  misc_feature: Encodes the peptide sequence at SEQ ID NO. 44383
ctccccgcggtggcggccgctctagaactagtggatcccccgggctgcaggaattcgcacgagaccattacctagaacatcctaatcgaaaaaaaccccctttgttgttgagcggcggggctagccgtttatacctggcaaccactacacgacgagggcaatgaggcgaacggcggcgttgctatcggcccactgcggccgcagcatcccgttggcgctcgccgacgtgctcgtctgcccactctctaagcaacctcttaggtactgcgaggtcaacgggtctttggtcagcgactccgctggggtggcctttccagtacttgatgggattccttctcttgtaccaaaagatggaaagttactcgacgaccaagaagtgaaatcagaacaagagtccagcactagggattcttctggttgaatccttgtctatgcaacatctaattgaagcaatatgttgtagtaaatcgacggtaataaaaccaagtgcttcttgtcggaaatcgtcaccatattgccctagaggatgaggtgcaccgtttctgttgagaaggctaatatggttgtcttgaaagacaacaatgaaattggcaaacatagtttctgctttattttcttttactggaataactattctgttcatatactgcatctga

SEQ ID NO: 44383 - protein, 86 aa, Zea mays
  misc_feature: Ceres CLONE 1446483-F
  misc_feature (17)..(56): Pfam Name: Trm112p Pfam Description: Trm112p-like protein
  misc_feature: SWISSPROT Homolog: EC 2.7.1.130 Tetraacyldisaccharide 4'-kinase
MRRTAALLSAHCGRSIPLALADVLVCPLSKQPLRYCEVNGSLVSDSAGVAFPVLDGIPSLVPKDGKLLDDQEVKSEQESSTRDSSG

SEQ ID NO: 44384 - DNA, 719 bp, Zea mays
  misc_feature: Ceres CLONE 1446484-F
  misc_feature (1)..(1): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
naaatggggtttttttcttacccattcgacacaaaaaaattttnnnnnnnnnnnnnnnccaagctgggactccccgtgggggcggccgctctagaataggggatcccccgggctgcaggatattcgcacgagaccgttacctagaacatcctaatccaaaaatgagttgcccggttccccccggatcgtggtcccctaaccatttcgatctgctcagctacgaaactctgctcctccgtgcttccgtcacgcgagagcactgcactcccaggcaaactcgaacgggtcggtgctcctgcgggccccgacaaagtacatagggtccagccgatatataattcccggaatcctttcctcggagtcttgagatcatgggcctgagtctcgtgcaggatgctacaggatcgaggtgacttggtggtcactggtcgaggacgtggtagtatgaacctacgtagcagaggtgaaggaaaagggcccccccggggtgtgtggagatggattttaaacaggtcgccaacctatgtttggctgggtcaaacgggtaatgcgaccacatcctcgagcaagtgaagaattgagggaaggggtcttgtgattgtcctcgttgtcggggcggagtcacggagtcagaacgaagtatctggctgtttcgtgaattcacgtgatacgccgactggatggatctcttatggctggattacaggggtcgaccgacc

SEQ ID NO: 44385 - DNA, 713 bp, Zea mays
  misc_feature: Ceres CLONE 1446485-F
  misc_feature: Encodes the peptide sequence at SEQ ID NO. 44386
  misc_feature (423)..(423): n is a, c, t, g, unknown, or other
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaagtttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatccaccacacacccnactcanccaagaagttcgagcccaagtacaggcttatcaggaacggtcttgctaccaaggtggagaagtcgcgcaagcagatgaaggagaggaagaacagggcgaagaagatccgcggtgtgaagaagacaaaggcttgggacgccaagaagaaatgagcaaggtttcagtgtactttaaccgtcttgagttcgagtaacacctgttaccccgtcagaaatttatgtaccccatgtcgcaatgcttttgatctagaaaagaagttttttttacctggttacatccaccaa

SEQ ID NO: 44386 - protein, 137 aa, Zea mays
  misc_feature: Ceres CLONE 1446485-F
  misc_feature (28)..(111): Pfam Name: Ribosomal_S24e Pfam Description: Ribosomal protein S24e
  misc_feature (86)..(86): Xaa is any aa, unknown, or other
  misc_feature (88)..(88): Xaa is any aa, unknown, or other
MADTKASPAVTLRTRKFMTNRLLSRKQFVLEVLHPGRANVSKAELKERLAKMYEVKDPNCIFVFKFRTHFGGGKSTGFGLIHHTPXSXKKFEPKYRLIRNGLATKVEKSRKQMKERKNRAKKIRGVKKTKAWDAKKK

SEQ ID NO: 44387 - DNA, 787 bp, Zea mays
  misc_feature: Ceres CLONE 1446486-F
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (415)..(415): n is a, c, t, g, unknown, or other
  misc_feature (787)..(787): n is a, c, t, g, unknown, or other
aaagctgggagctccccgcggtggcggccgctctagaactagtggatcccccggcctgcaggaattcgcacgagaccattacctagaacatcctaatcgaaaacatcaccaccattggcattgatttcaaggttaggacggttgagcttgatggacagcgtgtaaagttacaaatttgggacactgctggtcaacaacgtttccgaaaattcctactgccctatacagaggagccttgggccttccgcttcgcacccaagtcggcgaccaatccgcctttcatttttcccgaactggagcccggcttgcggcgagccttcctcgaccccttttaacaacaccctgacttgacatttatttttatttggacccccaaagggggggggtctccttttttaattnnntattttttctncccaccccccacaaaaaaaaaataaagcatcagatcttgcacggctcccacccgtggagcgaccctttcttttccctactggtgagggaggagtgttctactcctctgggtaggcgtttggttgtgttatcccccacctaccgcaaataacgccctgcgcggccgggtgtcccattctcatatacgcgccccgactgccgcccaaaggtggtcggctcccacaccccctgaaattagccccccacacagccgcgtgtttgcccctctgtcaccccggtctcccccgatatctacccccattgctgctgacgcgtcgcgagcgtgctctctataccccctccagcgagtcgaagtcttcgcgtgttcatcaan

SEQ ID NO: 44388 - DNA, 734 bp, Zea mays
  misc_feature: Ceres CLONE 1446488-F
  misc_feature: Encodes the peptide sequence at SEQ ID NO. 44389
  misc_feature (514)..(514): n is a, c, t, g, unknown, or other
  misc_feature (523)..(523): n is a, c, t, g, unknown, or other
  misc_feature (570)..(570): n is a, c, t, g, unknown, or other
  misc_feature (583)..(583): n is a, c, t, g, unknown, or other
acaagctggagctccccgcggtggcggccgctctagaactagtggatcccccgggctgcaggaattcgcacgagaccattacctagaacatcctaatcgaaaactagccgcctgtctccctgtccggtctccactcgtccgggcgacgagacgacgacggagggtttctgcgggggatttgtttgtcgctgactcgccggcgaccaagatgaggccggttttcgtggggaacctagactatgatacccgccactcggagctcgaccacctcttctaccgctatggcagggtcgagcgcatcgacatgaagtcaggctttgcttttgtctactttgaggatgaacgtgatggcagtgatgccatacgtgctcttgatggttatccatttggccctggcagacgcaggctttcagtagagtggtcacggggtgatcgagctgctagacgtgatggcaacaaaccagaagtaaatactaagccaactaaaacattgtttgtcattaactttgatccnatggacacnagagtcagtgatatcgaaagacactttgcaccatttgggaacatatncagtgttaggatnaggaagaactttgcttttgtccggtttaaccactagaagaagcccgtaaggctcttgacctactcatgctaccatggctttggatagggggatttctgtgggtatgcctttagggtgatgataaacgggatgataggtcccacagcccaaa

SEQ ID NO: 44389 - protein, 136 aa, Zea mays
  misc_feature: Ceres CLONE 1446488-F
  misc_feature (4)..(69): Pfam Name: RRM_1 Pfam Description: RNA recognition motif. (a.k.a. RRM, RBD, or RNP domain)
  misc_feature (121)..(121): Xaa is any aa, unknown, or other
  misc_feature (125)..(125): Xaa is any aa, unknown, or other
MRPVFVGNLDYDTRHSELDHLFYRYGRVERIDMKSGFAFVYFEDERDGSDAIRALDGYPFGPGRRRLSVEWSRGDRAARRDGNKPEVNTKPTKTLFVINFDPMDTRVSDIERHFAPFGNIXSVRXRKNFAFVRFNH

SEQ ID NO: 44390 - DNA, 700 bp, Zea mays
  misc_feature: Ceres CLONE 1446490-F
  misc_feature: Encodes the peptide sequence at SEQ ID NO. 44391
  misc_feature (313)..(313): n is a, c, t, g, unknown, or other
  misc_feature (407)..(407): n is a, c, t, g, unknown, or other
agctccccgcggtggcggccgctctagaactagtggatcccccgggctgcaggaattcgcacgagaccattacctagaacatcctaatcgaaaaacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccnaccgcgttcgcatcttcgtcgacaccgtcgcggaggcaccccacatcggctgagaaatcaatctataaaatgaataacttcgacatgtcatgcntgcatgtccgtcgccaaatatggatgggtgggctccgttccataaattggctagaaaaatatgggcatcccccggttgcttgaattaaatggttccaattggtccccctttccccatgtggaaaataaaaagtggcccccctgttttgggtttccaaaaaaaaaaaaaaaaaatttttttaccccccccccccgggggggggcccccggcccccatcccccccaaggggggggtttaatccccgcccccccgcgggcttttttttaaacccccgtggggggaaaacccccgtt

SEQ ID NO: 44391 - protein, 70 aa, Zea mays
  misc_feature: Ceres CLONE 1446490-F
  misc_feature (11)..(70): Pfam Name: potato_inhibit Pfam Description: Potato inhibitor I family
  misc_feature (54)..(54): Xaa is any aa, unknown, or other
MSSTGGDDGAKKSWPEVVGLSLEEAKRVILCDKPDADIVVLPVGTPVTMDFRPXRVRIFVDTVAEAPHIG

SEQ ID NO: 44392 - DNA, 633 bp, Zea mays
  misc_feature: Ceres CLONE 1446500-F
  misc_feature: Translation starting site: 89
gctctagaactagtggatcccccgggctgcaggaattcgcacgagaccattacctagaacatcctaatcgaaaaaggcctaagcgcccatggatcccaagcccgacgccagcgcgcccgccgcggtgccagcggagcacgcggcgtacccgaggctgtcaccggaggacatcgccccgccgccgccgcctgtcgtgccgccgtcccgcgccaacccctacgtgctctccgccccgtcgcctaacccgcccgcaagagccctaggggagatcttaaggaaaagtttccgcttgtggggaaaaaattcaaccaggccccccccaaaaccaagggattccccggggatttttgccccccctttaaattggcccccccctccttgttctccccccggtaggttccccaaacccccgggcctttctggagggggctccacaaaatttttccccccattttttggccccccctgaaaaaaacccccaagggtttgtgtccccctctccccccgcggggcaacaaggggggtggtttttttcctttcgcaaaaattttcttggcccccccccctcttttttttttttacaaaaacaaacaccccccttttaagaggggtctccccccccccccccagagg

SEQ ID NO: 44393 - DNA, 665 bp, Zea mays
  misc_feature: Ceres CLONE 1446512-F
  misc_feature: Translation starting site: 164
  misc_feature: Pfam Name: RNA_pol_N Pfam Description: RNA polymerases N / 8 kDa subunit
  misc_feature: Pfam Name: Asp_Glu_race Pfam Description: Asp/Glu/Hydantoin racemase
  misc_feature: SWISSPROT Homolog: EC 2.7.7.6 DNA-directed RNA polymerase
aagctggagctccccgcggtggcggccgctctagaactagtggatcccccgggctgcaggaattcgcacgagaccattacctagaacatcctaatcgaaaaaaaaaaacaacctcctccacgaccaaacgatccgggttccagcggcggcagcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagaccgagacaagttaagtgagcaagcatatcatgctctgaaagcactactgtttcgtagtatcatatatattgtaggcggtatgttgtttcttctctatcaggagaggattgttgtgagtgtgaacttgcttttgctctcgagcattcaaggactgacaagggcatgttgcatctatgctacgatgttggagattttaatcgatataacggctaactaataaaaaaaaaaaaaaaaaagcttatcgataccgtcgacctcgagggggggcccggtacccaattcgccctatagtgagtcgta

SEQ ID NO: 44394 - DNA, 699 bp, Zea mays
  misc_feature: Ceres CLONE 1446519-F
  misc_feature: Encodes the peptide sequence at SEQ ID NO. 44395
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (48)..(48): n is a, c, t, g, unknown, or other
  misc_feature (425)..(425): n is a, c, t, g, unknown, or other
  misc_feature (679)..(679): n is a, c, t, g, unknown, or other
  misc_feature (699)..(699): n is a, c, t, g, unknown, or other
nnccccccnnnaaccacctggcactccccgcggtggcggccgctctanaactagtggatcccccgggctgcaggaattcgcacgagaccattacctagaacatcctaatcgaaaaaggatatgttcccatccctctgaccgaccaccctcccaaggtcgagggctcctgtatctttaccgtctccaatcgatcccatctcctcgccatcgccgccgccatggcgttcctagcgcgggctctccgccagtccaattcgcgtctgtcgtcgtgcccctccgtcgccgcgtcctgccgctggatctcccggaccgccgccgcgggatcgccggatgcctgcgcggcggtggcgcccgctgacccggagttgccttcttcccccccccctggtggggggggggggggtggacttcctcccaacccgaangacgcgctcaaggatgataaggatggccccgcggggcgggatccgcaaggggtcaccgtgctacaggcctgcgaagtcgccggcgtcaacatccgccggtttctgctaccatagccgaccctccctccctgggaactgcccatatggccccctttaaagtcgaaaaatccccctaaccccgttgattcttgtggcggtgccccccctgcccgggatgaaaacccccaccaccccgcccgggggccaaaaaagcnaaacgaaggggtccacgcan

SEQ ID NO: 44395 - protein, 106 aa, Zea mays
  misc_feature: Ceres CLONE 1446519-F
  misc_feature (69)..(69): Xaa is any aa, unknown, or other
MAFLARALRQSNSRLSSCPSVAASCRWISRTAAAGSPDACAAVAPADPELPSSPPPGGGGGGGLPPNPXDALKDDKDGPAGRDPQGVTVLQACEVAGVNIRRFLLP

SEQ ID NO: 44396 - DNA, 1586 bp, Zea mays
  misc_feature: Ceres CLONE 1446520
  misc_feature: Encodes the peptide sequence at SEQ ID NO. 44397
agtcgcgtccatggcgatcttggtaggcctcgtcgccgtcctctccgccctcttcgccgccgcgcttcggcgcctcctaatctcttgtcgccaccccgcatacgccgccggtttcttccacccgtacaccaacgacggcggcggaggcgagcgcgtgctctggtgtgcggtgcgcgccgtgcaggagctttgcccggacctcccctgcgctgtctacaccggcgatgccgatgcggcgcccgaggccctcgccgcacgcgctctcgaccggttcggtgtccgtctcctccgcccgccgcaggttgttcacttgaataagagaaagtggatcgaagcaagcacgtatccccacttcacaatgatcgggcaaagtcttggctctgtttatcttgcatgggaagcccttactaaatttaccccgcagttttactttgatacaagtggctatgcttttgcgtatccactagctcggctatttggttgcaaagtcatctgctatactcattaccctacaatcagttctgatatggttgaacgtgttaagcaccgcagttctatgtataataacaattctcttatcgcagggagcatttggctatcccgatgtaaaatcctctactataccatattcagttggttatatggtctggtgggttcatgtgcgcatcttgtaatggttaattcctcatggacaagatcccacattacaaatatttggaagttcccagagcgtactaagagggtgtaccctccatgcgatacttctgctcttcagatgcttcccctggaaagaccaacaacacctcctgttcttatttcagttgcacagttccgcccagaaaaggcccatggccttcagctggaggcatttgcacttgctcttcaaaagctagaccctgactttcctaagccaaagattcaatttgtcggtagttgccggaataaagaggatctggacagactacaaaagcttaaggacaggtccactgaactacacatagatgagcttgtggagttccacaaggatatttcttacagggacctggtacaatttcttgggggtgccattgctgggctccattcgatgacagatgaacatttcggaataagtgttgttgagtatatggcagctggagctattccaattgcacataaatcggcaggaccgatgatggacatcgtgctagatgaggatgggcatcaaacaggatttctagcctccgagaaggaggaattcactgaagcgattatcaaggtcttgaggatgccagagtcggggaggcaagaaatggcagctgcggctaggaaacgtgcacaaagattttcagatcagagattccaccaagatttcactgagaccgtccgccctattttgtcagcaagggaaggctgactgacaagctgcagtttccacctaacaatctgaattctctgtcaagtttcacacggtacagtgaaagacttgcaaggggcactgaattggcagattattgctgctcccttttcccagactgcttgtgtattgtgctgcatcgtgtaacgctactgtgcagaaatagatcacagaaagaaaaaaaaaaaaaaaa

SEQ ID NO: 44397 - protein, 460 aa, Zea mays
  misc_feature: Ceres CLONE 1446520
  misc_feature (252)..(434): Pfam Name: Glycos_transf_1 Pfam Description: Glycosyl transferases group 1
MAILVGLVAVLSALFAAALRRLLISCRHPAYAAGFFHPYTNDGGGGERVLWCAVRAVQELCPDLPCAVYTGDADAAPEALAARALDRFGVRLLRPPQVVHLNKRKWIEASTYPHFTMIGQSLGSVYLAWEALTKFTPQFYFDTSGYAFAYPLARLFGCKVICYTHYPTISSDMVERVKHRSSMYNNNSLIAGSIWLSRCKILYYTIFSWLYGLVGSCAHLVMVNSSWTRSHITNIWKFPERTKRVYPPCDTSALQMLPLERPTTPPVLISVAQFRPEKAHGLQLEAFALALQKLDPDFPKPKIQFVGSCRNKEDLDRLQKLKDRSTELHIDELVEFHKDISYRDLVQFLGGAIAGLHSMTDEHFGISVVEYMAAGAIPIAHKSAGPMMDIVLDEDGHQTGFLASEKEEFTEAIIKVLRMPESGRQEMAAAARKRAQRFSDQRFHQDFTETVRPILSAREG

SEQ ID NO: 44398 - DNA, 666 bp, Zea mays
  misc_feature: Ceres CLONE 1446525-F
  misc_feature: Encodes the peptide sequence at SEQ ID NO. 44399
ctccccgcggtggcggccgctctagaactagtggatcccccgggctgcaggaattcgcacgagaccattacctagaacatcctaatcgaaaaaaaaaaatccatttccctttcttctgaagtcgtcctcttcttcccgtcgcttcgccgtgccgcacctgcgaggagaggagacttcgccgcgaagctcaccatgatctcgccggagaggagctcgtcacagagccagcggtcggcggcggcgggggcgccgttcctgtcgatctccgtcacggatcccgtaaagatgggtaccggcgtgcagtcctacatctcctaccgcgtcatcaccaagaccaacctccctgaatttgagggaccagagaaaattgttattcggcgctatagtgattttgaatggttgcatgatcggcttgctgagaggtacaaaggcatttttataccccctcttccggagaagaatgctgttgagaaattccggtttagcaaggagttcattgaattgcggcgtcaagctctggatttattcgttaacaggatagcttcacaccctgaactcaagcaaagtgatgtcttgaggacatttttgcaagcagatgaagagataatggatagggcaagatcttatgagactggtatttttaagaaaccggcagatttcatatcg

SEQ ID NO: 44399 - protein, 158 aa, Zea mays
  misc_feature: Ceres CLONE 1446525-F
  misc_feature (19)..(135): Pfam Name: PX Pfam Description: PX domain
  misc_feature: SWISSPROT Homolog: EC 2.7.11.1 Non-specific serine/threonine protein kinase
MISPERSSSQSQRSAAAGAPFLSISVTDPVKMGTGVQSYISYRVITKTNLPEFEGPEKIVIRRYSDFEWLHDRLAERYKGIFIPPLPEKNAVEKFRFSKEFIELRRQALDLFVNRIASHPELKQSDVLRTFLQADEEIMDRARSYETGIFKKPADFIS

SEQ ID NO: 44400 - DNA, 691 bp, Zea mays
  misc_feature: Ceres CLONE 1446536-F
  misc_feature: Encodes the peptide sequence at SEQ ID NO. 44401
ggagctccccgcggtggcggccgctctagaactagtggatcccccgggctgcaggaattcgcacgagaccattacctagaacatcctaatcgaaaaatccatgtacccggaccggaccccctcaattcaaatcccccctccgtcatcatctcgtctcgtcatactcctcgccccccacctccaccccctcgtgattatctccccggattccaaatcccatctccgattcactcggccccagagccgccgccgggttcttcgcgcggacgatggcgggggctgccgagggcgccggcgcggaggcggtggagagggcgcacgggctctaccgcggcggccgccaccgggaggcgctggagctctactccgccgcgctggctgcggcgcggggccccgcgcagcgcatcgcgctccacagcaaccgcgccgcctgctacctaaagctccacgacttccacaaggcagcacaagagtgtacatctgtcctcgagttggatacggagcatgctggagctctgatgttacgtgcccagactctcgtcactctgaaggattatcagtcagctctgtttgatgtcaacaggctcgttgagataaacccgtcgtctgaagtgtatcggaacctgcaggcacgattgaagacacagctatcactggccccaattcctgagtgcgaagaggagtccctttg

SEQ ID NO: 44401 - protein, 140 aa, Zea mays
  misc_feature: Ceres CLONE 1446536-F
  misc_feature: SWISSPROT Homolog: EC 5.2.1.8 Peptidylprolyl isomerase
MAGAAEGAGAEAVERAHGLYRGGRHREALELYSAALAAARGPAQRIALHSNRAACYLKLHDFHKAAQECTSVLELDTEHAGALMLRAQTLVTLKDYQSALFDVNRLVEINPSSEVYRNLQARLKTQLSLAPIPECEEESL

SEQ ID NO: 44402 - DNA, 640 bp, Zea mays
  misc_feature: Ceres CLONE 1446537-F
gagctccccgcggtggcggccgctctagaactagtggatcccccgggctgcaggaattcgcacgagaccattacctagaacatcctaatcgaaaagacgagccataacttcaacaagcagcgggcgggtctcgggcggcgcgcgggcgcttggtggacgacgctcaagcggaggcgggcagcgcttgggagtcaggcgtgcgaccttgcggctgtgctcaggcggggcgttgcgtgaagcgctaaggagtccggtgtgctacgggcggcgctcgttcctccaggtgttgcggacaaccctcaaaccctggggtggggtccacccattgccaaacaaaccccaaaaaaaatccctggccccaggtccgggttaaacaccccgctttttcggggggggggggagtgggtcccccccgaggggagaaaaccccccccaaacgccccaatctctcggggggggagggggtaccccccctttgggtttggggggcataaataattgcctctttacaccggaaggtccccccccgggggccctcccagaaaaaacaaaaggagaacaccttgctcctcaaaaaaaagtgttttttcttaaaaacaaaaaaatggtggtccgcccccccaaagaagaaggggtggcc

SEQ ID NO: 44403 - DNA, 747 bp, Zea mays
  misc_feature: Ceres CLONE 1446538-F
  misc_feature: Encodes the peptide sequence at SEQ ID NO. 44404
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaactcctgcactttcactctatcatcacctaggagtaccaggctactagcataacaagtcgccaatccctccgcgagagagagtcagaaatggcatcacctcatagctgctttcgcggctggcagagcacgagccacgtggcagttgcgctggtgtccgtgctgatcctgagctcggcacgtctctccgcgggcggcaggagcctgctggagctgtacaagccgccggccagcgcgctcctgacgtaccacaacggcgccgtgctgcagggccgcatgccggtgtccataatctggtacggccggctcgccccaccgcagaaggccgtggtcaccgacttcctcgggtccctcacaaccgccgccgcctcgccgctgggaccgtcgccgtccctgtcccagtggtgggagaccatcgaacagctgaacctctccaggcccggggcaccggccaccggcggccccggggtggccctcttcggccagcccccgaacaaagggtgcttccctgggaaaacgcctggaacctgggcccactccccaantttgggggccccggccgggcccaaaaaaggcggggaaccccctgggggccccccccccaaaaatgggggccgggaacgggttttctacaaagcccttttggg

SEQ ID NO: 44404 - protein, 185 aa, Zea mays
  misc_feature: Ceres CLONE 1446538-F
  misc_feature (152)..(152): Xaa is any aa, unknown, or other
MASPHSCFRGWQSTSHVAVALVSVLILSSARLSAGGRSLLELYKPPASALLTYHNGAVLQGRMPVSIIWYGRLAPPQKAVVTDFLGSLTTAAASPLGPSPSLSQWWETIEQLNLSRPGAPATGGPGVALFGQPPNKGCFPGKTPGTWAHSPXLGAPAGPKKGGEPPGGPPPKNGGRERVFYKALL

SEQ ID NO: 44405 - DNA, 689 bp, Zea mays
  misc_feature: Ceres CLONE 1446540-F
  misc_feature: Encodes the peptide sequence at SEQ ID NO. 44406
  misc_feature (542)..(542): n is a, c, t, g, unknown, or other
  misc_feature (543)..(543): n is a, c, t, g, unknown, or other
agctccccgcggtggcggccgctctagaactagtggatcccccgggctgcaggaattcgcacgagaccattacctagaacatcctaatcgaaaaaaattgggtgtgctgtggcgaccgggctttccctacgggctggtcatcattttcgggagcgtcgtggctacctccggtgctgcggctagcgcgactaggccagatcgacccagcgcgatgacggctgtgtgcggcgtcctcggacatcgctccgccagctcaaatctccaagcgctcgagctcgaaactcctccaaccggtcatccgctgccagcaatcgacctccatccgcagagcactcaccgaaaggtggctctggatatctcctgctctaacagctccacaaaattgcattccacacttgggatgagtgaccgaccgaaaagttttcctcggtgccccccattggagttcaagtcccccaaaaaactctggttacctttggggaaaaaattttatactaaaaggttcccggggaaaaaattcccaaaccgcccttacaaagtannccccggggcgcggggaagggggcctaaaaaaaaaataaaccctttttttaaggggccgtttccacaaaaggaaaaagggtttttttttttaaaaaccctttgtggaccaaaaaaatttttccccctttttttgttggaaaaaaaaa

SEQ ID NO: 44406 - protein, 159 aa, Zea mays
  misc_feature: Ceres CLONE 1446540-F
  misc_feature (111)..(111): Xaa is any aa, unknown, or other
MTAVCGVLGHRSASSNLQALELETPPTGHPLPAIDLHPQSTHRKVALDISCSNSSTKLHSTLGMSDRPKSFPRCPPLEFKSPKKLWLPLGKKFYTKRFPGKKFPNRPYKVXPGARGRGPKKKINPFFKGPFPQKEKGFFFLKTLCGPKKFFPLFLLEKK

SEQ ID NO: 44407 - DNA, 655 bp, Zea mays
  misc_feature: Ceres CLONE 1446541-F
  misc_feature: Encodes the peptide sequence at SEQ ID NO. 44408
  misc_feature (50)..(50): n is a, c, t, g, unknown, or other
  misc_feature (271)..(271): n is a, c, t, g, unknown, or other
  misc_feature (308)..(308): n is a, c, t, g, unknown, or other
  misc_feature (407)..(407): n is a, c, t, g, unknown, or other
tggagctccaccgcggtggcggccgctctagaactagtggatcccccggngctgcaggaattcgcacgagaccatacctagaacatcctaatcgaataacaaaaacacaggtagggttaggcgacgcggcggcgagagcgcgagagtaggaggaggcgtcggccatgacggggaaggcgaagccgaagaagcacacggcgaatgagatcgccgcgaagatcgacgcggcgacgacgatccggggcggcgggcatgtcgggcagggcgatcngctagggcaggacaggggcgggcacgcgaagctggcntgcccgctctggccggacccccgggcccgaaatgtagtccatggaaatccccccagaggcggccttccaaagctcccctttgaggccgaaaaagttgtnaactggaatccctcccccccgccgcccgcgaaggcccccccctctaaacccaaacccggggcccgggggacccccaaaaaaaacggggggtggtgtccccccccaaccccccggggaaattcccccttttttttcccccccccccccccccccttttttttttttataatatacccccccccccccccccccgggggggggaaataaaaacgcccccccgccccccccccccccgttttttaaaagaa

SEQ ID NO: 44408 - protein, 149 aa, Zea mays
  misc_feature: Ceres CLONE 1446541-F
  misc_feature (36)..(36): Xaa is any aa, unknown, or other
MTGKAKPKKHTANEIAAKIDAATTIRGGGHVGQGDXLGQDRGGHAKLACPLWPDPRARNVVHGNPPRGGLPKLPFEAEKVVNWNPSPPPPAKAPPSKPKPGARGTPKKNGGWCPPPTPRGNSPFFFPPPPPPFFFFIIYPPPPPPGGGK

SEQ ID NO: 44409 - DNA, 721 bp, Zea mays
  misc_feature: Ceres CLONE 1446545-F
  misc_feature: Encodes the peptide sequence at SEQ ID NO. 44410
cagagctggagctccccgcggtggcggccgctctagaactagtggatcccccgggctgcaggaattcgcacgagaccattacctagaacatcctaatcgaaaatccatcttcccacagcaagccccatggatgtccactattgcttacccgcacgcgggcgcactcagggaccgtcaaatcgagcaagttgacagaggagaggaagcctcgaagatgttccggaaccagtacgacaccgacgtgactacatggagcccccaggggcggctgttccaggtggagtacgccatggaggccgtcaagcagggctcagcctgcgtcgggctccggtccagcactcacgccgtcctcgccgccgtcaacaagcccgcctccgagctctcctcctaccagcggaaggtgttccgcgtcgctgaccacgccggggtcgcgctcgccggcctcaccgccgacggccgcgttctctcgcgcttcctccgcaacgagtgcatcaaccactccttcgtctacgaggcgccactccccgtctccaggctcgcgctcaagctcgccgacaaggcgcaggtttgcacacagcggtcatggaagaggccctatggtgttggcctcctagttgctggactggacgagtcaagtgctcatctgtactacaactgccccagcgggaactactttgagtaccaggcattcgccatcggttctcgttcccaagccgcctag

SEQ ID NO: 44410 - protein, 168 aa, Zea mays
  misc_feature: Ceres CLONE 1446545-F
  misc_feature (29)..(169): Pfam Name: Proteasome Pfam Description: Proteasome A-type and B-type
  misc_feature: SWISSPROT Homolog: EC 3.4.25.1 Proteasome endopeptidase complex
MFRNQYDTDVTTWSPQGRLFQVEYAMEAVKQGSACVGLRSSTHAVLAAVNKPASELSSYQRKVFRVADHAGVALAGLTADGRVLSRFLRNECINHSFVYEAPLPVSRLALKLADKAQVCTQRSWKRPYGVGLLVAGLDESSAHLYYNCPSGNYFEYQAFAIGSRSQAA

SEQ ID NO: 44411 - DNA, 701 bp, Zea mays
  misc_feature: Ceres CLONE 1446547-F
  misc_feature: Encodes the peptide sequence at SEQ ID NO. 44412
  misc_feature (449)..(449): n is a, c, t, g, unknown, or other
  misc_feature (450)..(450): n is a, c, t, g, unknown, or other
  misc_feature (461)..(461): n is a, c, t, g, unknown, or other
  misc_feature (488)..(488): n is a, c, t, g, unknown, or other
  misc_feature (496)..(496): n is a, c, t, g, unknown, or other
aagctggagctccccgcggtggcggccgctctagaactagtggatcccccgggctgcaggaattcgcacgagaccattacctagaacatcctaatcgaaaaggtggtcccttggtgctattatgtatgaaatgctagttggttaccctccattttattcagaggacccaatgtctacttgcagaaagattgtgaactggagaagtcacttgaaattccctgaagaggcaaagcttcctcctgaagctaaggctctcatcagcaagcttttgtgtaatgttgagcatcgacttggtacaaaaggagcccatgaaataaaagcgcatccatggttcggaggtgttcagtgggagaagttgtatcagatgaaagctgctttcataccagaagttaatggagagttggatactcagaattttgagaaaattcgagagattggaactcaaattnncaagtcatccnagtcaggcccctggaggaagatgcttnccatcaangatgcaaacttttgtgggtatacgtaccagaactttgaaaattgtgattgatgatgaagttggcaggaattgccaaatttaaaaaaaaaaagttccaaaccaaaggcccccaccctcaaaaacatttttttaaaaaaattgccccgaaagaacccctttccaagggaatttcttaaaaattttttccccccgggggggcaaactc

SEQ ID NO: 44412 - protein, 141 aa, Zea mays
  misc_feature: Ceres CLONE 1446547-F
  misc_feature (89)..(138): Pfam Name: Pkinase_C Pfam Description: Protein kinase C terminal domain
  misc_feature: SWISSPROT Homolog: EC 2.7.11.1 Non-specific serine/threonine protein kinase
  misc_feature (110)..(110): Xaa is any aa, unknown, or other
  misc_feature (114)..(114): Xaa is any aa, unknown, or other
  misc_feature (123)..(123): Xaa is any aa, unknown, or other
  misc_feature (125)..(125): Xaa is any aa, unknown, or other
MYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFEKIREIGTQIXKSSXSGPWRKMLXIXDANFCGYTYQNFENCD

SEQ ID NO: 44413 - DNA, 695 bp, Zea mays
  misc_feature: Ceres CLONE 1446576-F
  misc_feature: Encodes the peptide sequence at SEQ ID NO. 44414
agagctggagctccccgcggtggcggccgctctagaactagtggatcccccgggctgcaggaattcgcacgagaccattacctagaacatcctaatcgaaaaagtagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagatagggcgctgtggcgtacatagaatgcagctcaaagacacagaggaacgtaaaggctgtgttcgacactc

SEQ ID NO: 44414 - protein, 179 aa, Zea mays
  misc_feature: Ceres CLONE 1446576-F
  misc_feature (15)..(175): Pfam Name: Ras Pfam Description: Ras family
  misc_feature (15)..(128): Pfam Name: Miro Pfam Description: Miro-like protein
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGRCGVHRMQLKDTEERKGCVRH

SEQ ID NO: 44415 - DNA, 654 bp, Zea mays
  misc_feature: Ceres CLONE 1446581-F
  misc_feature: Encodes the peptide sequence at SEQ ID NO. 44416
  misc_feature (654)..(654): n is a, c, t, g, unknown, or other
ctctttcctagaggatcccccgggctgcaggagtgcccacgagagcattacctagaacatcctaatcgaaaagaatccagaattcctgtttctgctcgaaatcgatccgatctccgctcgcgctgaagcctgatctccaccgggttcgcagcaggggcgcatgacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgaaagaaaaccaactacctcctcgcccacaacaagacgacagttaaacaaatcgaggatgccttcaaccaatttactaccagggaggatattgctattgtgctcgtcagtcagtatattgccaacatgataaggtttctggtggataggtacaacaagcccctccctgctattcgggagatcccatccaaggaccatccatatggatccagcgcacgactctgtgctctctggagtgaaatatgtgttctctgcagaaaccgggggcgctgataggcgatgaaggcatccttgtgggagagtacccttcgatggatctttttggatatgggn

SEQ ID NO: 44416 - protein, 127 aa, Zea mays
  misc_feature: Ceres CLONE 1446581-F
  misc_feature (15)..(109): Pfam Name: ATP-synt_F Pfam Description: ATP synthase (F/14-kDa) subunit
  misc_feature: SWISSPROT Homolog: EC 3.6.3.14 H(+)-transporting two-sector ATPase
MAGRANIPTNNSALIAIIADEDTVTGFLMAGVGNVDLRKKTNYLLAHNKTTVKQIEDAFNQFTTREDIAIVLVSQYIANMIRFLVDRYNKPLPAIREIPSKDHPYGSSARLCALWSEICVLCRNRGR

SEQ ID NO: 44417 - DNA, 644 bp, Zea mays
  misc_feature: Ceres CLONE 1446587-F
  misc_feature: Encodes the peptide sequence at SEQ ID NO. 44418
  misc_feature (79)..(79): n is a, c, t, g, unknown, or other
  misc_feature (86)..(86): n is a, c, t, g, unknown, or other
  misc_feature (87)..(87): n is a, c, t, g, unknown, or other
  misc_feature (381)..(381): n is a, c, t, g, unknown, or other
  misc_feature (383)..(383): n is a, c, t, g, unknown, or other
  misc_feature (416)..(416): n is a, c, t, g, unknown, or other
  misc_feature (429)..(429): n is a, c, t, g, unknown, or other
  misc_feature (462)..(462): n is a, c, t, g, unknown, or other
ggagctccccgcggtggcggccgctctagaactagtggatcccccgggctgcaggaattcgcacgagaccattacctangaacatnncctaatcgaaaaccaacgccgtgctccgtcgtcgtctccgcccccagagtgatcgagcccactgaccactgacctggcccccgagcctcagctcgtgagcccggcaccgcgcctcgccatggccatggtgcagccggcggacacggccgtcaaggccaacgagatcctggcgcggttccggcccatcgcgcccaagcccacactggcagcagccgccgccgccgccgccgcggcgcccgtggcgcaggcccgcggccgagggcgtcgtggccgcgaaacggcttgcccccccancngcagaggaggcctttcctccgcggcaaaccccncccccccctccgntcttccccatggcgcccaagtcggggccccaanccccccgccaaaccgaaagaaaagctccaacgccggatcccgccctctcccaggtccccgggggcaaaccccggggggcccatgtgttccccgggtctgccccacggagggggcccctttccccccccggggaagaggggggggtccccaaaaacttctccgaaaggggggtactccaatcc

SEQ ID NO: 44418 - protein, 33 aa, Zea mays
  misc_feature: Ceres CLONE 1446587-F
MCSPGLPHGGGPFPPPGKRGGSPKTSPKGGYSN

SEQ ID NO: 44419 - DNA, 718 bp, Zea mays
  misc_feature: Ceres CLONE 1446589-F
  misc_feature: Translation starting site: 197
  misc_feature (313)..(313): n is a, c, t, g, unknown, or other
  misc_feature (315)..(315): n is a, c, t, g, unknown, or other
  misc_feature (320)..(320): n is a, c, t, g, unknown, or other
  misc_feature (321)..(321): n is a, c, t, g, unknown, or other
  misc_feature (358)..(358): n is a, c, t, g, unknown, or other
  misc_feature (406)..(406): n is a, c, t, g, unknown, or other
  misc_feature (417)..(417): n is a, c, t, g, unknown, or other
  misc_feature (470)..(470): n is a, c, t, g, unknown, or other
  misc_feature (635)..(635): n is a, c, t, g, unknown, or other
  misc_feature (672)..(672): n is a, c, t, g, unknown, or other
  misc_feature (676)..(676): n is a, c, t, g, unknown, or other
atagctggagctccccgcggtggcggccgctctagaactagtggatcccccgggctgcaggaattcgcacgagaccattacctagaacatcctaatcgaaaaagatacgcccaacaaaaaccaaccacccaccaagccagcaagcacctctccaagcagacagacgggaagggagggcaaccgagagcgatcggcgatgggctccttcctctcgagcttagtcacgccccctccggccgccgacaaccccaactgcgccgtggtggccgcccactccaaggccacctacgacgagcagtgggcggcccacaananccgcnncaagctgatggtgatcgacttctcggcctcctggtgngggtctctgtccctccccccagcgggaaagaagggaggtggcctcccncttctccaacnccatcttctttagggaagacatcaacaaactcgcggagggcgcgaggacttgnaaggtaaaagccattcccaacgttcctaacttgtaaaggaagggaaggaagtaaccccgtgggggttggggcccaaaaaggacaaactctgaaaggaaaatcccgaatgttcccctccatcctcccccaccgtaaactccctgtgggttcccccggggacagaantgtccaaaaatgaaaatggttccccctccccggaaangctnaaaaaaaaaaaagaaaaaaacctcttgtgcaaaaaggacgga

SEQ ID NO: 44420 - DNA, 639 bp, Zea mays
  misc_feature: Ceres CLONE 1446598-F
  misc_feature: Translation starting site: 228
ctggagctccccgcggtggcggccgctctagaactagtggatcccccgggctgcaggaattcgcacgagaccattacctagaacatcctaatcgaaaaactccaactctcaagcgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtcgcggctctcgagacggacctgcagcggatgggcgaggagaaccggcgcctggcggaggcgctggccgaggtggcctccaagtacgaggcgctgcgggggcagtacacggagatggttggccgcggcggcccacggcctggcgggaacaccccgtcgtcccactccgaaagggcgggtccctggtcccccttccccggaaacccccaaaaagggaaaaacccgggaaccccggggcccggggccg

SEQ ID NO: 44421 - DNA, 650 bp, Zea mays
  misc_feature: Ceres CLONE 1446608-F
  misc_feature: Encodes the peptide sequence at SEQ ID NO. 44422
agctccccgcggtggcggccgctctagaactagtggatcccccgggctgcaggaattcgcacgagaccattacctagaacatcctaatcgaaaaacatccgtagtgtgtgcatgcatcacagtcacacacacaatcactcacacacacagagaagaaaccgaacgagagtttagctatagccaagccagcgtgcgtgcgtgcgtgtgtgttgctagtagtactagctagcaaaataaacagaagcaagcaagctagctagagctaaggatcgagatcgaccgaccgaccgacgatcagctagcatggcgcgcttcgtggatccgctggtggtggggcgggtgatcggcgaggtggtggacctgttcgtgccttccatctccatgaccgtcgcctatgatggccccaaggacatcagcaacggctgcctcctcaagccgtccgccaccgccgcgccgccgctcgtccgcatctccggccgccgcaacgacctctacacgctgatcatgacggaccccgatgcgcctagccccagcaacccgaccatgagagagtacctccactggatagtgattaacataccaggaggaacagatgctactaaaggtgaggaaggtggtggagtacatggggcccgcggccgccggtgggc

SEQ ID NO: 44422 - protein, 115 aa, Zea mays
  misc_feature: Ceres CLONE 1446608-F
  misc_feature (19)..(111): Pfam Name: PBP Pfam Description: Phosphatidylethanolamine-binding protein
  misc_feature: The sequence is a functional homolog of SEQ ID NO 2 in US patent 7196246
  misc_feature: The sequence is a functional homolog of SEQ ID NO 2 in US patent 7208653
MARFVDPLVVGRVIGEVVDLFVPSISMTVAYDGPKDISNGCLLKPSATAAPPLVRISGRRNDLYTLIMTDPDAPSPSNPTMREYLHWIVINIPGGTDATKGEEGGGVHGARGRRW

SEQ ID NO: 44423 - DNA, 547 bp, Zea mays
  misc_feature: Ceres CLONE 1446614-F
  misc_feature (333)..(333): n is a, c, t, g, unknown, or other
tggagctccccgcggtggcggccgctctagaactagtggatcccccgggctgcaggaattcgcacgagaccattacctagaacatcctaatcgaaaaagcccgcgccctcggagcccccttccgcttctcctctccgggaatggcgtcggcgcgaggaccttgcggattagtgtcgttctgacttcgtcagctgcctattccaggctgagcccatcgaatctgttctgcgtgatgctgttcagtcacgccaccgtacagtccgcatggccagctatcagtgtgcatggcactggaaagagcagtgcaattcactgcagtagcgtgatcaaccnaggccgtttggttgaaaataaacaagtggttagctaaaggggggttggaacctcctttttgtccctggtcagggaaacttgggtggaaacccttgttccccgcgaagttggccaggggccttttatttaaaggtttgaaaaaagaaaaaccccggggctttcccctttttttaaaacccccaaaaaaattttttggaaaaaattacccccgccc

SEQ ID NO: 44424 - DNA, 670 bp, Zea mays
  misc_feature: Ceres CLONE 1446626-F
  misc_feature: Encodes the peptide sequence at SEQ ID NO. 44425
ctccccgcggtggcggccgctctagaactagtggatcccccgggctgcaggaattcgcacgagaccattacctagaacatcctaatcgaaaactcagcgcaacgattacggtaacgccgtcgccgccctacggctcagatcttcgtcgtcatcttctccggcaacgagcacccaaggatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaacccccaagcttcatacgcaacagttcttaaggcccatatgcatgctctgaagaaaagggagaggaaagacaagaagaaggctgcagatgctgagaaggcaattgagaccgcacccaagaagcagaagaaagcatcttcaaagaaatcttccggggtcccagtcataaggcgctcgcagaaatcagggtcttcttcccttctgttgttatcgcaccgccagactaattagagtgtcgtgcattttatctgggttttatcccgaa

SEQ ID NO: 44425 - protein, 152 aa, Zea mays
  misc_feature: Ceres CLONE 1446626-F
  misc_feature (4)..(93): Pfam Name: SRP14 Pfam Description: Signal recognition particle 14kD protein
MVVLQPDRFLSELTSMYERSTEKGSVWVTMKRSTLKGKAQLRKMENKGQEVEHRCLVRASNGKKNISTSVSLKEYTNPQASYATVLKAHMHALKKRERKDKKKAADAEKAIETAPKKQKKASSKKSSGVPVIRRSQKSGSSSLLLLSHRQTN

SEQ ID NO: 44426 - DNA, 706 bp, Zea mays
  misc_feature: Ceres CLONE 1446632-F
  misc_feature: Encodes the peptide sequence at SEQ ID NO. 44427
  misc_feature (421)..(421): n is a, c, t, g, unknown, or other
  misc_feature (462)..(462): n is a, c, t, g, unknown, or other
  misc_feature (621)..(621): n is a, c, t, g, unknown, or other
  misc_feature (706)..(706): n is a, c, t, g, unknown, or other
aagctggagctccccgcggtggcggccgctctagaactagtggatcccccgggctgcaggaattcgcacgagaccattacctagaacatcctaatcgaaaaaaaaaaactctcacacatcaccgcgagagaggaggctgagccgcggaggagcagcggcgcatcgcaacactaaccaaagtcctcctctccaggtgccgagccagggtgactgttccgaggagcgtggcgtggacccatggggaacaagggcaagtggttcggcgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctgcgggtcccccccccnttcctcgccagaccgacgaggtcagggtccccgaagccgancaggagcagagcaagcatgtcaccctggaggaggcccctgctgctgctgctgccccagcacaggcgtcgggtgctgccacctggtgcgccaaccgaagagctccccgcaatcaagatccagaccgcctttccgaggttacctgcccaaggagggcactnagaagcacctacaagggccttgtaccgattggaagtcattgggttgacgggtaattcactttaaccggccattctgcaaagcatn

SEQ ID NO: 44427 - protein, 145 aa, Zea mays
  misc_feature: Ceres CLONE 1446632-F
  misc_feature (62)..(62): Xaa is any aa, unknown, or other
  misc_feature (75)..(75): Xaa is any aa, unknown, or other
MGNKGKWFGAVKKVFSPESKEKKEERLRRKSAASNPAPVDLTPSTSLEVNVSVPPPAGPPPXPRQTDEVRVPEAXQEQSKHVTLEEAPAAAAAPAQASGAATWCANRRAPRNQDPDRLSEVTCPRRALRSTYKGLVPIGSHWVDG

SEQ ID NO: 44428 - DNA, 648 bp, Zea mays
  misc_feature: Ceres CLONE 1446634-F
  misc_feature: Encodes the peptide sequence at SEQ ID NO. 44429
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (539)..(539): n is a, c, t, g, unknown, or other
  misc_feature (553)..(553): n is a, c, t, g, unknown, or other
  misc_feature (558)..(558): n is a, c, t, g, unknown, or other
  misc_feature (575)..(575): n is a, c, t, g, unknown, or other
  misc_feature (586)..(586): n is a, c, t, g, unknown, or other
  misc_feature (589)..(589): n is a, c, t, g, unknown, or other
  misc_feature (592)..(592): n is a, c, t, g, unknown, or other
  misc_feature (597)..(597): n is a, c, t, g, unknown, or other
  misc_feature (616)..(616): n is a, c, t, g, unknown, or other
  misc_feature (617)..(617): n is a, c, t, g, unknown, or other
  misc_feature (622)..(622): n is a, c, t, g, unknown, or other
  misc_feature (643)..(643): n is a, c, t, g, unknown, or other
  misc_feature (644)..(644): n is a, c, t, g, unknown, or other
cgcggtggcggccgctctagaactagtggatcccccgggctgcaggaattcgcacgagaccattacctagaacatcctaatcgaaaactcgtcctctccgtcccgaccagaatcatcgcttcttcctgctccggcgatatccgccgccgcctgcggtccggcagagatgggaagcacttcctctatgctcacccaatacgatatcgaggaggtccaggaccattgtaaccacgcattctcgcagcaggagatcgtatcgctgtaccaccgcttctgccagctcgaccgtaacggtggtggcttcgtctccgctgacgagttcatgtcggtccctgagttcgccgtatatcccctctcccagaggctgcgggaggatgctggatgggctcaacttcaaggagtttgtagcatttttgtcagcttttaccccccgcacaagcctgcagcaaaaattgaatttattttccgggtttatgaaaaccnnnacttggnnnnnnnnnnnnnnaaaaaaaaaggnnnnnntttttttttttttgccncccccgcaccaccnacttnttgtgtgtgatgggagnagagcacaganagnagnagacnaagaacacgcacacccccnnagacnggtgcagtaattggggggganngccc

SEQ ID NO: 44429 - protein, 133 aa, Zea mays
  misc_feature: Ceres CLONE 1446634-F
  misc_feature (106)..(106): Xaa is any aa, unknown, or other
  misc_feature (107)..(107): Xaa is any aa, unknown, or other
  misc_feature (109)..(109): Xaa is any aa, unknown, or other
  misc_feature (110)..(110): Xaa is any aa, unknown, or other
  misc_feature (111)..(111): Xaa is any aa, unknown, or other
  misc_feature (112)..(112): Xaa is any aa, unknown, or other
  misc_feature (113)..(113): Xaa is any aa, unknown, or other
  misc_feature (118)..(118): Xaa is any aa, unknown, or other
  misc_feature (119)..(119): Xaa is any aa, unknown, or other
  misc_feature (125)..(125): Xaa is any aa, unknown, or other
  misc_feature (131)..(131): Xaa is any aa, unknown, or other
MGSTSSMLTQYDIEEVQDHCNHAFSQQEIVSLYHRFCQLDRNGGGFVSADEFMSVPEFAVYPLSQRLREDAGWAQLQGVCSIFVSFYPPHKPAAKIEFIFRVYENXXLXXXXXKKKGXXFFFFAXPAPPTXCV

SEQ ID NO: 44430 - DNA, 768 bp, Zea mays
  misc_feature: Ceres CLONE 1446640-F
  misc_feature (385)..(385): n is a, c, t, g, unknown, or other
  misc_feature (387)..(387): n is a, c, t, g, unknown, or other
  misc_feature (393)..(393): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (523)..(523): n is a, c, t, g, unknown, or other
  misc_feature (573)..(573): n is a, c, t, g, unknown, or other
  misc_feature (606)..(606): n is a, c, t, g, unknown, or other
  misc_feature (607)..(607): n is a, c, t, g, unknown, or other
  misc_feature (617)..(617): n is a, c, t, g, unknown, or other
  misc_feature (630)..(630): n is a, c, t, g, unknown, or other
  misc_feature (633)..(633): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
gagctccccgcggtggcggccgctctagaactagtggatcccccgggctgcaggaattcgcacgagaccattacctagaacatcctaatcgaaaaaaccccacactacaactcgacaccgagaaaagcgcagcaaagcaacgcaaagcctacgccgctacagtgctacagcgagcgagcctcttgcctgccgctacgagccaacgactcgaacgcatacactccaatggcagcgacggtgatggcctccatgagcccactcgcctccgccacccctggttcgcgtcgagatttccctgtacggctgctgcttccatgcatctgcactcgcggccggccggccccccttttttctttttcccccccgccgggacaaagcaagaggnancccaancccaaataaaatttcccccccccccccnnnacccctgaaccccaacacccaggggcggcgggggacgggggagcccccggggctgtggggaaccgcccggaggcttcaacggggccgggcctcccccagngcgagagtaacggcggccccacggcctgggagcggcctctccggctgggncaatgtaccatataaggatgggctcccctgccnnggcccccccnagcgacactcccnagnaaaggggannnagcggcccccctgatcaacgggggcccgagcgacccctgtcggatgttgcgccgccccctcgcccccgcgtgctctatgggggaccacccccccgacggcaacacacgccggcaacctcccgct

SEQ ID NO: 44431 - DNA, 767 bp, Zea mays
  misc_feature: Ceres CLONE 1446642-F
  misc_feature: Encodes the peptide sequence at SEQ ID NO. 44432
  misc_feature (11)..(11): n is a, c, t, g, unknown, or other
  misc_feature (12)..(12): n is a, c, t, g, unknown, or other
  misc_feature (21)..(21): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (446)..(446): n is a, c, t, g, unknown, or other
  misc_feature (452)..(452): n is a, c, t, g, unknown, or other
  misc_feature (515)..(515): n is a, c, t, g, unknown, or other
  misc_feature (754)..(754): n is a, c, t, g, unknown, or other
  misc_feature (764)..(764): n is a, c, t, g, unknown, or other
atttttgttgnncccggcgtntgttacctatacaatcacnnnnnnnggnnnnnnnntaaagctggagctccccgcggtggcggccgctctagaactagtggatcccccgggctgcaggaattcgcacgagaccattaccgagaacatcctactcgaaaaactgcgactgtgagcttcgttcgttcagttcatccatgttcttgtttgccaggtccacagagagaggatgtcgtgctgcggaggcaactgtgggtgcggctcctgctgcaagtgcggcaacggctgcggagggtgcagcaagatgtacccggacatggctgagcacgtgaccaccaccacccaggctctcatcatgggtgtcgcaccatccaaggggtacgccgagggcggattcgaggcggccgccggagttgataagggcgggtgcaagtgtggaggggggtgcnaatganaaccctccaactgcggccagcccccccccccgtctcactctgcaggccggccagaggaagccnccccacccttacccgctaatttggggttatagggcgtcccctctgtgccgctccgccgcccgcccaccaaataggttgcttggccatggacgggaatggctcctcagcctcgggatgggtggaggtttggttggatggttcgccgtcccgctccctgacaacccccccccttcccctctccttggagcgatttcatgggcgggcccagccaccgggactagcgaagcctacaggaaccncacaagaggncac

SEQ ID NO: 44432 - protein, 73 aa, Zea mays
  misc_feature: Ceres CLONE 1446642-F
  misc_feature (1)..(73): Pfam Name: Metallothio_2 Pfam Description: Metallothionein
MSCCGGNCGCGSCCKCGNGCGGCSKMYPDMAEHVTTTTQALIMGVAPSKGYAEGGFEAAAGVDKGGCKCGGGC

SEQ ID NO: 44433 - DNA, 717 bp, Zea mays
  misc_feature: Ceres CLONE 1446652-F
  misc_feature: Encodes the peptide sequence at SEQ ID NO. 44434
aagctggagctccccgcggtggcggccgctctttaactagtggatcccccgggctgcaggatttcgcacgagaccattacctagaacatcctaatcgaaaaattcttcaatcccgctcgcgtcggctgtgttagccggtagccctccccccgtccgaggtccgagtccgaccgaaggagagaggcagcagccatggctaagggcgggctgagcaagctccggtgcatggtcaagaggaggtggcactcgtcgagccgcatcgtctcccgcgccccgtcgccaccggctcacgccgacgccgtcgccgtcgccgccacctccggccacgcgcgcggcgcgtcgtcccacggtgcggactaggcgctgaagggcctgcacgcggtgtacgtctgcaggtcgcgccaccggcaccctcccccacaggagctcgtgggccacccgatgttccagaccctcgtccaccccacccgcggtgccaggggtcccgcgggtaccgtcgccgtctgttgcgaggtcgccctcttcgagcacctcctctggatgctggagcacctctacccgcagccggagtcccctcgacgagctcgtcgactactacgcctgctgacctgccattccgatggttaatacactatactaaccatttgtgccgcctcctgaacacttgtgtcgctttcgcccgttgggttgcattttggttcccattgcctttgggta

SEQ ID NO: 44434 - protein, 55 aa, Zea mays
  misc_feature: Ceres CLONE 1446652-F
MAKGGLSKLRCMVKRRWHSSSRIVSRAPSPPAHADAVAVAATSGHARGASSHGAD

SEQ ID NO: 44435 - DNA, 714 bp, Zea mays
  misc_feature: Ceres CLONE 1446658-F
  misc_feature (533)..(533): n is a, c, t, g, unknown, or other
acccgcggtggcggccgctctagaactagtggatcccccgggctgcaggaattcgcaccagaccattacctagaacatcctaatcgaaaaatgtgatgatactacggctcagcccaaccatttccttttgcaaaccctgctccaactccgattcgtcactccaccctcgtcgcgccgccgcctgccgcgtccccggccagcctcgcagccccgtgggctgctagcggctagccacagcggagagaccaggagccatggtgatccctccaccaccaagggcatctatagtcatccgtttcctcaagccctacctgttgacgatgcttttctcgaaagagtaagtatctggtgaaggaagttcacagggttaacaaaaatagattggatgtttctgaaaggagcgcccgcccccccccccccgagagcgaaggaggggggcggagggcggggagctgcgcaggtggtctgcgcgagagagggagaagatggctttggtccaaagcgccgggctgccggggagggggagatgaccngggcggggtggggccgcccgggcggcgggcgggcgtggggtgacccgtgggggcgagttagaaggccgggcggaggagacggtggcccgagggaggcgggatgaccgggcggctcgaggaacgcgggaagggtggaagcggacgcggaacggatgcgccgtcttggcgccgcgagctgccg

SEQ ID NO: 44436 - DNA, 648 bp, Zea mays
  misc_feature: Ceres CLONE 1446663-F
  misc_feature: Encodes the peptide sequence at SEQ ID NO. 44437
agctccccgcggtggcggccgctctagaactagtggatcccccgggctgcaggaattcgcacgagaccattacctagaacatcctaatcgaaaaatcacatatccgttgtggcagcagccttcgtgcaggcatggcgagctcatcttgtgcactgctgggtctggcctgcttcgtgctcctggcggcggcagccggcgccacgcagtacaaggtcggcggcgacaatggctgggccgtgccggacgccaccgccgagtcgttcaacacctgggcggagaagaccagcttccagatcggcgacagcctcttgttcgtgtaccccaaggacaaggactcggtgctgctggtggagccggccgactacaacgcctgcaacacctcctcctacgacaagcagttcgacgacggcagcacgtccgtggcgctggaccgcgccggcgccttcttcttcatcagcggcgtcgaggccaactgccgcgccaacgagaagctcatcgtcatggtcgccggcgcgggcgcgccggcgccggccccggaccggcagggctccggctcttcctcctccccgtcgacgtccgcgccggtaccctccaagggtggcggcgccccggtgccgccgtcctcgcctaaagcccccgccgccaaga

SEQ ID NO: 44437 - protein, 172 aa, Zea mays
  misc_feature: Ceres CLONE 1446663-F
  misc_feature (34)..(119): Pfam Name: Cu_bind_like Pfam Description: Plastocyanin-like domain
MASSSCALLGLACFVLLAAAAGATQYKVGGDNGWAVPDATAESFNTWAEKTSFQIGDSLLFVYPKDKDSVLLVEPADYNACNTSSYDKQFDDGSTSVALDRAGAFFFISGVEANCRANEKLIVMVAGAGAPAPAPDRQGSGSSSSPSTSAPVPSKGGGAPVPPSSPKAPAAK

SEQ ID NO: 44438 - DNA, 697 bp, Zea mays
  misc_feature: Ceres CLONE 1446666-F
  misc_feature: Encodes the peptide sequence at SEQ ID NO. 44439
  misc_feature (651)..(651): n is a, c, t, g, unknown, or other
  misc_feature (697)..(697): n is a, c, t, g, unknown, or other
ggagctccccgcggtggcggccgctctagaactagtggatcccccgggctgcaggaattcgcacgagaccattacctagaacatcctaatcgaaaaattaaacagttatactctcgtctcgacatcacaatcgaggcgagctacgtgcaactttgctggctgctgcagagcctaggctcgttcgaggcggtggcggacatgcaggaagagcagctctccgttctgcttgactagctcgggtgccaacgtcacgcacctgcgctcggacaatggacagaggctgagcgttccgagtcccgtgcagcacagagggagacctcgcgctcgtaccacttgacgacagccttcgtggagacgaggatgagcgccgtccagacctctttccatccaggaggctggtgcacccaacaccaaacaacgcaagaacagcagctgagcatgcacgtgagaggctccagctatgctcaccgcgaaacctccacctgaggtatcgtctgaagatgacaacagttgccaacatgtcttcgtagcagttataaccaaagctgctcactatcgagagctcgctgaatctggggagctattacttgggagattctgagatgatcttgagtattttcgtatgccccatatactaatgaatcagatgtntcgatcagatcttaaatcaactgcctgtccgatgacgtctatgtgn

SEQ ID NO: 44439 - protein, 46 aa, Zea mays
  misc_feature: Ceres CLONE 1446666-F
MLTAKPPPEVSSEDDNSCQHVFVAVITKAAHYRELAESGELLLGRF

SEQ ID NO: 44440 - DNA, 752 bp, Zea mays
  misc_feature: Ceres CLONE 1446667-R
aattgggtaccggggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctttcggaaaaagagtgggtagctctttgatccgggcaaacaaaccaccgctggtt

SEQ ID NO: 44441 - DNA, 634 bp, Zea mays
  misc_feature: Ceres CLONE 1446683-F
  misc_feature: Encodes the peptide sequence at SEQ ID NO. 44442
tggagctccccgcggtggcggccgctctagaactagtggatcccccgggctgcaggaattcgcacgagaccattacctagaacatcctaatcgaaaaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataacatggaccatgggaaa

SEQ ID NO: 44442 - protein, 65 aa, Zea mays
  misc_feature: Ceres CLONE 1446683-F
MILVAIVAELLEEYTALVARVLEQLLNDAPFPRRMRFLMLRSLPFVPPPLPPPPPPHALHVTTRV

SEQ ID NO: 44443 - DNA, 735 bp, Zea mays
  misc_feature: Ceres CLONE 1446684-F
aaagctggagctccccgcggtggcggccgctctagaactagtggatcccccgggctgcaggaattcgcacgagaccattacctagaacatcctaatcgaaaaagtctgtctaggccatcaatcacgtcaagatccctgccccggccgcgctgcagcacggcgggggtcctgccgaactccgtcgccggggagctgccgtggctccggcacgggtcccagctcctgtgggccttgctccgtcggtggccaggcggaggctcgcagctctggctcctgccgtaggccgtcctcctgaagctcaggtgctccagcgccgcgcgctcgcagtccgacagcgggctcgaggccgtgcggctgttcaccggcgacgtgttgtgccgagtctccgtctcccggtcgaggtccggcgccgccgcctttgcgggactgggacgacgcgtcgtgcctcgacgaattgctggtcccgtagccctctgtcttcacctggatcaccaggtgggtggaggaccgccaccagctccagcatgtaatgctccgtttttcgccttgcccgccttaatgaacctccttgattccggtgaacccttgcctgggaaccctgttttcctgccagtggccccccggcaaccagggggaaccctgtttagggggggggcaaactgaaacaaaaaagttccccccactttgccgaggggagaaaacaaaaagggtttccccggcccccgggggaaactt

SEQ ID NO: 44444 - DNA, 656 bp, Zea mays
  misc_feature: Ceres CLONE 1446691-F
  misc_feature: Encodes the peptide sequence at SEQ ID NO. 44445
ccccgcggtggcggccgctctagaatagtggatcccccgggctgcaggaattcgcacgagaccattacctagaacatcctaatcgaaaaacctacacgtaacacgttgcacctcgcgtcctcgccccgctctgttcgagttcccgttgcaggcgcacgccatggccgcggccattctccgccgccttacccccaccgccgccagccagctcgtggcgccgctgcccctgctcgcgcgtggggtctccgactcccgcgacgcgatcaccgttgacacctcggtgcccttcaagtcccacatcgtggaacccggcacgcgcgaagcccaccacctcggcgcggggagttgctggtctttcttccgccaacatgtcgcctcaatgcgggccctccaagaatcccgggggggaatttggtccacacaaacccaaaaattaaatcgggggggtttttggccaccttcttaaaaaggccaaaaagggtttttccccctcgccaatgaaggccccccccacccccgggccaaaacccattattaaccccctaacggggaaacctgggggggaacctccggggggggggggggaacccccttcccccccttttcccaaaaatttatggggcccccggggagaggtttttcccaaaaaaaaagag

SEQ ID NO: 44445 - protein, 101 aa, Zea mays
  misc_feature: Ceres CLONE 1446691-F
  misc_feature: SWISSPROT Homolog: EC 1.2.4.1 Pyruvate dehydrogenase (acetyl-transferring)
MAAAILRRLTPTAASQLVAPLPLLARGVSDSRDAITVDTSVPFKSHIVEPGTREAHHLGAGSCWSFFRQHVASMRALQESRGGIWSTQTQKLNRGGFWPPS

SEQ ID NO: 44446 - DNA, 689 bp, Zea mays
  misc_feature: Ceres CLONE 1446692-F
  misc_feature: Encodes the peptide sequence at SEQ ID NO. 44447
ctggagctccccgcggtggcggccgctctagaactagtggatcccccgggctgcaggaattcgcacgagaccattacctagaacatcctaatcgaaaaccgaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccatttcaatcctttaccgtgtcattcaggacccatcttcttctgctgatgcactgagaacaaaagaagttgcaattacaaatcttacaaactacctcactaaagaaaacagagctgaggagctgcgtaatcttttgacccagctcagaccattttttgcagttattcctaaggcaaagactgcaaaaattgtccgtggaataattgatgctgtcgccaagatacctggaacatcagatcttcagatttcactctgcaaggaaatggtagaatggacccgtgcagagaagcgtactttcctccagcaacgtgtggaggcaaggttggcagctctcctgttagagaatc

SEQ ID NO: 44447 - protein, 144 aa, Zea mays
  misc_feature: Ceres CLONE 1446692-F
MSSSMESSYLPATTESLAQAQEAKDASESISILYRVIQDPSSSADALRTKEVAITNLTNYLTKENRAEELRNLLTQLRPFFAVIPKAKTAKIVRGIIDAVAKIPGTSDLQISLCKEMVEWTRAEKRTFLQQRVEARLAALLLEN

SEQ ID NO: 44448 - DNA, 601 bp, Zea mays
  misc_feature: Ceres CLONE 1446701
  misc_feature: Encodes the peptide sequence at SEQ ID NO. 44449
gagtacccagagcagccgaccctggctagctctagcttgtgtagttgagttcttgtatttgcttgaatctgcaaaaaaaaactagagacaaaaggaggacgggaaacggagagaaggatcatggactacagcatgcagggatccaaggactcgtactcgccgcaagttcacaaccacttgtacccggactctcagccagggctgtatcctcctccgccgcaggggggctacggctacggctaccagtaccagggctaccttggcgaatcggcgaaccctccttattactactacactggcagctggcccgagcagcccccagctccgtccgacggcgccccctttcgctaccgctacctgcaggaccaggacgatgccgactgcatcaccttcctcagaggatgtcttgctggtctgtgctgctgctgcttactggagcgatgctgcatctaaggaggatggcgtgcagtgctgctgcctggagcacgcatgtatgcagcagtgtggtggtgacataataataataataataagctgctgcggcagcagagatgacggttcctgcgttgacggcgccatccatgtaaaaaaaaaaaaaaaa

SEQ ID NO: 44449 - protein, 110 aa, Zea mays
  misc_feature: Ceres CLONE 1446701
MDYSMQGSKDSYSPQVHNHLYPDSQPGLYPPPPQGGYGYGYQYQGYLGESANPPYYYYTGSWPEQPPAPSDGAPFRYRYLQDQDDADCITFLRGCLAGLCCCCLLERCCI

SEQ ID NO: 44450 - DNA, 868 bp, Zea mays
  misc_feature: Ceres CLONE 1446713-R
  misc_feature: Pfam Name: Rep_fac_C Pfam Description: Replication factor C
cgattgggtaccgggccccccctcgaggtcgacggtatcgataagcttttttttttttttttttaaccctgagaaaggttctttgcacattggggcatccatccccgggcccagttcagggggattttaagtcggagttcatcgctttttcaacccgtccaaagctcccaacatcaaagcggtgggggaggcaaattaaccttggggggcttctaaaaggcaggaaaaagttttccccaaggatcgaaaccccctttcctctttataaactcttaaaaaaccagcgtccgcggcatgttaaaaaaaaagcggatagtctccctggcaacatccagaaggtgtaaatactcatctgccccatcaaccaagcacttatgagtttccccaagctttttacaaatcctggcctttggaccatcgggaataccacccgggctaataatcacatctaaaaactgggccatcagctggaacaccgaatatccatcggcaaaaaggttgcaaacttccttgttggccacgccaaattcaccaaatctgcaggcggcaagcagtgccttgacaacatcttcggggaaaacccctaaaacaatgaatcgggcactgggaagagaaaaaaaatccaaataagcggggtggccctctgaagggggggttttggccccgccaaaaatccccttggaaaaagcacccccagtggggaccaccccccggaacataaaaattgaggcccttccccagtggccaataggcaaaagggggaaatacctcttccatttttttggaaaaagggtttgaaacccaaactttgcccatttttgaaggaaagggggccccataaacccggcggaataaaggggcaaaaaaa

SEQ ID NO: 44451 - DNA, 725 bp, Zea mays
  misc_feature: Ceres CLONE 1446722-F
  misc_feature: Encodes the peptide sequence at SEQ ID NO. 44452
  misc_feature (289)..(289): n is a, c, t, g, unknown, or other
aaagctggagctccccgcggtggcggccgctctagaactagtggatcccccgggctgcaggaattcgcaagagaccattacctagaacatcctaatcgaaaagcttcggcttcgccttgactcagatgcagcccgccgccgttaggctccggttgccgcctgctcgcgccgcggacacttcgtcctcccagtcgccggcgcgcctgacggcggtgctggagcaggtggaccagttgctaagccaggggaacgacatggccgcgctctccctcgtgcgcagtacgcaggngggtgacggcgggctcccgggcttttggcgccgccaggcaggtatattttggtggtggggtgaagaacttggttctggataccattggtcactatctcagccaaaagtttcccaaccgatttttccagcctgaaagctgcccccttcctgaaaacctaacctgcctggaagggcttccaaaaagatacccaatccccaagctttaaacccctttttaaaccagggaccccttaaggggcccactgggaaacctttttgggacactaaaatccccctaaaaaaataaaaagggggggaccctttccccccaggggtaaaaaaatcttccgggttaaccacccccggggttgcgcaaaatattgcttttttggcgccccaaaagggtttccccccccccacactttttttttgcccccccgggggtggtgccccaaaa

SEQ ID NO: 44452 - protein, 98 aa, Zea mays
  misc_feature: Ceres CLONE 1446722-F
  misc_feature (55)..(55): Xaa is any aa, unknown, or other
MQPAAVRLRLPPARAADTSSSQSPARLTAVLEQVDQLLSQGNDMAALSLVRSTQXGDGGLPGFWRRQAGIFWWWGEELGSGYHWSLSQPKVSQPIFPA

SEQ ID NO: 44453 - DNA, 634 bp, Zea mays
  misc_feature: Ceres CLONE 1446725-F
gctctagaactagtggatcccccgggctgcaggaattcgcacgagaccattacctagaacatcctaatcgaaaactatggcatctccattcgtcgttctgttgcaatattgcttacgatcctggctctgtgaaggctcatgccatggcgtctcctactggtctgggggactttactggagctggtgcacggcctgaccttcgttctggatttctcccatcacgacgtactgcctatgatcgggtctcatgctgccaatgtccactcttacgtgactgtcgacccgtgatgcatcaacgggagcagctggctttgactctctcaacggctcggggtatgatgctccaaatgcccatgtcactgcacatgcggcgtctacagccgctcctgctgcccttgcatgcctactaccctttctctcgaggaacggatgcctgtcgactatctacatcgccctactgatctgcactcgtgccggcatcctgctcatctggtgcacccacgtcctctgctcctacttccggagtgtgatcgcttccctctggttcacctctcgctgcagcgtcatagtgacgaacacagagcacatctgcgccggggcgctctcgcttcgatcatcctagagtccatgcatg

SEQ ID NO: 44454 - DNA, 789 bp, Zea mays
  misc_feature: Ceres CLONE 1446726-F
  misc_feature: Encodes the peptide sequence at SEQ ID NO. 44455
  misc_feature (332)..(332): n is a, c, t, g, unknown, or other
  misc_feature (340)..(340): n is a, c, t, g, unknown, or other
  misc_feature (351)..(351): n is a, c, t, g, unknown, or other
  misc_feature (365)..(365): n is a, c, t, g, unknown, or other
  misc_feature (368)..(368): n is a, c, t, g, unknown, or other
  misc_feature (378)..(378): n is a, c, t, g, unknown, or other
  misc_feature (381)..(381): n is a, c, t, g, unknown, or other
  misc_feature (398)..(398): n is a, c, t, g, unknown, or other
  misc_feature (409)..(409): n is a, c, t, g, unknown, or other
  misc_feature (410)..(410): n is a, c, t, g, unknown, or other
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcgaaaaatggatttctcttaggctcacccgtccgctcggctcgcttccttccccactctctctgatcccgtcgcacttccctcctcgctgcagcccctctattattgcgattaccgtttcctcactgccctttcctttttcggtcggcagcaatcaccggggcaagcgaaccctcgatttgcgtccccgctctctgctagcgcccctaaaagaggagcgaagcgatgtctatgccngagacggntcaggccgcgnagagggatgagcancancagtccccgnggnatagcactgatgcaggncatctgccccnntgtgtaccgcaggccnaaatacacgccctgccccatcaagcagggtctctacttggatctgtttggaccgctatcaaaaaggacccttctcagagcttgaactacccctatttttggatcgtgcaaagccccgggaccccgttttccccgcggaattttatttcccaagaattcaaatttcttttattccccaaaccttgattttttaaaagctttccaaaaaaaggttttggttttaaaaaaaaaattaaaattctttgagagaaatattttttccccttttttttttggggggagaaaggagaggaaaacatttttttttttttcttcaaaaaaaacaaaaaaaagccccccaaaggggtttgctcctaataaaaaa

SEQ ID NO: 44455 - protein, 96 aa, Zea mays
  misc_feature: Ceres CLONE 1446726-F
  misc_feature (7)..(7): Xaa is any aa, unknown, or other
  misc_feature (11)..(11): Xaa is any aa, unknown, or other
  misc_feature (15)..(15): Xaa is any aa, unknown, or other
  misc_feature (16)..(16): Xaa is any aa, unknown, or other
  misc_feature (20)..(20): Xaa is any aa, unknown, or other
  misc_feature (21)..(21): Xaa is any aa, unknown, or other
  misc_feature (30)..(30): Xaa is any aa, unknown, or other
  misc_feature (36)..(36): Xaa is any aa, unknown, or other
MSMPETXQAAXRDEXXQSPXXSTDAGHLPXCVPQAXIHALPHQAGSLLGSVWTAIKKDPSQSLNYPYFWIVQSPGTPFSPRNFISQEFKFLLFPKP

SEQ ID NO: 44456 - DNA, 682 bp, Zea mays
  misc_feature: Ceres CLONE 1446730-F
  misc_feature: Encodes the peptide sequence at SEQ ID NO. 44457
  misc_feature (682)..(682): n is a, c, t, g, unknown, or other
ctggagctccccgcggtggcggccgctctagaactagtggatcccccgggctgcaggaattcgcacgagaccattacctagaacatcctaatcgaaaactgagcccaacgcgacccaacctcttcctcctcgtctccgtctccgtctccgatagtccgactccacgaagcgaagccgctcaacatcctcttccgctgcgcctgcgcgcgcgggaggacgaaatacggcaagaagctactcgagaaaggccacgcacgatgatggcgtgtcggcggctggcgagggacgccgtcgcggcctcgctccggcggggcgccgccaccgagaccaccgcctccacgcccgccttcttctcctcttcctccgccgctgcgtcctcctgctcctccggcgcaccagtcgccagcagccccattcgccacttcctggcgcgctattcaagccccgctttccagatccagcctagcgctgcggggctcggcccttcgttcgccgcgagagtggcccttggtctccggccgcagttgtcaggcctcaatctgatcaaaggatttggaacaagcaccatgctagcgatgacgcttcatcagggacaggttactgctgccacaaaagagcaaccatcaaaagccatagctggaccaccccaggggtctttgaaaccaagcttggttcattttgn

SEQ ID NO: 44457 - protein, 141 aa, Zea mays
  misc_feature: Ceres CLONE 1446730-F
MMACRRLARDAVAASLRRGAATETTASTPAFFSSSSAAASSCSSGAPVASSPIRHFLARYSSPAFQIQPSAAGLGPSFAARVALGLRPQLSGLNLIKGFGTSTMLAMTLHQGQVTAATKEQPSKAIAGPPQGSLKPSLVHF

SEQ ID NO: 44458 - DNA, 709 bp, Zea mays
  misc_feature: Ceres CLONE 1446733-F
  misc_feature: Encodes the peptide sequence at SEQ ID NO. 44459
aagctggagctccccgcggtggcggccgctctagaactagtggatcccccgggctgcaggaattcgcacgagaccattacctagaacatcctaatcggaaaacacccacacatccgacgccgaggaagtaggaagcacgagcagcatatgtcacagagggccagcgtcccacactcctcctgcatagccttcgcgctccattcccatctcctggtctccagtgagatgtgccccagctcctattggcagcaatagctattctccgccttccttttttttttcttcttcttcctttcctcccgtctggatttcgtttccgtttgatcgagctggctctcagcttccgtttttagttttgttggcatctttgctctcggatccgtctctccctaactcctgaaacccaaaaggagagaagaaaccgggcaagcaagcgatgggtgtcaagggattcgtcgagggcggcatcgcctccatcgtggccggctgctccacccacccgctggacctcatcaaggtccgcatgcagctgcagggggaggcggcggccgccgtggcgccgcagccggcgctgcgcccggcgctcgccttccacgccgggggccacgccgtcgcgctcccgcaccaccacgacatcccggcgccgccgcggaagcccgggccgctggccgtcggcgcgcagatcctgcggtccgagggcgccgcgggc

SEQ ID NO: 44459 - protein, 91 aa, Zea mays
  misc_feature: Ceres CLONE 1446733-F
MGVKGFVEGGIASIVAGCSTHPLDLIKVRMQLQGEAAAAVAPQPALRPALAFHAGGHAVALPHHHDIPAPPRKPGPLAVGAQILRSEGAAG

SEQ ID NO: 44460 - DNA, 848 bp, Zea mays
  misc_feature: Ceres CLONE 1446749-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (350)..(350): n is a, c, t, g, unknown, or other
  misc_feature (357)..(357): n is a, c, t, g, unknown, or other
  misc_feature (361)..(361): n is a, c, t, g, unknown, or other
  misc_feature (374)..(374): n is a, c, t, g, unknown, or other
  misc_feature (381)..(381): n is a, c, t, g, unknown, or other
  misc_feature (383)..(383): n is a, c, t, g, unknown, or other
  misc_feature (401)..(401): n is a, c, t, g, unknown, or other
  misc_feature (402)..(402): n is a, c, t, g, unknown, or other
  misc_feature (420)..(420): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (567)..(567): n is a, c, t, g, unknown, or other
  misc_feature (588)..(588): n is a, c, t, g, unknown, or other
  misc_feature (590)..(590): n is a, c, t, g, unknown, or other
  misc_feature (591)..(591): n is a, c, t, g, unknown, or other
  misc_feature (605)..(605): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaactgggaaactccaccgccggttggggcggccgcctctagnaactagntggnaattcccccgggncttgcangnaaaattcgcacgaaaacnncattacctagaacatccntaatcgaaaaaaagttcagtcacagccacaggtatgctgacactcctgccccttcgcttgcattctcgctactgtagccgcacactcccgaacgccgccttgctcctcccgnnncagcacagggtctccctccgccagatcacgcangggagccagcatggacgctgncnngcggcttccttcgnttccggaacgctgctttcgggccgcccacttggcaaaaaaaggccccccaaagaaagcccttggaacatttcctggtcccaaataaatggggccctgggggggccaaattttggggaaaccccttggccccttggggggaaagttctttggggccaaaggttttcccacaccccccccggtggccccccccgggggggggccccccggaaacaccccccgaaaaaacccccccccttttttgc

SEQ ID NO: 44461 - DNA, 643 bp, Zea mays
  misc_feature: Ceres CLONE 1446751-F
  misc_feature: Encodes the peptide sequence at SEQ ID NO. 44462
tggagctccccgcggtggcggccgctctagatatagtggatcccccgggctgcaggaattcgcacgagaccattacctagaacatcctaatcgaaaaaacgtcctcatcttcatctcccaggttttcccctccaatcacccccaggtcttcctctcgcgagttgcggtctcgcgcccccctccgccgaccgccgcctcctcacaaccgcggaagctgcttccctctccattggacgcggccagcttccatctctcggtcacctccctctacatcccacggccgctaccacctttcctctacctcacacggccgccggcctctccaaggtctgcacacgcattcagcgacgcatttgcctatatcagcactgcggccataactcgagtagagaaaggagaagatgcaggcatctagggcaaggcttttcaaggagtacaagggagtacaacgagagaagtcagctgaccctgaaatccagttaatatgtgatgattcccactatttcagggggactgctcctatcaagggccccttctgaaacaccctaatgaaggtggggggggttcacttggcgttcgcaatttccaaaggaatatcctctactggcctcctcaaagtttgattttttaaccaaaatttttc

SEQ ID NO: 44462 - protein, 45 aa, Zea mays
  misc_feature: Ceres CLONE 1446751-F
MQASRARLFKEYKGVQREKSADPEIQLICDDSHYFRGTAPIKGPF

SEQ ID NO: 44463 - DNA, 696 bp, Zea mays
  misc_feature: Ceres CLONE 1446752-F
  misc_feature: Encodes the peptide sequence at SEQ ID NO. 44464
ctggagctccccgcggtggcggccgctctagaactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcccctcgtcgacggcggaccggcaggccacctgcaactgcctcaagagcatgacgggccggctcgccggcggcgtcagcatggcccaacgccccccacatccccggcaagtgcggagtctccgtccgggttgcccatcagcccccaccttgcaatggccccaagaatcaacctggatccaatggacccgtagcggaaggtaagctattcgccccctcccatcctcccttggaattgggaaccggtggcccattaaaaaaaaaattgggcccgcctaatcgtatctcc

SEQ ID NO: 44464 - protein, 137 aa, Zea mays
  misc_feature: Ceres CLONE 1446752-F
  misc_feature (36)..(115): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSGVRSLNSRPSSTADRQATCNCLKSMTGRLAGGVSMAQRPPHPRQVRSLRPGCPSAPTLQWPQESTWIQWTRSGR

SEQ ID NO: 44465 - DNA, 692 bp, Zea mays
  misc_feature: Ceres CLONE 1446753-F
  misc_feature: Encodes the peptide sequence at SEQ ID NO. 44466
  misc_feature (352)..(352): n is a, c, t, g, unknown, or other
  misc_feature (392)..(392): n is a, c, t, g, unknown, or other
ggagctccccgcggtggcggccgctctagaactagtggatcccccgggctgcaggaattcgcacgagaccattacctagaacatcctaatcgaaaaaattcgtgtcaccgcgtcccgagagcgcaaatcattccgcgcgacgcaaaaaccctagcccagccaccgacccctctcatggcaaccaccaccacccaggcgagcctcctcctccagaagcagctaagagatctcgcgaagcacccggtggatgggttctctgctgggctggtcgacgacagcaatgtcttcgagtggcaggtcaccatcatcggaccgcctgacaccctatatgatggagggtactttcatgcantaatgagcttcccacaaattaccgggaggggcggcatcanttcaatttacctctgaaaggggatccaaatggttatccggagggggggtttggttcctctttttccccccccggggagaacccaacggttaaaaccccccagggggggaggagaccccgggcccccaaaaaaagaaattttgaaaaatattaaaggccccccccaccaaaaaagagtccccccccaaacttggggcccccaagaggggggggggaaagaggggttttctttaaaaagggggggccccccctgcggaaaaacccaaaatttttttaaaagaaaggggccccccggaaaaaa

SEQ ID NO: 44466 - protein, 77 aa, Zea mays
  misc_feature: Ceres CLONE 1446753-F
  misc_feature: SWISSPROT Homolog: EC 6.3.2.19 Ubiquitin--protein ligase
  misc_feature (60)..(60): Xaa is any aa, unknown, or other
  misc_feature (73)..(73): Xaa is any aa, unknown, or other
MATTTTQASLLLQKQLRDLAKHPVDGFSAGLVDDSNVFEWQVTIIGPPDTLYDGGYFHAXMSFPQITGRGGIXSIYL

SEQ ID NO: 44467 - DNA, 792 bp, Zea mays
  misc_feature: Ceres CLONE 1446754-F
  misc_feature: Encodes the peptide sequence at SEQ ID NO. 44468
  misc_feature (62)..(62): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (531)..(531): n is a, c, t, g, unknown, or other
  misc_feature (647)..(647): n is a, c, t, g, unknown, or other
  misc_feature (688)..(688): n is a, c, t, g, unknown, or other
ttggccctccctggttggcgtaagacgtgataaacaataaattcattatcaattcgtccatnttnnnnnnnnggatnnnnnnncaaactgggactccaccgcggtggcggccgctctatatctagtggatcccccgggctgcaggaattcgcacgagaccattacctagaacatcctaatcgaaaaccgacttggcctctcccccgccaaacaacgcctcgacgcgacgacccagcccagccccgtgccgcgatggccatgaccgtgatccgcctcgccgccatccgcccgccgtcggcctcttcctccgccgcgtccccgtcgctgtggccgcccgcgcggctgcgcctccgcgtgaggtgccgcgccggcggggacggagggatgaagaaggaggagggggaggccgaggcgcccgagtcgctcttcgccagggagctccggcggcgtgggatggcgccgggggccgccgggcccgcggtcgctagcaagggggttgaagaacccggcgccgggaggcccgggtcaaancggggggggggcgcccccgcaattcaagccccgccgccccccgtggacgggcctcacgggaagccgcttccctgggcatccccatagacggagggtcccagaggaggtgttgggtnccctcgtgccaaacattgactgggttaaagcacttgcggantatggctattgttttttttgggggggcaatgggggatcccagggaaattctttggggctaccgcgaaccgcacccgtttattcgcacgaaatcaactgactacc

SEQ ID NO: 44468 - protein, 121 aa, Zea mays
  misc_feature: Ceres CLONE 1446754-F
  misc_feature (93)..(93): Xaa is any aa, unknown, or other
MAMTVIRLAAIRPPSASSSAASPSLWPPARLRLRVRCRAGGDGGMKKEEGEAEAPESLFARELRRRGMAPGAAGPAVASKGVEEPGAGRPGSXRGGGAPAIQAPPPPVDGPHGKPLPWASP

SEQ ID NO: 44469 - DNA, 634 bp, Zea mays
  misc_feature: Ceres CLONE 1446773-F
  misc_feature: Translation starting site: 160
  misc_feature (317)..(317): n is a, c, t, g, unknown, or other
  misc_feature (357)..(357): n is a, c, t, g, unknown, or other
  misc_feature (432)..(432): n is a, c, t, g, unknown, or other
  misc_feature (435)..(435): n is a, c, t, g, unknown, or other
  misc_feature (439)..(439): n is a, c, t, g, unknown, or other
  misc_feature (440)..(440): n is a, c, t, g, unknown, or other
  misc_feature (448)..(448): n is a, c, t, g, unknown, or other
  misc_feature (449)..(449): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (484)..(484): n is a, c, t, g, unknown, or other
  misc_feature (495)..(495): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (504)..(504): n is a, c, t, g, unknown, or other
  misc_feature (506)..(506): n is a, c, t, g, unknown, or other
  misc_feature (522)..(522): n is a, c, t, g, unknown, or other
  misc_feature (528)..(528): n is a, c, t, g, unknown, or other
  misc_feature (530)..(530): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (551)..(551): n is a, c, t, g, unknown, or other
  misc_feature (552)..(552): n is a, c, t, g, unknown, or other
  misc_feature (554)..(554): n is a, c, t, g, unknown, or other
  misc_feature (555)..(555): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (572)..(572): n is a, c, t, g, unknown, or other
  misc_feature (575)..(575): n is a, c, t, g, unknown, or other
  misc_feature (576)..(576): n is a, c, t, g, unknown, or other
  misc_feature (583)..(583): n is a, c, t, g, unknown, or other
  misc_feature (584)..(584): n is a, c, t, g, unknown, or other
  misc_feature (591)..(591): n is a, c, t, g, unknown, or other
  misc_feature (595)..(595): n is a, c, t, g, unknown, or other
  misc_feature (596)..(596): n is a, c, t, g, unknown, or other
  misc_feature (598)..(598): n is a, c, t, g, unknown, or other
  misc_feature (603)..(603): n is a, c, t, g, unknown, or other
  misc_feature (605)..(605): n is a, c, t, g, unknown, or other
tggagctcaccgcggtggcggccgctctagactagtggatcccccgggctgcaggaattcgcacgagaccattacctagaacatcctaatcgaaaaacccgagcccgtgcccggaatctttgtagaagcgtctggaggactcccacccggctgccagccatggctgataatctggcgcccgagaagcgccactccttcgtgcacaacgggcagaaggtgttcgagtgggaccaaacgctggaggaggtcaacatgtacatcaacctcccgaaggctgtgccaaccaggcatcgtcactgcagcaatccggatagacnggtttttttcgggggagagagcgcccctccgcgcgtcatnggtttcggccccgccccgccgcggggggggggggggttttgtttggttttttgtaccccccttggtgttacgatnaanctanntttggggnnatttggccttcccnnntttccccctgccnnnnncncaaccgcgggnccnnnnctncncccccccacgatcttnaattgngnggggggtgaagggnnnccgcnnanntgttccttttnnngagnatnngccggtnntggtgcngggnncnccaancngaccaacatcgaaacacaaacccaacaac

SEQ ID NO: 44470 - DNA, 797 bp, Zea mays
  misc_feature: Ceres CLONE 1446783-F
  misc_feature: Encodes the peptide sequence at SEQ ID NO. 44471
  misc_feature (78)..(78): n is a, c, t, g, unknown, or other
  misc_feature (79)..(79): n is a, c, t, g, unknown, or other
ggacttcctttgtcgtgtgccacccccagcaatataaaatactctttccccctccccccttctttacatcacataatnnctcccaagctggaactccaccgcggtggcggccgctctattcctagtggatcccccgggctgcaggatattcgcacgagaccattacctagaacatcctaatcgaaaaacgcgaatcgtaccggtacgaacactgagcacgcacgcacgcacgcaaactcaaaggagtgtgaccacggaactgaagccatggcggttacagttgagaagggctctatgggcgagccggcgctgctgctggagcgcagccgggcgatcaccctgcacggccgtgaccggaagggccgtgccgtcgtcaggatcgtcggcaactactttccagcgcgcgcgctgggcggccgggcggaggaggccctgcggtcgaacctgcgggagcgcatcctcccggagatcggggaccgcgagttcgtggtcgcgaaaaagcacaacccccatggatcatgaaaccaaacccaatggaccatagtgttaaaaccctcccccccaacaaacgacttccccccctgcaaacacaataataacgctaccaacaaaacaaaataattcgacacattctagaagcacccacctcctatccaacccccacacactaaaacccaatccacactcccccctcataacgtattctgtcaattcccccatccatataaagaccaaaacaacacaaaccatatcaattatccctcacagcacttctagcttcctacccgcgcccgccg

SEQ ID NO: 44471 - protein, 84 aa, Zea mays
  misc_feature: Ceres CLONE 1446783-F
MAVTVEKGSMGEPALLLERSRAITLHGRDRKGRAVVRIVGNYFPARALGGRAEEALRSNLRERILPEIGDREFVVAKKHNPHGS

SEQ ID NO: 44472 - DNA, 745 bp, Zea mays
  misc_feature: Ceres CLONE 1446787-F
  misc_feature (331)..(331): n is a, c, t, g, unknown, or other
  misc_feature (341)..(341): n is a, c, t, g, unknown, or other
  misc_feature (343)..(343): n is a, c, t, g, unknown, or other
  misc_feature (390)..(390): n is a, c, t, g, unknown, or other
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaagctgttagtgctgttcccctctctcttccccgtcctgcaggctccaggcgctgctgctctcgtcctccgctagcgagcgaatcgctggcccgacgccgcggcgggaggtatctcgctttcgatcaggattttggttggggcgtcgttctccggtgcttatctcatttctatttatcggtgcctcgggttcacggccaaattcgctgctgcgtggggctttggagattgnagccattccntnaaagtggcggtggcagcgtctgggtggaacatgagcttcgtgttccngagaagcaggcccaacntaaagccccgtggcttcacaaggttcgcccccgagcgccgcacatgattatgaccttctgaaagccctgaaggctgacaatacctgcatgtttcctctttagaggaaaaagaaataaatcccttcctgccttacaaataaggtcccggcccccagggaatgcccctgcccaaaaagtaaagggcttccccccttttgttttcttaaggggctcccaagaaaaaaaaggggggtttaaaccaggtggacggggaaaatccccgggggaaaaacagtggggtttcttaaaaacaaactggggggggaattttaaaaaaaccctattgtgttttttttttt

SEQ ID NO: 44473 - DNA, 765 bp, Zea mays
  misc_feature: Ceres CLONE 1446794-F
  misc_feature: Encodes the peptide sequence at SEQ ID NO. 44474
aaagctggagctccccgcggtggcggccgctctagaactagtggatcccccgggctgcaggaattcgcacgagaccattacctagaacatcctaatcgaaaaatcgcgcaccgcttccccagttcccccagctccccccaccttccgttgccttctcgaactcaacccccgcccccgtcgcggatcgtcatggccgccggcctcgccttccccgtcgcctcctttccactcgcctgcgtctcctcacctccccaccccgggcaccgcatctgctgcgcgatcccgtcgtcgtcctcgcgccgcaccgtcaaatcctcgccgctccgcgcgactaccgtcctctccagggaacgacggggcacgggccgtggcgcgtccgtagtgtgcgctgtccaaggccaggacacgaccatccaagtcccagatgtgacaaagtcaacatggaatccactcgtgatcgaaagcgagcttcccggtcctgttggagttctcggccggcatggtgcgggccatgcaaaaagaaaaaaaccatttgttggcagttttccaagggcctccaaggggaacttaaattgtctcaaccaaaacccaattgaagccccgggaaattccaaaccaaaatggggggcccggaagtcccccccccccgagtaatttttcagggggggggaaaaaaaagaatttcttttttttgggggccgtgcccaaaaaaacacctgggccatatcttccaaaaaatttttcaagagggaaaaaatttttttt

SEQ ID NO: 44474 - protein, 154 aa, Zea mays
  misc_feature: Ceres CLONE 1446794-F
MAAGLAFPVASFPLACVSSPPHPGHRICCAIPSSSSRRTVKSSPLRATTVLSRERRGTGRGASVVCAVQGQDTTIQVPDVTKSTWNPLVIESELPGPVGVLGRHGAGHAKRKKPFVGSFPRASKGNLNCLNQNPIEAPGNSKPKWGARKSPPPE

SEQ ID NO: 44475 - DNA, 630 bp, Zea mays
  misc_feature: Ceres CLONE 1446800-F
  misc_feature: Encodes the peptide sequence at SEQ ID NO. 44476
  misc_feature (563)..(563): n is a, c, t, g, unknown, or other
  misc_feature (570)..(570): n is a, c, t, g, unknown, or other
acccgcggtggcggccgctctataactagtggatcccccgggctgcaggaattcgcacgagaccattacctagaacatcctaatcgaaaagtcgtcaccgcctcgggcctcggccgatcgatcgggtcagcgtgcgcctggcggcggccacaagcgtcgctgtttaataaatagccctgagcggcctccccctgcccctcagttcagcctcggctggacatcgagtttgtaccgggaaacagcttggtagtataaccactgaagatggtcagtgggaggccgcatggtgaattggactcatggttcaagagcctcatggtgacctctagcagcgagagggggcaggctgggagtggtggtccagcgccaacattaacaggatggaaggaccttccgatggagctcctggtgcggataatatccacagttggagatgataggatggtcatcgtggcgtctggtgtttgcacaggctggcgtgacgcgctgggatggggggtcactaatctttcacttacatggtgcaaactgagcatgaataattttatgatatctcttgcccnacaagtncacgaaagttgcagttctcactctccggcaaaacaaacctcagcttgaagacagtgcgta

SEQ ID NO: 44476 - protein, 117 aa, Zea mays
  misc_feature: Ceres CLONE 1446800-F
  misc_feature (100)..(100): Xaa is any aa, unknown, or other
MVSGRPHGELDSWFKSLMVTSSSERGQAGSGGPAPTLTGWKDLPMELLVRIISTVGDDRMVIVASGVCTGWRDALGWGVTNLSLTWCKLSMNNFMISLAXQVHESCSSHSPAKQTSA

SEQ ID NO: 44477 - DNA, 655 bp, Zea mays
  misc_feature: Ceres CLONE 1446801-F
  misc_feature: Translation starting site: 155
  misc_feature (437)..(437): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (545)..(545): n is a, c, t, g, unknown, or other
  misc_feature (546)..(546): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (560)..(560): n is a, c, t, g, unknown, or other
  misc_feature (562)..(562): n is a, c, t, g, unknown, or other
  misc_feature (563)..(563): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (604)..(604): n is a, c, t, g, unknown, or other
  misc_feature (608)..(608): n is a, c, t, g, unknown, or other
  misc_feature (616)..(616): n is a, c, t, g, unknown, or other
  misc_feature (621)..(621): n is a, c, t, g, unknown, or other
  misc_feature (622)..(622): n is a, c, t, g, unknown, or other
  misc_feature (628)..(628): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaaactgccagtgtgcatcctgagccatccattgggctccgtttccacccaatccaatggcgctcaggctctccctcgccccgccagcagctgcacccgcggcctccacatgccgctgcagcagcgcaagcttcatccggccgggcgtcgcagttgggagccgccggggcagggcgcgtggctgcgtggtggcgatggccgacctgctgggcgacttgggcgcgcgcgaccccttcccggaggagatcgagagccagtttggggagaaggtgctgggcaacgtggacacgcttcccaccagaaatctcatccccacccctctccgcgctcttccctcgngagccttccccggctgccaaagnnnnnnnnnnnnnnnnnnnnngannnnnnnnnnnnnnnnnnnnnnnnnnnnnnnnnnnnnnnnnnnncnnnnnnnnnncannnncnncncnncnnnnnccncnncnnnncncnnccccccccccccnnnnnnncnnnnccccccncccncccccccnccccnncccccnncccccccccccccccccccccccccc

SEQ ID NO: 44478 - DNA, 677 bp, Zea mays
  misc_feature: Ceres CLONE 1446813-F
  misc_feature: Encodes the peptide sequence at SEQ ID NO. 44479
  misc_feature (187)..(187): n is a, c, t, g, unknown, or other
  misc_feature (224)..(224): n is a, c, t, g, unknown, or other
  misc_feature (239)..(239): n is a, c, t, g, unknown, or other
  misc_feature (245)..(245): n is a, c, t, g, unknown, or other
  misc_feature (246)..(246): n is a, c, t, g, unknown, or other
  misc_feature (257)..(257): n is a, c, t, g, unknown, or other
  misc_feature (263)..(263): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
ctccccgcggtggcggccgctctagaactagtggatcccccgggctgcaggaattcgacgagaccattacctagaacatcctaatcgaaaaaccaaagcctccgcccccttccctgacaccctcgccgccgcgcacgcacgcacgaaccagcgaagagatgggcgtctacaccttcgtgtgccgcancgccggcgggcgcgagtggaccgccagcagcactccngcgagatggaggccntcgccnngcacccctacnagctgnannngcgcctcgtccgcgccgcctccggggccgattcccggtccggggtcagtccgccttttccatgggacccccaattccccccttttcaaagaaaatttcgggggggccccaatatttttatagggggggggggcccgggggggcccccccccccccggggggggggccgccgcccctcccccccggggggaaaagggggggggggggggggggggccggcgtggtttnnnnnnnnnnnnnncgnnnnnnnnnnnnnnnnnnnnnnnnnnnnnnnnnnnnnntacgnnnnnnnnnnnnnnnnnnnnnnnnnnnnnnnnnnnnnnnnnnnnnnnttttttatttttttttttttttttttttttttggggggcggggnnnnnnnnnnnnnnnnnnntttggtgggtggtgtgg

SEQ ID NO: 44479 - protein, 76 aa, Zea mays
  misc_feature: Ceres CLONE 1446813-F
  misc_feature (10)..(10): Xaa is any aa, unknown, or other
  misc_feature (30)..(30): Xaa is any aa, unknown, or other
  misc_feature (35)..(35): Xaa is any aa, unknown, or other
  misc_feature (36)..(36): Xaa is any aa, unknown, or other
  misc_feature (37)..(37): Xaa is any aa, unknown, or other
MGVYTFVCRXAGGREWTASSTPARWRPSPXTPTSXXXASSAPPPGPIPGPGSVRLFHGTPNSPLFKENFGGAPIFL

SEQ ID NO: 44480 - DNA, 647 bp, Zea mays
  misc_feature: Ceres CLONE 1446818-F
  misc_feature: Encodes the peptide sequence at SEQ ID NO. 44481
  misc_feature (551)..(551): n is a, c, t, g, unknown, or other
  misc_feature (617)..(617): n is a, c, t, g, unknown, or other
ctccccgcggtggcggccgctctagaactagtggatcccccgggctgcaggaattcgcacgagaccattacctagaacatcctaatcgaaaacttgccgtctctccagttcaccctcatgggccctaaacttcacgtcaacactgccaaggtcgactcctgcctccgcccggtgaccggcatccggctgttcctggaaggcaagaagagcgaccagctgggcgtccacctgcagcacctgtcggcgacgcccagcgcgatcacggtgctcagcgaggccgcgtcctcggcggacgacgcggccgccgtgaacgagcgcgcctacatcgagcccgtccggtcgccgctgctctcgcacatctgcacggcgcccgtgcagtacaacggcgcgcttatcgacgactgcgccgccatcgtcaccagcgcctggctcgaggtgcgggacgcctgctgcctcaagaaggtgctgttcctgcgcctcggcttctccggcgtcgcggccatgaagatccgccgctccgagtggggcggggccctggtcgcgccgcgcangtccgggtcgctgtcggcgcgcctcagcgccgcgctgtccggtggcctggcgccggcgccgccggncgtggaagagaaagtggaagtcaactccgc

SEQ ID NO: 44481 - protein, 176 aa, Zea mays
  misc_feature: Ceres CLONE 1446818-F
  misc_feature (145)..(145): Xaa is any aa, unknown, or other
  misc_feature (167)..(167): Xaa is any aa, unknown, or other
MGPKLHVNTAKVDSCLRPVTGIRLFLEGKKSDQLGVHLQHLSATPSAITVLSEAASSADDAAAVNERAYIEPVRSPLLSHICTAPVQYNGALIDDCAAIVTSAWLEVRDACCLKKVLFLRLGFSGVAAMKIRRSEWGGALVAPRXSGSLSARLSAALSGGLAPAPPXVEEKVEVNS

SEQ ID NO: 44482 - DNA, 619 bp, Zea mays
  misc_feature: Ceres CLONE 1446826-F
  misc_feature: Encodes the peptide sequence at SEQ ID NO. 44483
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
ggagctccccgcggtggcggccgctctagaactagtggatcccccgggctgcaggaattcgcacgagaccattacctagaacatcctaatcgaaaaaggaggaggtagaccgaacaactccaggtcgcgggagcggccatttctctggggcgggaccgcgggagagctctagctcttgcagcagtagaactctactgcagccagagttaagagaaatggataaggatggcagctccgaaagaagtcgcccagatcatggtgatgtgaagatgctccagttcagaccaaaggtgcctcgacagaagccaaagccaaagcaaccagaccctaagccaattgatgaagatgtgatggagatattgaggactcgcccagtggctacaaaagtgcaccaaacacagaagatgagtgctcccacagaagaaactctcgaagccccttctggagaaggttgtttgcgtggccccacgcactctgagtggaaaaccaaatccattggcactccaaacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44483 - protein, 99 aa, Zea mays
  misc_feature: Ceres CLONE 1446826-F
MDKDGSSERSRPDHGDVKMLQFRPKVPRQKPKPKQPDPKPIDEDVMEILRTRPVATKVHQTQKMSAPTEETLEAPSGEGCLRGPTHSEWKTKSIGTPNG

SEQ ID NO: 44484 - DNA, 629 bp, Zea mays
  misc_feature: Ceres CLONE 1446832-F
  misc_feature: SWISSPROT Homolog: EC 1.1.1.62 Estradiol 17-beta-dehydrogenase
ggagctccccgcggtggcggccgctctattctagtggatcccccgggctgcaggaattcgcacgagaccattacctagaacatcctaatcgaaaaaaaaaatcgcatcgaccagctagctacacgaatcagacggcgccatggccggcacgtgcgcccacgtcaagttcctccgcgcgcaaccggcgtgggcgctgacgctggccgccgtgggtctgctcgtgggcgtccgccccgctgcccgcttctcgctcgtgggtctacgccgcgttcctccgcccggggaaccccctgcgccgccgctacggcgactgggccgacgtgacgggcgccaccgacggcatcggccgcgccgtcgcgttcggcctctccgcggtcggactcgggctcgtcctcgtcggccgaaacccgcacaacctggccgtggtggccgccgagatcaagggcaagcaccccaaggtccccgcagtgcgacccttattgctcgacttccccagcgaaggggctcgcgggccggggtcaacgggcttaaagacttccactcgggggccttcgaatttcggccttgggtcgtacaaaaaccccaaagtttctctcacccggaaagcccggggtaattttcccgaggag

SEQ ID NO: 44485 - DNA, 673 bp, Zea mays
  misc_feature: Ceres CLONE 1446835-F
  misc_feature: Encodes the peptide sequence at SEQ ID NO. 44486
ctccccgcggtggcggccgctctagaactagtggatcccccgggctgcaggaattcgcacgagaccattacctagaacatcctaatcgaaaaatcgcctcgtgcaagtccaagctcccacgactccaccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtccaggttacatcaccttatgcccatactgtgcatcataatgaaaatgctccacggggccagtttgctttccccacttcagaagctggaaacctaccttgcatggtttctgaataacccgcgtggaaaaaggatccgggaccctcctcttattttggttgggaaaaataggatttgctgcaaaggactggggaaccttttggctaaaaaaaaaaaaaattggggggccgaaaaactaagcttaggaaaatttgaagctggggccgaggcccctcccccaaaacctggggggt

SEQ ID NO: 44486 - protein, 104 aa, Zea mays
  misc_feature: Ceres CLONE 1446835-F
MAASVFPALLLAVAAVLLLPVAEAVWLELPPSGTKCVSEEIQPNVVVLADYAIMYESHPSSHPTVAVQVTSPYAHTVHHNENAPRGQFAFPTSEAGNLPCMVSE

SEQ ID NO: 44487 - DNA, 729 bp, Zea mays
  misc_feature: Ceres CLONE 1446836-F
  misc_feature: Translation starting site: 180
  misc_feature (402)..(402): n is a, c, t, g, unknown, or other
  misc_feature (547)..(547): n is a, c, t, g, unknown, or other
ctccccgcggtggcggccgctctagaactagtggatcccccgggctgcaggaattcgcacgagaccattacctagaacatcctaatcgaaaaatcgcgcaccgcttccccagttcccccagctccccccaccttccgttgccttctcgaactcaacccccgcccccgtcgcggatcgtcatggccgccggcctcgccttccccgtcgcctcctttccactcgcctgcgtctcctcacctccccaccccgggcaccgcatctgctgcgcgatcccgtcgtcgtcctcgcgccgcaccgtcaaatcctcgccgctccgcgcgactaccgtcctctccagggaacgacggggcacggggcgtgtcgcgtccgtagtgtgcgctgtccaggccagggcacgagcancccagtccccgatgtgacaagtcaacattgccatcccttctggatcaaagccaactttctggtcctggttaagttctccggggctgggtgcgggccttgcaaaatgtaaaaaacagtttgttggcaagccttccaaaggactccnagggggaactgtaaatgctcccagcttaaaccccaattgagaccccggaattcccaaacccattagggggggccgggaatcccccccccgaattttctttcggagtgggggaaaaaaaaatttcttattatcggggcccggccaaaaagcccttggttcttctgcccccaaaaattttttgc

SEQ ID NO: 44488 - DNA, 708 bp, Zea mays
  misc_feature: Ceres CLONE 1446847-F
  misc_feature: Encodes the peptide sequence at SEQ ID NO. 44489
  misc_feature (385)..(385): n is a, c, t, g, unknown, or other
  misc_feature (391)..(391): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
ggagctccccgcggtggcggccgctctagaactagtggatcccccgggctgcaggaattcgcacgagaccattacctagaacatcctaatcgaaaaaatgcgtcctgttgcaatggcaccttcagtaggtcctcgcatgcccatgtttccacctagtgttcctggagttggtcagcagctgttttatggtcagccacctccagccttcatcaaccctcaggctggatttgctttccagcaacctatgatgcctggtatgaggcctggtggtccaatgccgaactttatgatgcctatggttcagcagggacagcaaccgcaacgtcctgctggtaggcgtgctgggtctggtggaatgcaccagcccatgggggtggggagtcancaacanatattccctanannnccccctggctaccgctatgctactggacgtggaatgcctgatcctggcatgcataatgttggtgctgtgatgccatctccatatgagatgggagggatggcaatgagagatgctggtgtctcacaacctgtttcaattgggggactaagccccgcgcttgctaacgcctcaccaaaaccacaaagattgatgtttggtggaaacttgtttcctcctgttgaacaactgaaccttgaccaggcttgctaggcccattggcatgctttttgaagaggaccaaaacgaggttcctcccttgctgg

SEQ ID NO: 44489 - protein, 185 aa, Zea mays
  misc_feature: Ceres CLONE 1446847-F
  misc_feature (96)..(96): Xaa is any aa, unknown, or other
  misc_feature (98)..(98): Xaa is any aa, unknown, or other
  misc_feature (102)..(102): Xaa is any aa, unknown, or other
  misc_feature (103)..(103): Xaa is any aa, unknown, or other
MRPVAMAPSVGPRMPMFPPSVPGVGQQLFYGQPPPAFINPQAGFAFQQPMMPGMRPGGPMPNFMMPMVQQGQQPQRPAGRRAGSGGMHQPMGVGSXQXIFPXXPPGYRYATGRGMPDPGMHNVGAVMPSPYEMGGMAMRDAGVSQPVSIGGLSPALANASPKPQRLMFGGNLFPPVEQLNLDQAC

SEQ ID NO: 44490 - DNA, 667 bp, Zea mays
  misc_feature: Ceres CLONE 1446850-F
  misc_feature: Encodes the peptide sequence at SEQ ID NO. 44491
ccccgcggtggcggccgctctatatctacgtggatcccccgggctgcaggaattcgcacgagaccattacctagaacatcctaatcgaaaaaaaaccttcgcgcggtgatggagcacgcgcacgcgacctcgacacgcacgcagcagccagcaggtgaccgccgtcacgcgaccgcttcccacactcccttccccaccagccgaaaccgaggctgacgctgcgcgagccaaccggcggtgatgcaggcggcagtcggccaccgcggcgccaaccttggctccccgtcactctcgcgcttccggtatggcttccgcctccccggccggtcccgcctcttctctgagggcgtggcggcggccccaccccgcggcgggggggtgccccagccacggaccccatggcagcggcccgcttcccgcaccttcggggccatgggtggggagggcccgaaggctgccccacgcccctccgggagaacgcttatcgatccttcaaacaaagggcatggccccacccttctgaaaagctggctgactttccaaccaagaacattgcattttggtcccctctggaggcctcaacggaaaatatggccacaccccccaaggctctttcccccgcaaagggccaatttttttttggctgcgacgcccaaataacgaaccc

SEQ ID NO: 44491 - protein, 89 aa, Zea mays
  misc_feature: Ceres CLONE 1446850-F
MAAARFPHLRGHGWGGPEGCPTPLRENAYRSFKQRAWPHPSEKLADFPTKNIAFWSPLEASTENMATPPKALSPAKGQFFFGCDAQITN

SEQ ID NO: 44492 - DNA, 703 bp, Zea mays
  misc_feature: Ceres CLONE 1446861-F
  misc_feature (391)..(391): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaagtttgccgttttctccctttacacgctcgattccccccgccgtttccacgggggccaggtgcctgcattactgggtccgggcctagcgtcagcgcaaccgaacacgccggcgaccgctgccgcccttctcccagctgcccaggtcttcgtcgggccctttgcctgcggcgtcggcgacgagcgcctgccacaccaggaatcccgttaagtttatttatgctcaccaatttaagggcagaacttacggacctcaagctcttggttactcctgatcttctctaggcgactnnagcacattgccctctggcaaaatgccatcagtttatctttacatccctaacatatcggggtatttaggatcatccaaaatttcatgcatttgccggttgctatcccaaaggcctccctttgcaaccggaactccacaactttgccttgaaggggggaagggttggtttccaagaaatttaatccaccccccccttgggagtggtttaaaaaggtaacaaaagggtaaccccccctttttttgggccccttccccccattttaaaaaccggggaaaacccccgaaaaaggggggagagaaaaaaaacaaccc

SEQ ID NO: 44493 - DNA, 714 bp, Zea mays
  misc_feature: Ceres CLONE 1446863-F
  misc_feature: Encodes the peptide sequence at SEQ ID NO. 44494
  misc_feature (303)..(303): n is a, c, t, g, unknown, or other
  misc_feature (321)..(321): n is a, c, t, g, unknown, or other
acccgcggtggcggccgctctagaactagtggatcccccgggctgcaggaattcgcacgagaccattacctagaacatcctaatcgaaaaagctaaccccagaccgcccaacaccagctccaccctcgccaccaaccgcccccgcaccacggccagaaccctagtcacttccccgccgcccactccatggaggacgacgccatctcgacgctcatggacatcgacgactcgccgctcagcgctgcggggggccggttccctcgacgaagaagacggggaagggccaaattgttcttcgccccnaccgggggggcccggggngggcttgggaaacccccggggcccccttccctttttcggtgttttaaaaggtttaaaggggcccatttttaaaaaaaaaaaccctccccaaagaaaaaccccccccggttttaaaaaaaaatttttttccggaaacccaaactggtttttcccaaccccgggggggggctctattaagggccccccttccaaccccgtggggggccccacaaaaatttttggggaaacactttcttttttggcctatgtggggggggcccccccccccggaaaataaaaaaatccttttctcccccccccggggagaaaacaacaagaagatgctcccccccccgttgttttgtttttccccccccccccaaaaaaaaaacaccccctttttaaaaaaaaaaa

SEQ ID NO: 44494 - protein, 68 aa, Zea mays
  misc_feature: Ceres CLONE 1446863-F
MEDDAISTLMDIDDSPLSAAGGRFPRRRRRGRAKLFFAPTGGARGGLGKPPGPPSLFRCFKRFKGAHF

SEQ ID NO: 44495 - DNA, 727 bp, Zea mays
  misc_feature: Ceres CLONE 1446865-F
  misc_feature: Encodes the peptide sequence at SEQ ID NO. 44496
  misc_feature (419)..(419): n is a, c, t, g, unknown, or other
  misc_feature (432)..(432): n is a, c, t, g, unknown, or other
  misc_feature (438)..(438): n is a, c, t, g, unknown, or other
  misc_feature (457)..(457): n is a, c, t, g, unknown, or other
  misc_feature (458)..(458): n is a, c, t, g, unknown, or other
  misc_feature (461)..(461): n is a, c, t, g, unknown, or other
  misc_feature (467)..(467): n is a, c, t, g, unknown, or other
aaagctggagctccccgcggtggcggccgctctagaactagtggatcccccgggctgcaggaattcgcacgagaccattacctagaacatcctaatcgaaaaatcgcgctctagggttttgacgcgccggcggcttgtgttccctttaaagcttggctgctcgtctgctcctgctgctgtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgntgaagtcaatggnaatgancagacagatattgaaatgnntgntatcangggaaacagtgttgtcatgatcgaagccactgaagcagttgccaaatcccaatgaatcttaatttttcagctgaattatccccgcatgaaaactgatgttaatgctatgagtgaaccctgttgtacttggaacccgtggtttgccaaaaaataaaatgggttacagaccccctggttcaaggggaccccaaaaaaaaaaaaaaagtttttcaatccccccccccaagggggggccgggacccatttccccaaaaggggaa

SEQ ID NO: 44496 - protein, 80 aa, Zea mays
  misc_feature: Ceres CLONE 1446865-F
  misc_feature (8)..(72): Pfam Name: LSM Pfam Description: LSM domain
  misc_feature (47)..(47): Xaa is any aa, unknown, or other
  misc_feature (53)..(53): Xaa is any aa, unknown, or other
  misc_feature (60)..(60): Xaa is any aa, unknown, or other
  misc_feature (61)..(61): Xaa is any aa, unknown, or other
  misc_feature (63)..(63): Xaa is any aa, unknown, or other
MSRSGQPPDLKKYMDKKLQIKLNANRVVIGTLRGFDQFMNLVIDNTXEVNGNXQTDIEMXXIXGNSVVMIEATEAVAKSQ

SEQ ID NO: 44497 - DNA, 686 bp, Zea mays
  misc_feature: Ceres CLONE 1446876-F
  misc_feature: Encodes the peptide sequence at SEQ ID NO. 44498
ccccgcggtggcggccgctctagaactagtggatcccccgggctgcaggaattcgcacgagaccattacctagaacatcctaatcgaaaaagcgtgtctcttcctccatcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcaagagatgtataaacaggggggagcggggggaggggctgggctggaccggaagcggatcaacgacgcgctggataagcatctcgagaaggcgggtcgcgtcgccgtccacgtcgagggggtcgggcccccggcgggcgcgaaccaccaccgccttctccggggccgccctccgggtcgtccctcccccaggggccgcctgcccccaaaggggagtctgaatttctgaatagtgaaaccttcggaaggttagcggcctctagaggaaaaaaacccccccatggattttcattggtatttgcaaccttaaaaagggaaatgaatttcttctttgtgaatcccaaccaatgatttttttttcaaaaaccaacttccaaccctttgtgtgagtcctccccagacccaaag

SEQ ID NO: 44498 - protein, 73 aa, Zea mays
  misc_feature: Ceres CLONE 1446876-F
MYKQGGAGGGAGLDRKRINDALDKHLEKAGRVAVHVEGVGPPAGANHHRLLRGRPPGRPSPRGRLPPKGSLNF

SEQ ID NO: 44499 - DNA, 590 bp, Zea mays
  misc_feature: Ceres CLONE 1446880-F
  misc_feature: Encodes the peptide sequence at SEQ ID NO. 44500
ccccgcggtggcggccgctctagaactagtggatcccccgggctgcaggaattcgcacgagaccattacctagaacatcctaatcgaaaaagtctctcgcccctctctcccaccccgcagccgccgcgcaggtagccctagcacccgcgacgagcaggacctgcccagttgctctttgagtagttcccccaactgtcaccatgcagaacgaggagggtaagactgtggacctctatgtccctaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttgaacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttgttgggttccttctgagtttgatgtg

SEQ ID NO: 44500 - protein, 81 aa, Zea mays
  misc_feature: Ceres CLONE 1446880-F
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVRAQGDADSSLNRLWQKKKADIKQ

SEQ ID NO: 44501 - DNA, 647 bp, Zea mays
  misc_feature: Ceres CLONE 1446885-F
  misc_feature: Encodes the peptide sequence at SEQ ID NO. 44502
tggcggccgctctagaactagtggatcccccgggctgcaggaattcgcacgagaccattacctagaacatcctaatcgaaaatctcatcaaccgcagtacacggcgtatcattcccagcgaccacgagagactagctagccaagtgcatgcaaccagccatgcaggccgggaagacggcagtggaggcgacgaaggaggccgcggccaacgtcggggcctcggcgaacgccggcatgcagaagacccgtgccgccgtgcaaggccaggtggagaaggccacggcgcgcaacgcgtcggacaaggtcgcggccgaagagcgccagcgggagcgcgtgcgcgccgcggagctcccccaagcaggacgcggggcgcgccaacgcggccgcgaaggaacgcgccattggcggcgcggccacgtaccagcacccgcacccgtcgcagggcgcgcccgggatcggcccccaacaggaatatggcggcgaaaaagtcccccccgcgggccggcaacttccagcccggcgtccgcaaaaacccgtcccggtcccttggggcccccgggaacggggcgggcccaacgcccccgcacaaacccctcggtggggagcgacattctcccagggcgggcgggccccggggggaaaatacc

SEQ ID NO: 44502 - protein, 58 aa, Zea mays
  misc_feature: Ceres CLONE 1446885-F
MAAKKSPPRAGNFQPGVRKNPSRSLGAPGNGAGPTPPHKPLGGERHSPRAGGPRGENT

SEQ ID NO: 44503 - DNA, 635 bp, Zea mays
  misc_feature: Ceres CLONE 1446888-F
  misc_feature (155)..(155): n is a, c, t, g, unknown, or other
  misc_feature (194)..(194): n is a, c, t, g, unknown, or other
  misc_feature (215)..(215): n is a, c, t, g, unknown, or other
  misc_feature (221)..(221): n is a, c, t, g, unknown, or other
  misc_feature (249)..(249): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (464)..(464): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (487)..(487): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
cccccgcggtggcggccgctctagaactagtggatcccccgggctgcaggaattcgcacgagaccattacctagaacatcctaatcgaaaattgtaaacagagttgatgctgaagaacactgcatgggttgaatggatcaactattgggaagcangcagtttgactttccctggggcgcagcccctgcagtaancagtctaggggtgattctggnccaccngcgcatgcaactgcaacgcatgtactancggacccattcacggtgaaatagctacccctcccaattcgcacccaaaattgaacccccggcttaaaaaacctccccttttttgggaacccccccctttccccttataatggggggggaaaaaccccccccccattttcccccccgaaaaaaaaaaattttcccccaaaaaaaacgcccnnnnnnnngggggggacggggggggggggggggggngnnnngnnngnnggggnnngggngggggnnnngggggnnnnnnnnnaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagggggcgaggaag

SEQ ID NO: 44504 - DNA, 604 bp, Zea mays
  misc_feature: Ceres CLONE 1446891-F
  misc_feature: Encodes the peptide sequence at SEQ ID NO. 44505
  misc_feature (604)..(604): n is a, c, t, g, unknown, or other
acccgcggtggcggccgctctagaactagtggatcccccgggctgcaggaattcgcacgagaccattacctagaacatcctaatcgaaaagcttctgcccctctgcggctctgctgcctgcggcctgcccctttttttattcccaaaaaaactcccatctcgcggcggaaagagagagaggagaggtgcgagctggtaagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcagacaatcatgcttatagctgcggctgcagcagctgcggcagccaccaaaggcagtgctgccactgctttttatcctcaatgagcacttctgtagcagctggacaagctcagggtggtgctgaccctagctcn

SEQ ID NO: 44505 - protein, 117 aa, Zea mays
  misc_feature: Ceres CLONE 1446891-F
MDRLEERNIKKGEREMEEARKEEERKEEAGDRNTQEPQQGQGLSLSLANGSDSGRSGMLPMSNPSANPTQLTIFYGGSVCVYDSVPPEKAQTIMLIAAAAAAAAATKGSAATAFYPQ

SEQ ID NO: 44506 - DNA, 612 bp, Zea mays
  misc_feature: Ceres CLONE 1446893-F
  misc_feature: Encodes the peptide sequence at SEQ ID NO. 44507
ggagctccccgcggtggcggccgctctataactagtggatcccccgggctgcaggaattcgcacgagaccattacctagaacatcctaatccaaaaatcccccggtgaggtgagcagaccacacctcccctccctctcgtgtcggagcctccgcctcggcttgtccccaccaacccgcagctcgctcccaccaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagcgaaactccatccagtgtggaacgaagtactgcagctctcagtacacatcctacgaagccagtgcaccttgaggtttttgatgaagacagttcacagcaaacgacagcatgggtgttgctgaaattcactttactgaactctacgatgcttgcaaactgaacctgaaacacgcctcctgatgggacaggattcaaaaccatcttccctggtccgaataaaacacccttggcgggaaaaagccatggg

SEQ ID NO: 44507 - protein, 75 aa, Zea mays
  misc_feature: Ceres CLONE 1446893-F
MASASKEEVIGKLNVRVVRGNNLVIADPLTHTSDPYVVLQYGAQKVKTSVQKRNSIQCGTKYCSSQYTSYEASAP

SEQ ID NO: 44508 - DNA, 615 bp, Zea mays
  misc_feature: Ceres CLONE 1446915-F
  misc_feature: Encodes the peptide sequence at SEQ ID NO. 44509
ggcggccgctctagaactagtggatcccccgggctgcaggaattcgcacgagaccattacctagaacatcctaatcgaaaaatgcccagttctccctgtccaccggccgccgcacttgctcgaccgccgccgccgccgtgcgcttaatcttacccctgtctgtctcctcatccagtgcaaggaacgcccaccgctgcctgtgtcgtttggtcaccggagatggatggggatgaggagaacgtcgggccgttccgccggactagcgcgcgcacgcgccgcatggccacgcgcatggcgtccgcgctcgccagctcggacaatcgcgcccaggtaacggctgcattagctcgccttgaagctcttgagagcgataatggtggggtcgaggtggtagatcttaatgatgatgagtacggatccacggatgaagaagaccctgttctcatgcaaaaaaagcagtccaagatcatgaaacgtaaaacaaggcaagggaaagctttggagaagagggcagcaagatcactcatggatgtgctacaagaagcaaatttggagtccgttcctcctcatgtgccaacatattcaagggctgctgtgggtccaccgagcacttca

SEQ ID NO: 44509 - protein, 132 aa, Zea mays
  misc_feature: Ceres CLONE 1446915-F
MDGDEENVGPFRRTSARTRRMATRMASALASSDNRAQVTAALARLEALESDNGGVEVVDLNDDEYGSTDEEDPVLMQKKQSKIMKRKTRQGKALEKRAARSLMDVLQEANLESVPPHVPTYSRAAVGPPSTS

SEQ ID NO: 44510 - DNA, 767 bp, Zea mays
  misc_feature: Ceres CLONE 1446929-F
  misc_feature: Encodes the peptide sequence at SEQ ID NO. 44511
  misc_feature (533)..(533): n is a, c, t, g, unknown, or other
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaaatagcctccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatgtggcggtggcggtgtggctgttgtggcagctgcccctgctgctggcggcgctcctgcagctgaggcgaagaaagaagagaatgtggaggagaaggaagaaagtgatgacgacatgggcttcagcctcttcgacntagcctgtgcaatagtcaagagtattgtttttgagtcgcggaagcagagggaaagaaaatcgtagtcatgtttggacttttactttgttttatgttgggaagtacttgaaagacttttcctgtggtaatcctangcgtaggttgctgtgctggttggggttactggtgaacagagtttttctatctccactatgatttgttacctcagttacctggatgtccctattttgtggg

SEQ ID NO: 44511 - protein, 132 aa, Zea mays
  misc_feature: Ceres CLONE 1446929-F
  misc_feature (17)..(110): Pfam Name: Ribosomal_60s Pfam Description: 60s Acidic ribosomal protein
  misc_feature (112)..(112): Xaa is any aa, unknown, or other
MKFVAAYLLAVLAGNSSPSAEDLTAILESVGCEVDNEKMELLLSQLSGKDITELIAAGREKFASVPCGGGGVAVVAAAPAAGGAPAAEAKKEENVEEKEESDDDMGFSLFDXACAIVKSIVFESRKQRERKS

SEQ ID NO: 44512 - DNA, 768 bp, Zea mays
  misc_feature: Ceres CLONE 1446932-F
  misc_feature: Encodes the peptide sequence at SEQ ID NO. 44513
ggagctccccgcggtggcggccgctctagaactagtggatcccccgggctgcaggaattcgcacgagaccattacctagaacatcctaatcgaaaattttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctgcctcatcctgctcacctactttgcggtcgtctccggactcgtgtacgaagtcatcgttgagccccctgggatcgggagcggcaaggaccccggactggccccttccgccccgtcgcttctttcagggcgcgtaaagggcagtactcatccagggactctcccccgggtcctggtccccctggaggggttggaataatcttcttaaactccccgtaaacgaaaaaggcccggaaccctcccgttccttttggaacccccggggaacccccttttgcttccctaaaccaaggggaagtgctttccccccgataaaaaacccggggtcccctggggagggggaaaaaattttgggggtaaaaaaaaaaaaacccgcgggagaaatcccggccctcaaaaaaaaccccccgcgctttaaaaggtagaaccgcccctctctcttgtttgaaaaagagagccccc

SEQ ID NO: 44513 - protein, 127 aa, Zea mays
  misc_feature: Ceres CLONE 1446932-F
MPPRSDHAAGSGAAAAATQAHFDSIDPLFHVLRVLPFSFLLPPRTRLRLPSNLALPSPMTVFCLILLTYFAVVSGLVYEVIVEPPGIGSGKDPGLAPSAPSLLSGRVKGSTHPGTLPRVLVPLEGLE

SEQ ID NO: 44514 - DNA, 749 bp, Zea mays
  misc_feature: Ceres CLONE 1446935-F
  misc_feature: Encodes the peptide sequence at SEQ ID NO. 44515
  misc_feature (749)..(749): n is a, c, t, g, unknown, or other
aagctggagctccccgcggtggcggccgctctagaactagtggatcccccgggctgcaggaattcgcacgagaccattacctagaacatcctaatcgaaaaaaatacattggattcctctgctaagtttcgtgcacccgctaaccctaggtttgctcgcgtaccctccccggtctatgttgcctcggtctagaaatcgacgcgttcttctcgcctgatgaaatcctcttctcgtctacatctaagcatgcctacacctgcggtttccagatcgggtgtttggtacgatcgagcaacggtgaatctcgctctgttatttgtttgttcgaaacgcgtggttctgtttttgagatgatgtgcaggttccgatctgattggtttgattgatgagtggcgaatcggattgaagcgagacgaggctgcatgatttccgtgatccgaggcttctgatctgcgtgtttgctccgagactattggtgcctgacccggcaaattgcaatctgccgaccttcagagctgggtcgttctggcgagatctagacgtcgaagggctattaaagcgtggctggatctttctgcaccgcgcctctcgatgatgtttctgtgttgataattattggatgaaatttcgataattattagatctgagagatgttggtcggagcgatccgcgcctaaatggcagggtaagttaacacatgtaactacagagttgcgtgtgtgaagtcaaaagagggggaagatactgan

SEQ ID NO: 44515 - protein, 45 aa, Zea mays
  misc_feature: Ceres CLONE 1446935-F
MKSSSRLHLSMPTPAVSRSGVWYDRATVNLALLFVCSKRVVLFLR

SEQ ID NO: 44516 - DNA, 768 bp, Zea mays
  misc_feature: Ceres CLONE 1446939-F
  misc_feature (204)..(204): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
aatgctggagctccccgcggtggcggccgctctagaactagtggatcccctgggctgcaggaattcgcacgagaccattacctagaacatcctaatcgaaaaatccacttctcacctcaatctcgcgagaagcgaagccggaggaggagggtgcgaggagatcgcgagcagccggagccggagccggagccggaggcctagtanatgaagacgttcgatccgtggccggtcttcttccgccgggagtggaagcgcaattggcccttcctcacggggttcgccatcaccggcttcatcatcactaagatgacggccaactttcccgaggaggacctcaaggactccaagttcgttctttttttcccccccgctgagagagggggaggattttnnnaacaccattccttccgcccccccccggatggcaaagccacaggaatggggtgggggcgggggccgacctgcctgtctgggccgcccggcaaggtttggccgcttgaagagagaaaagcctcccttctcctccctccaacgcggcgcacccactgccccccgcccccccggataatcaaatggcgaccggcctcgaccccacaccctccccgcctccgacctactgaggagtaactcctgttcttggcgtgggttagcacctagcccccccacatgccgactgagattttctcgcgcctgcgatgctcggcagcgccttctccggccttccctctccctctcgccctcgctcgctggcggccccgttcgacgcta

SEQ ID NO: 44517 - DNA, 758 bp, Zea mays
  misc_feature: Ceres CLONE 1446940-F
  misc_feature: Encodes the peptide sequence at SEQ ID NO. 44518
  misc_feature (694)..(694): n is a, c, t, g, unknown, or other
aagctggagctccccgcggtggcggccgctctagaactagtggatcccccgggctgcaggaattcgcacgagaccattacctagaacatcctaatcgaaaagacgcgacgcctcaaatcgctccctgcctctggtcacctcgcttccgctcccggctcccctccggccacccagacatcgtccgttcgctcgccaagagacaggaccggagaccatggcggaccagctcgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaaggagtcgatgagatgatccgcgaggccgacgtcgatggtgatggccagatcaactacgaggagttcgtcaaggtcatgatggccaagtgagtaaagcctgcggtaacggtatagtaccccgcnggaattgaagaagaaaccaaacgtgcatcccatattagaaaggcatgccagtcttgtttctttc

SEQ ID NO: 44518 - protein, 148 aa, Zea mays
  misc_feature: Ceres CLONE 1446940-F
  misc_feature (84)..(112): Pfam Name: efhand Pfam Description: EF hand
  misc_feature (11)..(39): Pfam Name: efhand Pfam Description: EF hand
  misc_feature (120)..(148): Pfam Name: efhand Pfam Description: EF hand
  misc_feature (47)..(75): Pfam Name: efhand Pfam Description: EF hand
  misc_feature: SWISSPROT Homolog: EC 2.7.11.1 Non-specific serine/threonine protein kinase
MADQLDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEGVDEMIREADVDGDGQINYEEFVKVMMAK

SEQ ID NO: 44519 - DNA, 770 bp, Zea mays
  misc_feature: Ceres CLONE 1446947-F
  misc_feature: Encodes the peptide sequence at SEQ ID NO. 44520
  misc_feature (323)..(323): n is a, c, t, g, unknown, or other
  misc_feature (362)..(362): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (629)..(629): n is a, c, t, g, unknown, or other
  misc_feature (770)..(770): n is a, c, t, g, unknown, or other
acagctggagctccccgcggtggcggccgctctagaactagtggatcccccgggctgcaggaattcgcacgagaccattacctagaacatcctaatcgaaaaaccactcgtccggtcgtccctgactcagccactcaggccactgacagcgaccaccggaatccgcatgctggcgctgatgaccacctcgtccgccttctccgcccctctcctttcgttccggccgccgcctcgcctccccgttatccgtctgcgcctccacccccgccgtcacgctctgttccgctgcgacgcggtgtccgagattgccccggccgcctcanccaccctacgggtcctcctcctgggcgggggtgtcttcncctccccccaggcggggggggaaggctccttctacgggggtctggctggaacttccctctgggcccctgccttttacctgatgccgccggccgggaaaatggnnncaggtgatgccgttggaatttggatcccgctttctattgcccggcgggtttggaacccgggggaaaaacccccgaagtgggggccctggggcttctttattacccttttttgggggggggggggggctcttttcctcccgtccccccgaaaaaagggggggnccccttttttttcttcacgctgaggaggcgggctcccctggcgcccctctttggaggcgcccccgttggggtgggcaccaaaaaaagaaaaacacgaaaccgcgcccccccccccctctttctcgggatgaaacgaaaaan

SEQ ID NO: 44520 - protein, 161 aa, Zea mays
  misc_feature: Ceres CLONE 1446947-F
  misc_feature (53)..(53): Xaa is any aa, unknown, or other
  misc_feature (66)..(66): Xaa is any aa, unknown, or other
  misc_feature (100)..(100): Xaa is any aa, unknown, or other
  misc_feature (101)..(101): Xaa is any aa, unknown, or other
  misc_feature (155)..(155): Xaa is any aa, unknown, or other
MLALMTTSSAFSAPLLSFRPPPRLPVIRLRLHPRRHALFRCDAVSEIAPAASXTLRVLLLGGGVFXSPQAGGEGSFYGGLAGTSLWAPAFYLMPPAGKMXXGDAVGIWIPLSIARRVWNPGEKPPKWGPWGFFITLFWGGGGALFLPSPRKKGGXPFFSSR

SEQ ID NO: 44521 - DNA, 743 bp, Zea mays
  misc_feature: Ceres CLONE 1446950-F
  misc_feature: Translation starting site: 184
  misc_feature (636)..(636): n is a, c, t, g, unknown, or other
  misc_feature (743)..(743): n is a, c, t, g, unknown, or other
aaagctggagctccccgcggtggcggccgctctagaactagtggatcccccgggctgcaggaattcgcacgagaccattacctagaacatcctaatcgaaaaaaattaaaccgccggcgcctccacttcgcgttctcgcctcatctcctcccgctcaggatccgccggcgaaggtaaggcaagatgtacaccgcgaggaagaagatccagaaggataagggccttgagccctctgagttcgaggactctgtcgcccaggctttcttcgacctggagaacggtaaccaggagctcaagagcgacctcaaggacctttacatcaacggtgctatccagctggatgttgccgggagcaggaaggctgttgtgatccacgtcccataccgcttgcgcaaggccttcaggaagatccatgtcaggatcgtcagggagctggagaagaaattcagcggcaaggatgtggtaattgttgccacaaggaggatcgtgcggccgcccaagaagggttcagctgttcagcgccctcgctccaggactctgactgctgtccacgatggcatcttggaggatgttgtcttcccagctgagattgtggggaagcgagtcaggtaccgtctggatggtgccaagatcatncagatcttcttggacccaaggagaggaacacaccgaatacaagctggacacctacactacggtctaccgcaggctgtgtggggaagatgtggtctttgagtaccctn

SEQ ID NO: 44522 - DNA, 746 bp, Zea mays
  misc_feature: Ceres CLONE 1446954-F
  misc_feature: Encodes the peptide sequence at SEQ ID NO. 44523
  misc_feature (515)..(515): n is a, c, t, g, unknown, or other
  misc_feature (537)..(537): n is a, c, t, g, unknown, or other
  misc_feature (539)..(539): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaacgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggacgaggacgacgagcaggccaagaccgccgacgtgttcggtgggcggaccggcggcggcggcctcttcggcggcgtccacggcccgctgggcggcggcgtcgctgggttcggcccgttcggcggggccgtcgccggcgcgggcccgttcggcgggttcggaggcggcgcgtcnggttggggggagagagaagaananaaggaggaacaggtgncgccggcgtcccgtgagtcttgaacaacgctgtgcatggccatggatgcatgcgtgcgtgcgcgtgtaataaggcgtgtctgtactctgtactgtacgtacatgccgtgtgcctgtccgctcttgtgatgaaggattgggcgtacgtatgtcggtatgtgcatgcatgtgggtcgtcactcgtcagccatc

SEQ ID NO: 44523 - protein, 123 aa, Zea mays
  misc_feature: Ceres CLONE 1446954-F
  misc_feature (111)..(111): Xaa is any aa, unknown, or other
  misc_feature (117)..(117): Xaa is any aa, unknown, or other
MAAKWWLVASLLLCLAVASAAARATPRDCDTTAAFAAGDGSAGAVDEDDEQAKTADVFGGRTGGGGLFGGVHGPLGGGVAGFGPFGGAVAGAGPFGGFGGGASGWGEREEXKEEQVXPASRES

SEQ ID NO: 44524 - DNA, 783 bp, Zea mays
  misc_feature: Ceres CLONE 1446959-F
  misc_feature: Encodes the peptide sequence at SEQ ID NO. 44525
  misc_feature (400)..(400): n is a, c, t, g, unknown, or other
aaagctggagctccccgcggtggcggccgctctagaactagtggatcccccgggctgcaggaattcgcacgagaccattacctagaacatcctaatcgaaaaatctatcttcgtgaggaccttcaaccatctcaggcggaatggcggcttctggtgagggcgcgtcgctgccgtctccggcgggcggggaggatgcgcaccgccgccgcgtcagctatttctacgagccgtcgatcggagactactactacgggcaaggtcacccgatgaagccccaccgcatccgaatggcgcactcgctggtggtccactacggcctccaccgcctcctcgagctctcccgcccctacccggcctctgaggccgacatccgccgcttccactccgacgactacgtcgncttcctcgcgtccgccaccggaaacccgggtgtcctcgaccccgcgcgcattaagcgctttaacggtcgtgaagactggcccgttgttcaaggttctcttcccttttggccaggctcccctgggggaaggatccggcccgccgtcaaggttaacggggggaacccgaaattcccgtaaatgggggggggggcccccccccccccaaaaaaaagggggcccccgggttttgttttataaaaaaaaatgtcccccccttcccaaaaccctcaaaatcccacggggggggggatatttggaactttttgtccccccccggggaggggggggaggagagggtttcttctcaaaaaaaagggggtgggggtgtttttttttccaaagg

SEQ ID NO: 44525 - protein, 145 aa, Zea mays
  misc_feature: Ceres CLONE 1446959-F
  misc_feature (87)..(87): Xaa is any aa, unknown, or other
MAASGEGASLPSPAGGEDAHRRRVSYFYEPSIGDYYYGQGHPMKPHRIRMAHSLVVHYGLHRLLELSRPYPASEADIRRFHSDDYVXFLASATGNPGVLDPARIKRFNGREDWPVVQGSLPFWPGSPGGRIRPAVKVNGGNPKFP

SEQ ID NO: 44526 - DNA, 822 bp, Zea mays
  misc_feature: Ceres CLONE 1446961-F
  misc_feature: Encodes the peptide sequence at SEQ ID NO. 44527
  misc_feature (389)..(389): n is a, c, t, g, unknown, or other
ggagctccccgcggtggcggccgctctagaactagtggatcccccgggctgcaggaattcgcacgagaccattacctagaacatcctaatcgaaaaactcactctattcccattccaagcccccgctctcggattcccgacgacgagctcagagctcctcctctcctcccctgctcggtgttcgacgcaacagctgccgccatgtctgccgccaaccagctcgccgccctcttcagcaacatgtacgccacgggtttgcttgacgatcagttccagcagctccagatgctccagaacgccagtactcctgacttcgtctccgaggtcgtcacgctcttctgccaggacggcgagcggatcatcggacagctggccaaactgctggaaanccccaccgtgaaatttgacccggttgacgcctttgggcatcagctcaaaggaagcagtgcaagtttttggtgcccaaaaaggttaaaaacccttgcattccgttcccccgaatccctgccccaaaaaaacaaaaaatgggggcctccagaaccctgggaacacgggaaaaattaactttctggacccggggggaaaagttttcaaaccctggttttactttgtagaggtaggggtaaggggtttccccccccccaaggggagaaaaaaaggggggagaggaggcctctcctgtggggagagaggggggggttttttggggtgctccaaaaattttaaaaaaacccccctttgtggtttttcgaagagggttgtatattcttcttcccccaaattttttgttccaccccctcccaaaaaaaataatatgtcttt

SEQ ID NO: 44527 - protein, 120 aa, Zea mays
  misc_feature: Ceres CLONE 1446961-F
  misc_feature (63)..(63): Xaa is any aa, unknown, or other
MSAANQLAALFSNMYATGLLDDQFQQLQMLQNASTPDFVSEVVTLFCQDGERIIGQLAKLLEXPTVKFDPVDAFGHQLKGSSASFWCPKRLKTLAFRSPESLPQKNKKWGPPEPWEHGKN

SEQ ID NO: 44528 - DNA, 747 bp, Zea mays
  misc_feature: Ceres CLONE 1446963-F
  misc_feature: Encodes the peptide sequence at SEQ ID NO. 44529
  misc_feature (407)..(407): n is a, c, t, g, unknown, or other
  misc_feature (417)..(417): n is a, c, t, g, unknown, or other
aacgctggagctccccgcggtggcggccgctctagaactagtggatcccccgggctgcaggaattcgcacgagaccattacctagaacatcctaatcgaaaaacgaaacatagctactcctactactcaaatccatccttattgagcttagtgtttgatccatggactcggaaggagtagcagcaaaggtggcagatgagactactaaaccggcaagccaagaagacggcgagagcaaggccgggatgactgatctgctgatgctgaccgacaagtcgcagctgcaggcgctagcgatgctgctgcggaacaacgaggagctcatgatgagccaagcgatcaagtcggagacggagcgcgttgagtatctcaccacccccagcgacggggagagggggacaatgaanctccttgacnactccatgggggccaggatcaagtacgaacgttcgggcggaacgaggagcctcctccccccgggacatggacgactacgtcgtctacggcctcaacgcgtgcttgcagaacatccccaactgctggctgggtctgaaccccatcgacaaactgcgggcgcactacaaccccctcccccaagccatccccaaaacggcggcaaagttgaggggctccccccggaagggtccaaaaaaagcccccatgggcggtttgctacaacaccggaacgctccccgcgggggcaatccctggctaatccaggaggtagattgaagggaccattttccg

SEQ ID NO: 44529 - protein, 195 aa, Zea mays
  misc_feature: Ceres CLONE 1446963-F
  misc_feature (82)..(82): Xaa is any aa, unknown, or other
  misc_feature (86)..(86): Xaa is any aa, unknown, or other
MDSEGVAAKVADETTKPASQEDGESKAGMTDLLMLTDKSQLQALAMLLRNNEELMMSQAIKSETERVEYLTTPSDGERGTMXLLDXSMGARIKYERSGGTRSLLPPGHGRLRRLRPQRVLAEHPQLLAGSEPHRQTAGALQPPPPSHPQNGGKVEGLPPEGSKKSPHGRFATTPERSPRGQSLANPGGRLKGPFS

SEQ ID NO: 44530 - DNA, 743 bp, Zea mays
  misc_feature: Ceres CLONE 1446964-F
  misc_feature: Encodes the peptide sequence at SEQ ID NO. 44531
agctccccgcggtggcggccgctctagaactagtggatcccccgggctgcaggaattcgcacgagaccattacctagaacatcctaatcgaaaaaaggagagggagagggagaggaagcgagcggctgggcgccccaagccccacatggtgcagcgaggtccacgctaacaacttctcgaccttggcctcccacggctctgccgcattgccgcgcgccgccggccggcactcgccgtcctgacgcgagaaggaagatgctctaggaagttgggggcctggctagggacagcctgtgtcccgccgtgggatcggtggaagagcgggaggcaggcatgtgtgatctggtggcccgcacgggccggcacctgcagcgctacgagaacggccatcgccttgtggccgggtgcataccattcagatatagggatattaatgatggagcttctgatgatgaacaaaagaaacttgttgaagttctcatgatcagctcccaaagtggaccgggtcttctatttccaaagggaggctgggagaatgatgaaactgttgaagaagcagctgcaagggaagctatcgaagaagctggagtgcgaggagatttagtgcaactgctgggggtctacgatttcaagagcaagcagcccgaagcaacgtgcagggccgcaatctttcgccctgcacgtgaaggaagagctagcatcctggccagaacagagcacccggcagaagagctggctcacgt

SEQ ID NO: 44531 - protein, 136 aa, Zea mays
  misc_feature: Ceres CLONE 1446964-F
  misc_feature (19)..(136): Pfam Name: NUDIX Pfam Description: NUDIX domain
  misc_feature: SWISSPROT Homolog: EC 3.6.1.52 Diphosphoinositol-polyphosphate diphosphatase
MCDLVARTGRHLQRYENGHRLVAGCIPFRYRDINDGASDDEQKKLVEVLMISSQSGPGLLFPKGGWENDETVEEAAAREAIEEAGVRGDLVQLLGVYDFKSKQPEATCRAAIFRPAREGRASILARTEHPAEELAH

SEQ ID NO: 44532 - DNA, 764 bp, Zea mays
  misc_feature: Ceres CLONE 1446965-F
  misc_feature (481)..(481): n is a, c, t, g, unknown, or other
  misc_feature (485)..(485): n is a, c, t, g, unknown, or other
  misc_feature (649)..(649): n is a, c, t, g, unknown, or other
  misc_feature (761)..(761): n is a, c, t, g, unknown, or other
aagctggagctccccgcggtggcggccgctctagaactagtggatcccccgggctgcaggaattcgcacgagaccattacctagaacatcctaatcgaaaacccgccatgtgcgtgccgcttttgacagaagaggacgaggcagatctccagtccccggccctccgtcccctcctcctgcgaaggctcctccagcaccactagctagagctaaccccgtgctgctgctgctgctactacctgctgccgcgcgccgttcgttgccgtgcgggcgtgttgtggtccgctgatctcgttcgcgggacgccggggggtggtggtggtggcagcggtggttggtggtgcgcggcgtgaaagaaagaaagaaaaaaaaaaggcccgccgctttgcgctgctctgcttccgtaggtgtcacgagatttggccctagcctttcgctttcctttttcatctcgctcacaagggaagggaccgagggacangggnaaaaacgttggggaggggagcgagcgagccgtaacatccgagctgttccaatggcgacccctgccgttgctttcgtcgccagcgctttgttggggcggtggtagcgctaggagcggagcagtactaggttggtaggtgggtgtagctttgcgcgtgacccgagngcgcgctcgctcgctcctgtgcctctctacctcgcttgcgtgcgccgggaaagcagtgggtggctggtccgttctcgccagaaggtgctgggggctgtcctcctcccccggntga

SEQ ID NO: 44533 - DNA, 747 bp, Zea mays
  misc_feature: Ceres CLONE 1446966-F
  misc_feature: Translation starting site: 163
  misc_feature (423)..(423): n is a, c, t, g, unknown, or other
  misc_feature (494)..(494): n is a, c, t, g, unknown, or other
ggagctccccgcggtggcggccgctctagaactagtggatcccccgggctgcaggaattcgcacgagaccattacctagaacatcctaatcgaaaaatattccctacgcctcgctagcgccttccgcgaactgaggtctcccgagaggccgagaccaccccgatgtccgccatggagaccgacatcaacgcgccgccgcccgccccagccggcgagggatcctccgtggtcggtccgtcctcctcatcctcccgcaagcccaacaagcgcttcgagatcaagaagtggaacgccgtcgcgctctgggcatgggatatcgtcgtcgacaactgcgccatctgccgcaacacatcatggatctatgcatcgagtgccaggcgaaccaagctagcgcgaccagcgaggagtgcactgtcgcttggngtgtctgtaatcatgcttttcacttccactgcatcagcaggtggcttaagactcgccaagtgtgcccattnagatacagtgagtgggagttcagaaatatggccactagttcctgggcaccgtcatgtgatgttggggctttgctgcaactcagaagtgtttttgtctgccaacagctccatcttctactgctttcgatgcttgcatccatcactcgtcaattatactagctagcagtacgtccacctgggatgggatttggatgattcatggaaaggatggaagcccattttaccatggtaatgtggatcttcctaaaaaaaa

SEQ ID NO: 44534 - DNA, 768 bp, Zea mays
  misc_feature: Ceres CLONE 1446967-F
  misc_feature (361)..(361): n is a, c, t, g, unknown, or other
  misc_feature (402)..(402): n is a, c, t, g, unknown, or other
ggagctccccgcggtggcggccgctctagaactagtggatcccccgggctgcaggaattcgcacgagaccattacctagaacatcctaatcgaaaaaatccctcccaccaccaccagattcgcctcgcctcctcgacgcccctccctcacccttgatgccacgcccccctcccatggcgccacgcccgcgcccctccccacccgcccgagccgcgacgctgaccctcctcctcccgctcctcctcctcgcctctccgtccctcccctccgccgccgctgccccctcgccgccgacggtgcccgccacgcagcggcaggccgcgtccgcgtccgacgccccgtcccctcctccccctccggngcagcagcacccgcggaggcaccgccaccggcactggaagnaccggccgtctgccctcgcacccgccgccgcccgccaggcggcgtcggctcgacttcggggagcggctcgggatcgccttcgcccgggtggctatcgcaatgcaagtcgtccctcggcgccttcctcgcgctgcgcgcgtggcacctgcggcggctccacaaggccgaggtgtcctcctccaggcccttatcttgaccaccgtctccccgcccaaagctcgtcgtgtgcatccagtcaagtccggtggtttattttgggatccgaacctgatgctgccgaaaaacaaaccatgggtgaaaaaacctgcgcctggtcccgtgttcgcgacccattcctttccggtccgtgtggaacaaacccgggaa

SEQ ID NO: 44535 - DNA, 760 bp, Zea mays
  misc_feature: Ceres CLONE 1446968-F
  misc_feature: Encodes the peptide sequence at SEQ ID NO. 44536
  misc_feature (354)..(354): n is a, c, t, g, unknown, or other
  misc_feature (372)..(372): n is a, c, t, g, unknown, or other
  misc_feature (386)..(386): n is a, c, t, g, unknown, or other
  misc_feature (403)..(403): n is a, c, t, g, unknown, or other
  misc_feature (478)..(478): n is a, c, t, g, unknown, or other
  misc_feature (606)..(606): n is a, c, t, g, unknown, or other
  misc_feature (695)..(695): n is a, c, t, g, unknown, or other
ctggagctccccgcggtggcggccgctctagaactagtggatcccccgggctgcaggaattcgcacgagaccattacctagaacatcctaatcgaaaaaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaagggacagttataaagacggattncacgaatattttaatcangcatctccagttgnaacagcagaagactganggcaaagatgtggattccagaattgtcggcgaaaaccacagagggaaaagatctgctgccagaagtttggatgtncaacattcagcaaagaaggctaacttgggtacttcatctggatcatcagcctatgaggaaatttctggcttttcacaacacacactgcagtcatttacagtggagagattgcgtgcacttctacgacnaagtggtccatcgaccaagggcaaaaggatgaactgattgctcgcttacggaagtcccagggttgacatgaatctggtacttgtttagncaaccaaaccctttcgggcagggtacccgacccaatgagtccctggctggtactggcaatgggtg

SEQ ID NO: 44536 - protein, 175 aa, Zea mays
  misc_feature: Ceres CLONE 1446968-F
  misc_feature (80)..(80): Xaa is any aa, unknown, or other
  misc_feature (86)..(86): Xaa is any aa, unknown, or other
  misc_feature (91)..(91): Xaa is any aa, unknown, or other
  misc_feature (96)..(96): Xaa is any aa, unknown, or other
  misc_feature (164)..(164): Xaa is any aa, unknown, or other
MPTEEGSDGGGGAGAGAGEKKSSQAPAKPGACGAAKFLAGLPSRGNFSSGSAPSNLGGFRVYVCEHSTDPPEGTVIKTDXTNILIXHLQLXQQKTXGKDVDSRIVGENHRGKRSAARSLDVQHSAKKANLGTSSGSSAYEEISGFSQHTLQSFTVERLRALLRXSGPSTKGKRMN

SEQ ID NO: 44537 - DNA, 729 bp, Zea mays
  misc_feature: Ceres CLONE 1446969-F
  misc_feature: Encodes the peptide sequence at SEQ ID NO. 44538
  misc_feature (369)..(369): n is a, c, t, g, unknown, or other
  misc_feature (561)..(561): n is a, c, t, g, unknown, or other
ggagctccccgcggtggcggccgctctagaactagtggatcccccgggctgcaggaattcgcacgagaccattacctagaacatcctaatcgaaaaccagctggaggtctcgctgttcccttcacgatacgcccccccaaagcggatcaaaccctagatctcgtcttgtcgccccgttcctccgatcccatcctatccgatcctcatggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgttgacttcaaggngaaaatggttagcattggtggcaaaaaactcaagcttgccatctgggacacagctggacaagagaggtttaggaccttgaccagctcttactacagaggggcacaggggatcattatggtgtatgatgtcagtcgacaagagacgttcaccaaatctttctgatatatggggccaacgaaaattgacctgtnttcaaccaaccaggactgtgttaagaagcttgttggaaataaagtagaccaggaaaagtgggagggctgtcccgaaaaaaggaggggaatttgaattttgccgggaaataccggttgtttggttttctagaaatggcaggtgcgaaaaacaaaaagttaacctgtaaa

SEQ ID NO: 44538 - protein, 108 aa, Zea mays
  misc_feature: Ceres CLONE 1446969-F
  misc_feature (19)..(109): Pfam Name: Ras Pfam Description: Ras family
  misc_feature: SWISSPROT Homolog: EC 2.7.11.1 Non-specific serine/threonine protein kinase
  misc_feature (55)..(55): Xaa is any aa, unknown, or other
MDSSSSSLSQQPEFDYLFKLLLIGDSGVGKSSLLLRFTADSFDDLSPTIGVDFKXKMVSIGGKKLKLAIWDTAGQERFRTLTSSYYRGAQGIIMVYDVSRQETFTKSF

SEQ ID NO: 44539 - DNA, 826 bp, Zea mays
  misc_feature: Ceres CLONE 1446970-F
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (79)..(79): n is a, c, t, g, unknown, or other
  misc_feature (325)..(325): n is a, c, t, g, unknown, or other
  misc_feature (328)..(328): n is a, c, t, g, unknown, or other
  misc_feature (329)..(329): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (826)..(826): n is a, c, t, g, unknown, or other
nnttaaaccnnnaaaaaaaacatctccacccggtggcggccgctctagaatagtggatcccccgggctgcaggaattcncacgagaccattacctagaacatcctaatcgaaaactatgaccaattgggaccccctgtaagtggcagcagtcggcctcttgtgaacaaaatgatgcaaagcaaagagttgtttgaggctacaatccggcagccatgcttctgcgatactccatttgttctggttctgaacaagtacaaccttttcgaggagaagatcaaccgcgcgcctctctctattttctaccggatgaaagacttctgcccngtnncttattttttttaacaaccaggcgcttggttcatccacgctttttttttttcccccacacccgggaaaaagaaaagggannnnnnnnnnnnnnnnnnccccccctctttttccaaaaacaaaaaaaaaaaacccccctctggggggggggggggtcttcttatatatttaaggtttctcaacgtgaagtaagacaaccaatcccacctccccccaccgttaattatcccccctccccccctttaataacctccctcccccctcctcactattctaactcaaaattctttctttgtctgccgacgcttgctctcccagtctaatcgctcccccacactctgtgtacacaccatgcgctctcccatctatcataccactctcgtcctcgtcttcatgcctcccttccaactctccctcccatttatgcgctctctatcagactgtcgggctccaagcacatctcacccgagatgcacgatgcgcgtctctccaccctcn

SEQ ID NO: 44540 - DNA, 760 bp, Zea mays
  misc_feature: Ceres CLONE 1446971-F
  misc_feature: Encodes the peptide sequence at SEQ ID NO. 44541
  misc_feature (414)..(414): n is a, c, t, g, unknown, or other
  misc_feature (499)..(499): n is a, c, t, g, unknown, or other
  misc_feature (568)..(568): n is a, c, t, g, unknown, or other
  misc_feature (583)..(583): n is a, c, t, g, unknown, or other
  misc_feature (720)..(720): n is a, c, t, g, unknown, or other
ggagctccccgcggtggcggccgctctagaactagtggatcccccgggctgcaggaattcgcacgagaccattacctagaacatcctaatcgaaaaaatttcttcatctggtggtcttcttgttcaatccccatctcgatcagggaggccaccaaccaccatatggcgggagggaaggtttactcgttcgaggaggtgaggaagcacagcgaccgcaaggactgctggctcatcatcgccggcaaggtgtacgacgtcacgccgttcatggaggagcaccccggcggcgacgaggtcctgctggcgtccgtcggcaaggacgccaccgcggactttgaggacatcggccacagcgcctccgccaaggagctcatgccccagtactgcatcggcaaggtcgacgcggctaccttnccggccaagcccgcctacgtcgtcaccaaggacgacgccaggtcgtccgagaaggccgcgacgagcgccggcgctttggcacgcntctgcagctcgccgcgcccgtcctgctgctggcgctggccttcgcgctgcagcagaactatgccagggnccaggcggagtagancagataccgatagataccatcgttgattccgctgagtcgcggccgtgcggcctctttgaagcatctgaattacattttctcctggcaaattaactactcgtggttttcgtacttttcgaataagggtaacattttcntccctggcgaaaaaaaaaaaaaaagcttatcgatccgtcc

SEQ ID NO: 44541 - protein, 148 aa, Zea mays
  misc_feature: Ceres CLONE 1446971-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (84)..(84): Xaa is any aa, unknown, or other
  misc_feature (113)..(113): Xaa is any aa, unknown, or other
  misc_feature (136)..(136): Xaa is any aa, unknown, or other
  misc_feature (141)..(141): Xaa is any aa, unknown, or other
MAGGKVYSFEEVRKHSDRKDCWLIIAGKVYDVTPFMEEHPGGDEVLLASVGKDATADFEDIGHSASAKELMPQYCIGKVDAATXPAKPAYVVTKDDARSSEKAATSAGALARXCSSPRPSCCWRWPSRCSRTMPGXRRSRXDTDRYHR

SEQ ID NO: 44542 - DNA, 843 bp, Zea mays
  misc_feature: Ceres CLONE 1446972-F
  misc_feature: Encodes the peptide sequence at SEQ ID NO. 44543
  misc_feature (522)..(522): n is a, c, t, g, unknown, or other
  misc_feature (576)..(576): n is a, c, t, g, unknown, or other
  misc_feature (593)..(593): n is a, c, t, g, unknown, or other
  misc_feature (662)..(662): n is a, c, t, g, unknown, or other
  misc_feature (672)..(672): n is a, c, t, g, unknown, or other
  misc_feature (675)..(675): n is a, c, t, g, unknown, or other
  misc_feature (758)..(758): n is a, c, t, g, unknown, or other
  misc_feature (759)..(759): n is a, c, t, g, unknown, or other
  misc_feature (762)..(762): n is a, c, t, g, unknown, or other
  misc_feature (782)..(782): n is a, c, t, g, unknown, or other
ggagctccccgcggtggcggccgctctatactagtggatcccccgggctgcaggaattcgcacgagaccattacctagaacatcctaatcgaaaaaatttcttcatctggtggtcttcttgttcaatccccatctcgatcagggaggccaccaaccaccatatggcgggagggaaggtttactcgttcgaggaggtgaggaagcacagcgaccgcaaggactgctggctcatcatcgccggcaaggtgtacgacgtcacgccgttcatggaaggagcacccccgggcgggcgaaaaaaaaggcccttggttggggggtccctcctcggaaaaaggagacccccccgcggggaaaaattttttgggagaaatttgtgtcaaaaggtgtgttttgttggggggggaacattgtggcgcgttgttgtgtgtaactaagggggaggaaaacccccccccccgggtttttggtgaagaaaccccctttattattttttttctcaggagaaaaaaaccaccccccccnccccccacaacaaaacccccccacacaaaaaccacgccgcctttggttgggggngtatttctattctattnttcactttacgcgcccacccccgttcttttggtgagcgggaggtctccccccccccccgcccggacaanaaaaaatatntcncgaggaggccgcgggcgcgcacaacaaaaacacaaaacaaacaaaaccgcacaccgccacttctcactctcaccttatcaatnnccncaggaaagaaaggcccctcnttttcgcccgacaagagcgagagtagtatttatatctcacgccgaacgagcacaaaaaaag

SEQ ID NO: 44543 - protein, 90 aa, Zea mays
  misc_feature: Ceres CLONE 1446972-F
  misc_feature (6)..(72): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MAGGKVYSFEEVRKHSDRKDCWLIIAGKVYDVTPFMEGAPPGGRKKRPLVGGSLLGKRRPPRGEKFFGRNLCQKVCFVGGGTLWRVVVCN

SEQ ID NO: 44544 - DNA, 752 bp, Zea mays
  misc_feature: Ceres CLONE 1446973-F
  misc_feature: Encodes the peptide sequence at SEQ ID NO. 44545
  misc_feature (445)..(445): n is a, c, t, g, unknown, or other
  misc_feature (455)..(455): n is a, c, t, g, unknown, or other
  misc_feature (540)..(540): n is a, c, t, g, unknown, or other
  misc_feature (549)..(549): n is a, c, t, g, unknown, or other
tggagctccccgcggtggcggccgctctagaactagtggatcccccgggctgcaggaattcgcacgagaccattacctagaacatcctaatcgaaaattcggaggctttatttatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaaggctgaagagaggcacatagaaatacttggctatctcctctatgttgccaaggttgttgcgaagcangaaggacttngagatggctatcgcgtcgtcatcaatgacggccccagtggatgtcaatctgtttaccacatccacgttcatctccctcggagcanggcaatganctggcccccaagctaagaatatcttgtgattgatcagtgctaatggcaaggactgctactccatttctctagaataatccctgtaatttccataaaagctagtgcgcagtgcgctgaccttgtgctatatttgtgaaataccggaagcatgctgctgtgatctatgatgaacccaagaacttgtaactggtactcctatcaaa

SEQ ID NO: 44545 - protein, 129 aa, Zea mays
  misc_feature: Ceres CLONE 1446973-F
  misc_feature (25)..(123): Pfam Name: HIT Pfam Description: HIT domain
  misc_feature: SWISSPROT Homolog: EC 3.6.1.17 Bis(5'-nucleosyl)-tetraphosphatase (asymmetrical)
  misc_feature (90)..(90): Xaa is any aa, unknown, or other
  misc_feature (94)..(94): Xaa is any aa, unknown, or other
  misc_feature (122)..(122): Xaa is any aa, unknown, or other
  misc_feature (125)..(125): Xaa is any aa, unknown, or other
MSSEKEAALAAVLDDSPTIFDKIIKKEIPSTVVYEDEKVLAFRDINPQAPTHILIIPKVKDGLTGLAKAEERHIEILGYLLYVAKVVAKXEGLXDGYRVVINDGPSGCQSVYHIHVHLPRSXAMXWPPS

SEQ ID NO: 44546 - DNA, 759 bp, Zea mays
  misc_feature: Ceres CLONE 1446974-F
  misc_feature: Translation starting site: 247
  misc_feature: SWISSPROT Homolog: EC 3.5.4.5 Cytidine deaminase
  misc_feature (336)..(336): n is a, c, t, g, unknown, or other
  misc_feature (349)..(349): n is a, c, t, g, unknown, or other
  misc_feature (362)..(362): n is a, c, t, g, unknown, or other
  misc_feature (373)..(373): n is a, c, t, g, unknown, or other
  misc_feature (376)..(376): n is a, c, t, g, unknown, or other
  misc_feature (456)..(456): n is a, c, t, g, unknown, or other
  misc_feature (457)..(457): n is a, c, t, g, unknown, or other
  misc_feature (568)..(568): n is a, c, t, g, unknown, or other
tggagctccccgcggtggcggccgctctagaactagtggatcccccgggctgcaggaattcgcacgagaccattacctagaacatcctaatcgaaaactctctcttctcatccctcgtggtcgcgtggtcctgggtgctggcctcttccaagctccaaggaacatccaaagcacatccgtgttacgagttcggagactaaacgcgattaagagtactggtagcctagttacagttggatctgagcgatgggggaggagcaggtggtggcgccaaagccggaggccgccgcccgcgccccgcgcacgtcggtggagctgacggggttcgttatgggncgcgaagacgccnagcgcgccgcggncgccgcccgcntancgaccgtccagaacctgctgccgctcctggtcccgtcccgcgagaagcgcgcgcaggtcccgatctcggggttccccgtnnggcgcgtggggctgggcgccagcggcccgcgtctacgtcgcgtaaacctcgagttccgcggcctcccgctgtgccactcccgtccacgccgagcagttcctcgtcgccaangcggccgcggcgggggagcccaagctgcgcgccgtcgcgttctcccaaatgccctggggccactgccgccagttcctgcaagaaatacgcggggccgccagcatccgaatcctcgtgacaagcgacgcccctgaaggatgccccacccgagtgggcccacggtggcgtcctccctcctccgcccctttggg

SEQ ID NO: 44547 - DNA, 767 bp, Zea mays
  misc_feature: Ceres CLONE 1446976-F
  misc_feature: Translation starting site: 173
  misc_feature (445)..(445): n is a, c, t, g, unknown, or other
  misc_feature (513)..(513): n is a, c, t, g, unknown, or other
  misc_feature (543)..(543): n is a, c, t, g, unknown, or other
  misc_feature (717)..(717): n is a, c, t, g, unknown, or other
aagctggagctccccgcggtggcggccgctctagaactagtggatcccccgggctgcaggaattcgcacgagaccattacctagaacatcctaatcgaaaagactctggactggagggcaccaagctaacatttagttgcaaaggagcgctaggaagaagaagcaacgagccatggcctccggtggcccgaaacccaaactggcctacatcatcttgtacgtgagggacgtggagaaggccgcctccttctacgacgccgccttcggctacaccgtccgccgcctcgaccagtcccgcaagtgggcggagctggagagcggggcgacgaccatcgcgttcacgccgctgcaccagcgggagacggacgagctgtcggggggcggtgcagctgccggactcgtcagccgccgggaggggctccgtagaggtctgcttcgcctacgncgacgtcgacgcggcgtacaagcgcgccgtggacaacggggccgtggccgtgagcgcgccggaagacnaagcctggggccagaagtccggcttcgtgncggacatggacgggcacatcgtgcgcatcgcgagctacgtgcgagagtagtcgcattccgctgcatcaccatcggtcgatcgatcagcctttccatgcatgtctcgtatactacacgtctacacgtgtaccaaaaaaataatataaatcgtgtgcaggtcatgtttgtcttggnagaagtaggaccgtgaagatgttaatggaaccgtggagccatgatacaaa

SEQ ID NO: 44548 - DNA, 714 bp, Zea mays
  misc_feature: Ceres CLONE 1446979-F
  misc_feature: Encodes the peptide sequence at SEQ ID NO. 44549
ctggagctccccgcggtggcggccgctctagaactagtggatcccccgggctgcaggaattcgcacgagaccattacctagaacatcctaatcgaaaaatagaagccgccactcacgcctggaagcatctggaggcgtggcacggcagccgtcgcccgccacaccagcagcgaactgcttcccggtgcccgcggcggcgaagcacaggagagaggcggcgagtgaaaccgatgacgccgccgatggatccgcccgacgtcgagatggagatggagcccgcgccccagcctccggctccgacagcggtcggggaggggtggagcatgctgtcgcgcgcccgcgggctgctcgaggagggcaaaccgtccctcgctctgcaggcggttctcttggccataagaatctcaaagcggtgaacaagctctcatgcaaacattgaaccgtgcacgtgaactctatgcacagagattgcaagccagtcctagtggtgatgagcttgcctctttgcttgcccaatgtggccataccagaggctcagtcatcaaatactaaccctccacaagggccctgggtcagaccctgtcaatatgctgaatttctgatgaggcctgcattcttgctgagagtggaaggaagcaaatcatcctgaacgcatttgctgatgggaccagcttccttttgcttgaatgttgggggctccttaccacatctcga

SEQ ID NO: 44549 - protein, 61 aa, Zea mays
  misc_feature: Ceres CLONE 1446979-F
MTPPMDPPDVEMEMEPAPQPPAPTAVGEGWSMLSRARGLLEEGKPSLALQAVLLAIRISKR

SEQ ID NO: 44550 - DNA, 760 bp, Zea mays
  misc_feature: Ceres CLONE 1446980-F
  misc_feature: Translation starting site: 190
  misc_feature: Pfam Name: bZIP_1 Pfam Description: bZIP transcription factor
  misc_feature (549)..(549): n is a, c, t, g, unknown, or other
ggagctccccgcggtggcggccgctctatactagtggatcccccgggctgcaggaattcgcacgagaccattacctagaacatcctaatcgaaaaatttttttcgcgtggtcgagtccgtccgtgtctgtcctccgctgtccgctggctgcgatagtgctgcctgctgctctaacccaatccaaggaggatgccgaggagcccgcagctgagcctgagcggctgcagctctctcttctccctgtccagcaccagtacgagccgcgacagcgccgccctgaaggcgccggtgccagccccaccggcaggcgcggtgcccccacggcgcacccctctcctgtcgctcagcgtcggcgaggaggaagaggaccagggtgaggacaaggaggattacctgcttgggccccccccccccccacctgcagctgacggggcccggtggcggcagcaacagcagcggcggctacaacgacaagcggaagaacatccggatgatgaggaacagggagtctgccctgcgctccgggcaaggaagagggcctatgttcangacctggaaaaggaggtcgtcccctggtgaatgaaaacctcaagctcaagagccgtggcaaacactgaaaccaaatatgcctgcactggtcccccaagcagcagccagagcagcttcccccatcaaaaaaccctcctcatccactcagcctctaggctgttaccaataagagatatgttttgtgaattttaaaggcctattatgaaccaag

SEQ ID NO: 44551 - DNA, 710 bp, Zea mays
  misc_feature: Ceres CLONE 1446988-F
  misc_feature: Encodes the peptide sequence at SEQ ID NO. 44552
  misc_feature (155)..(155): n is a, c, t, g, unknown, or other
  misc_feature (161)..(161): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (483)..(483): n is a, c, t, g, unknown, or other
  misc_feature (484)..(484): n is a, c, t, g, unknown, or other
  misc_feature (486)..(486): n is a, c, t, g, unknown, or other
  misc_feature (531)..(531): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (583)..(583): n is a, c, t, g, unknown, or other
  misc_feature (584)..(584): n is a, c, t, g, unknown, or other
  misc_feature (594)..(594): n is a, c, t, g, unknown, or other
  misc_feature (617)..(617): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
cgctctagaactagtggatcccccgggctgcaggaattcgcacgagaccattacctagaacatcctaatcgaaaacctaatcgaaaagacggcatttgcatctgagttcctgattgttgtattccagtttcttctgtgagttttgtgggatcgcnaggaanaactagaaggatgtcgtgctgccgaggcaactgcgggtgcggcgccggctgcaagtgcggcagcggctgccgagggtgcaagatgtacccggacatggctgagcaggggaccacacccagactctcatcatgggtgtttgcccatcaagggcgggttcgaggcggccgccttatttataccgcccgggcgggagggggcccactccacccnnnaccccccccctgctaggaaacgacggcggcaataacctttcgggtctgcgcccgcaggggctgatggcaccccccaaagaacccttaccctccccaacaaacggttganntnttttcacacctctgcaggccctcttttcatctcccgcccaacacnaaaaaacaccacccgtctcagggnnnncgcccggcccgtctccccaccccanncaaaaagcgncccattccacccctccacctcgnagtgggggtggtggacacttccccaagacacgnnnnaccccctccaccgcgaccacgaccactatcacccaccgtgtctgnnnnacccgtgtg

SEQ ID NO: 44552 - protein, 72 aa, Zea mays
  misc_feature: Ceres CLONE 1446988-F
  misc_feature (1)..(72): Pfam Name: Metallothio_2 Pfam Description: Metallothionein
  misc_feature (68)..(68): Xaa is any aa, unknown, or other
MSCCRGNCGCGAGCKCGSGCRGCKMYPDMAEQGTTPRLSSWVFAHQGRVRGGRLIYTARAGGGPLHPXPPPC

SEQ ID NO: 44553 - DNA, 756 bp, Zea mays
  misc_feature: Ceres CLONE 1446989-F
  misc_feature: Encodes the peptide sequence at SEQ ID NO. 44554
  misc_feature (442)..(442): n is a, c, t, g, unknown, or other
  misc_feature (469)..(469): n is a, c, t, g, unknown, or other
  misc_feature (583)..(583): n is a, c, t, g, unknown, or other
  misc_feature (686)..(686): n is a, c, t, g, unknown, or other
  misc_feature (756)..(756): n is a, c, t, g, unknown, or other
ctggagctccccgcggtggcggccgctctagaactagtggatcccccgggctgcaggaattcgcacgagaccattacctagaacatcctaatcgaaaactcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgccgaccgtgtcgtctccgtcgtcaagaacttccagaaggttgaaccctcaaaggtgacacctagtgctcattttcagaaggaccttggacttgatagcctggacactgtggagatcgtgatggcgtttgaggaagaattttcctttgagattcctgancacgatgcagagaagattgactccatncagacagcggttgatttcattgcttcgcatcctcaagcaaaataagaggatttctttttttttcgtatttcaaagtgtgttttgcacttttgcatccagaactttatgcgacancggactagttttatctagcttgccgcagtagataggaagtcatttctttacttttctgaatccgcgtgtaccaacgattgggtgtgtcttgtgacctcatggntacgctaatcaataatccatttgggcttcctttctgcttcaaaaaaaaaaaaaaaggctatcgatacgcn

SEQ ID NO: 44554 - protein, 127 aa, Zea mays
  misc_feature: Ceres CLONE 1446989-F
  misc_feature (53)..(120): Pfam Name: PP-binding Pfam Description: Phosphopantetheine attachment site
  misc_feature (104)..(104): Xaa is any aa, unknown, or other
  misc_feature (113)..(113): Xaa is any aa, unknown, or other
MAMAAARRALLAHLRVPVVHPAAAAATIPAAGRLLSSTTETKGSFLDKGEVADRVVSVVKNFQKVEPSKVTPSAHFQKDLGLDSLDTVEIVMAFEEEFSFEIPXHDAEKIDSXQTAVDFIASHPQAK

SEQ ID NO: 44555 - DNA, 753 bp, Zea mays
  misc_feature: Ceres CLONE 1446992-F
  misc_feature: Encodes the peptide sequence at SEQ ID NO. 44556
  misc_feature (471)..(471): n is a, c, t, g, unknown, or other
  misc_feature (502)..(502): n is a, c, t, g, unknown, or other
tggagctccccgcggtggcggccgctctagaactagtggatcccccgggctgcaggaattcgcacgagaccattacctagaacatcctaatcgaaaaataataataataaaaaactccgaatccgccgcgcgcgccccgtcctcgtcgccggcggaggcgcccgccaccgcccacagcagcctatcgccggagaaggaacgccgcggggagcttttccactgccatctcccgtctgacccctccgagatcggaagcggcggccatggcgatcccgctcgtgctcgtcgtgctcccgctcggcctcctcttcctcctgtccggcctcatcgtcaacaccatccaggcgatcctatttgtgacaataaggcccttttccaagagcttgtatcgccggatcaacaggttcttggccgagctgctgtggctccagcttgtctgggtggtggactggtgggcaggcgttaaggtancactacatgcggatgaggaaacttaccgatncatgggtaaagagcatgccctcgtcatatcaaatcatcgaagtgatattgattggcttattggatggatattggcccagcgctcagggtgccttggaagtacactcgctgtcatgaagaagtcatccaagttcttccagtcattggctgggtcatgtgtttggcagagtacctctttttttgaaagggactgggcccagaatgaaaagacactaaggtggggtctccaagggtgaaagacttccctagacc

SEQ ID NO: 44556 - protein, 157 aa, Zea mays
  misc_feature: Ceres CLONE 1446992-F
  misc_feature: SWISSPROT Homolog: EC 2.3.1.51 1-acylglycerol-3-phosphate O-acyltransferase
  misc_feature (70)..(70): Xaa is any aa, unknown, or other
  misc_feature (80)..(80): Xaa is any aa, unknown, or other
MAIPLVLVVLPLGLLFLLSGLIVNTIQAILFVTIRPFSKSLYRRINRFLAELLWLQLVWVVDWWAGVKVXLHADEETYRXMGKEHALVISNHRSDIDWLIGWILAQRSGCLGSTLAVMKKSSKFFQSLAGSCVWQSTSFFERDWAQNEKTLRWGLQG

SEQ ID NO: 44557 - DNA, 771 bp, Zea mays
  misc_feature: Ceres CLONE 1446994-F
  misc_feature: Encodes the peptide sequence at SEQ ID NO. 44558
  misc_feature (277)..(277): n is a, c, t, g, unknown, or other
  misc_feature (330)..(330): n is a, c, t, g, unknown, or other
  misc_feature (361)..(361): n is a, c, t, g, unknown, or other
  misc_feature (368)..(368): n is a, c, t, g, unknown, or other
  misc_feature (668)..(668): n is a, c, t, g, unknown, or other
ggagctccccgcggtggcggccgctctagaactagtggatcccccgggctgcaggaattcgcacgagaccattacctagaacatcctaatcgaaaaacaccgatctcacggacaaacttacaacatatggctatggcgacggcgaagctgaactccccggctaccagcttgctcgctggcggccgcacgcgccgatctgcgcccgcccgctgcacgacggtgatccgcgccgccgcaggctcctactcggacgagctcatctccaccgcgaaatctngtgcttcccctgggcgtggtattctgggcattgatgagtcaaatggcacatgntggaagagttatcatctattggtttggacanccaaaantgaaccgccaggcttacaggcagcttttgctaacactgctgggcttgggaaataatttccgggccttttcctttcgaggaagccctttttcatcaacttcaaccgcgaaaaatttttttaacgcttgaagaacaaaaaataccccccgcgcccaagggaaaaggggttgggtcccttgccgggacacaaaaaaaacatggccccagctctttgtggttctctccaggggggggaaaaataaaagggggggccccctccaagagggaagggtgggaccccccctggggcccccccttaaanggaaaaagaagggggggtcttctcctatttttttttttaaaaagaatgttttttgggggggaaccaccttctttttttaaaaaaaaaaagggggggggggggg

SEQ ID NO: 44558 - protein, 98 aa, Zea mays
  misc_feature: Ceres CLONE 1446994-F
  misc_feature: SWISSPROT Homolog: EC 4.1.2.13 Fructose-bisphosphate aldolase
  misc_feature (51)..(51): Xaa is any aa, unknown, or other
  misc_feature (68)..(68): Xaa is any aa, unknown, or other
  misc_feature (79)..(79): Xaa is any aa, unknown, or other
  misc_feature (81)..(81): Xaa is any aa, unknown, or other
MAMATAKLNSPATSLLAGGRTRRSAPARCTTVIRAAAGSYSDELISTAKSXASPGRGILGIDESNGTXWKSYHLLVWTXKXEPPGLQAAFANTAGLGK

SEQ ID NO: 44559 - DNA, 739 bp, Zea mays
  misc_feature: Ceres CLONE 1447002-F
  misc_feature: Encodes the peptide sequence at SEQ ID NO. 44560
  misc_feature (612)..(612): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaatatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaagcggcgggaagacgtcgcagatctacgccatccgccaggccgtcgccaaggggctcgtcgcctactaccagaagtacgtcgacgaggccgccaagaaggaggtcaaggacatctttcaccggtacgaccgcacccttctcgtcgccgaccccagcgctgcgagccgaagaagtcggtggtcgtggcgcccgcgcangtcccagaagtctaccgtgagcgctncgctgccccgcttgccgaaccgtgctgtgtgtcccaactgcagtcgatgctgtacccgtgcttatttctatcatcgactactatgtggtctatactagagc

SEQ ID NO: 44560 - protein, 182 aa, Zea mays
  misc_feature: Ceres CLONE 1447002-F
  misc_feature (17)..(139): Pfam Name: Ribosomal_S9 Pfam Description: Ribosomal protein S9/S16
  misc_feature (142)..(142): Xaa is any aa, unknown, or other
  misc_feature (151)..(151): Xaa is any aa, unknown, or other
MSTVLQRPTPGTVQCFGRKKTAVAVAYTKPGRGLIKVNGVPIELIRPEMLRLKAFEPILLAGRSRFKDIDMRIRVRSGGKTSQIYAIRQAVAKGLVAYYQKYVDEAAKKEVKDIFHRYDRTLLVADPSAASRRSRWSWRPRXSQKSTVSAXLPRLPNRAVCPNCSRCCTRAYFYHRLLCGLY

SEQ ID NO: 44561 - DNA, 741 bp, Zea mays
  misc_feature: Ceres CLONE 1447008-F
  misc_feature: Translation starting site: 415
  misc_feature (537)..(537): n is a, c, t, g, unknown, or other
  misc_feature (544)..(544): n is a, c, t, g, unknown, or other
  misc_feature (556)..(556): n is a, c, t, g, unknown, or other
ggagctccccgcggtggcggccgctctagaactagtggatcccccgggctgcaggaattcgcacgagaccattacctagaacatcctaatcgaaaaaattattatttcttgtgacctataatcatgctttgtgacgtcagatcgccggcaactcgggcatcctgctgagctacatcgccgacttcgcgctcgccggcctcccgacgccactcaactggcgcctgatgatcggcatcggcgccgtccctcctctattcctagcggccgcggccgcgcttgccatgccggagaccccgcgctggctcgtcctccacggccaccgcgacgaggcgcgccgcgtgctggcgcgcacggtgggggacgcggaccgccggctccaggagatcgtgacgtccgtgcaggaggccacgaagcatggggggctccggcggcggcgacgcgccgtcttcggcgagcgtgctgcgcgagatcctgctcctggcgacgccctgcgtccgccgcgtgatgctggccatcctggggctgcaagtgttccancaggcgntgcgcgtggcgnccatggtgctgtacgccccgcgcgtgttcagccacttcgggatcacctccgagcgcgacgtgctccgcgccaccgtcctcctcggcgccggccagacggtggcgatcgtcgtccctctgttcctcgccgacagcttcggcgccggccaatggtgctcaccagcgcgggtggcatgcccgcttccc

SEQ ID NO: 44562 - DNA, 739 bp, Zea mays
  misc_feature: Ceres CLONE 1447011-F
  misc_feature (416)..(416): n is a, c, t, g, unknown, or other
  misc_feature (418)..(418): n is a, c, t, g, unknown, or other
  misc_feature (419)..(419): n is a, c, t, g, unknown, or other
  misc_feature (423)..(423): n is a, c, t, g, unknown, or other
  misc_feature (432)..(432): n is a, c, t, g, unknown, or other
  misc_feature (456)..(456): n is a, c, t, g, unknown, or other
  misc_feature (457)..(457): n is a, c, t, g, unknown, or other
  misc_feature (696)..(696): n is a, c, t, g, unknown, or other
ggagctccccgcggtggcggccgctctagaactagtggatcccccgggctgcaggaattcgcacgagaccattacctagaacatcctaattcgaaaaaaaaccaaacccagctcaggcacaaccccaacgcaccgccgccgctcgcctggcctcacctcgccggagaagagttataagacaggagaaccccgtccccggggcgcaggcctcggcagcttccgtgacccaccgcccaatcctgccacagctgccctccctcctcccctctgggcgtggccgagttgtaggcatcacggctagcgttgcagccccccggcgcggccccgcagctgcgcaggtggagcccacgggcaccatcgcctccgctgtcgcgtccagccccgctccgcacgggggccgcggggcgctgccctcngnncgangaagcccgntcgatctcctctttcctcgcggcnngcgtcgcctctgagccgtttctgtctctcacttcttctttcctagcattagtcccttctgctacccccccgaccccaacgagtttctaccccgaaagaactgaccgaactcccgcttggaaatgaactgacctccggagggtgcccacgttttctcaaatacaggggaaccaaaaaaccccgcgcggttggggaaagaaatgcccgaaaaggtttttgccttttaaagtccccccaacntttaaatttaacccgcaaaggctcccagaagagtcctttccct

SEQ ID NO: 44563 - DNA, 756 bp, Zea mays
  misc_feature: Ceres CLONE 1447012-F
  misc_feature: Encodes the peptide sequence at SEQ ID NO. 44564
  misc_feature (342)..(342): n is a, c, t, g, unknown, or other
  misc_feature (408)..(408): n is a, c, t, g, unknown, or other
  misc_feature (477)..(477): n is a, c, t, g, unknown, or other
ggagctccccgcggtggcggccgctctagaactagtggatcccccgggctgcaggaattcgcacgagaccattacctagaacatcctaatcgaaaatgactgcagatttgagttctggcccaagaaccgcgtgctagcccgccatggaggtgaggtccgagcaagggctgatggcggggagggatctattcggcttgacgaagagcccgccggcgcccgcgccgccgtcgtccgccgcatgcagagcgtgcgcatggcgtacaccgcggacggcaccgcccgtgtcgctccggtgagctcttcgcctgcgacgccgtcttaccagccgcagggcgcagcccnacgcgctagcatgtccgcggcgacggtccgtcgcaggcatggcgctccagctgccccgagcatggntgaccccctggccaaaagaaaccccgaccaccaagaaatacgggccccacggtccttggccttggaatngtgcctgcttcggcgttttgggcccccgggaaaaaaaaggttttttgggccctttccccccctggttaaaacccgaacttcctggggggggcccccaaaagattcaaaacgggccgctctaggttttcacacaaacccccggggaccttgggggtccaagggttgttttacccccttttttccccccccggggggggaggggcgcccaaaaatttttttttcccggaggaacccggtgtttttgtttttaaagggcgcccaaaaaagagccccctcccc

SEQ ID NO: 44564 - protein, 50 aa, Zea mays
  misc_feature: Ceres CLONE 1447012-F
MEVRSEQGLMAGRDLFGLTKSPPAPAPPSSAACRACAWRTPRTAPPVSLR

SEQ ID NO: 44565 - DNA, 747 bp, Zea mays
  misc_feature: Ceres CLONE 1447013-F
  misc_feature: Encodes the peptide sequence at SEQ ID NO. 44566
  misc_feature (387)..(387): n is a, c, t, g, unknown, or other
tggagctccccgcggtggcggccgctctatcactagtggatcccccgggctgcaggaattcgcacgagaccattacctagaacatcctaatcgaaaaatccaatacccccacgaacccactctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggctcatccgcgcgctcaacctcctgcctaaggagaaagaagcggggccggccgcgggcggcggcgacggggccagcgtgtcgcccggggagctcctanagcgacgcgtccggatgccccccctgccgccggcgtcggggacctcggccaccacgccggatatttccgcctgccgcaaaagcaagagggcagaaatgttctacttcttcttcgaatccagggccagaaaaaaggaagacaaccccgtcttgatctgtttaccggaaggccccgggttgcacaacgagcttgccgtttttcacagaaggggccttccccattgccaaaaacatggccctggtctggaaaaattcgggtgggcaaccgactccaatttcctttttgttggacccccaccggaacggtctttacttcacccccacgaacgggaacacccgttggaaaaattggtgcaccatg

SEQ ID NO: 44566 - protein, 204 aa, Zea mays
  misc_feature: Ceres CLONE 1447013-F
  misc_feature: SWISSPROT Homolog: EC 3.4.16.5 Carboxypeptidase C
  misc_feature (85)..(85): Xaa is any aa, unknown, or other
MAKMAMASSRLPALLCLAAVAVAVAAEAAAAAGEGGLRLPRDATFPAAQAERLIRALNLLPKEKEAGPAAGGGDGASVSPGELLXRRVRMPPLPPASGTSATTPDISACRKSKRAEMFYFFFESRARKKEDNPVLICLPEGPGLHNELAVFHRRGLPHCQKHGPGLEKFGWATDSNFLFVGPPPERSLLHPHEREHPLEKLVHH

SEQ ID NO: 44567 - DNA, 684 bp, Zea mays
  misc_feature: Ceres CLONE 1447017-F
  misc_feature: Encodes the peptide sequence at SEQ ID NO. 44568
ggagctccccgcggtggcggccgctctagaactagtggatcccccgggctgcaggaattcgcacgagaccattacctagaacaccctaatcgaaaactccccgaccacaccgctcctctccttccaagccctcgtcaccaccagcctgctctcattcctgtgcccactggatctcaactgcttgcgctcaaatgctcccacacactctcgctgcgggtgtgcccgcccaaccgtgcatcgctctctgtcgcttccgctcatcatagtgatggcgtcgtcgtccccgcacagcacagaagttggcagcacttttgaagacaaacttggtggaaatgaactatcctaaaaaacccttgggatttccccggccaaggtaatttaacaactcaaaaaaaaaaccaaatggttctattttggcctaaaaaccagaaggcccaaaaatttgaattggaaaaagggccaaattttaaaaggtgtccccccccaagcccccctaaaaaaagggggggcccttccccccccccgggggggcccccacaattttattggggggaaaaaaaaccccttttttaaacccccccggggaaaaattttttttataacaaaaggagggagttttttttattttttaacaacctcttttttttccaaaaattttttccccccccaaaaaaaaaaaaattt

SEQ ID NO: 44568 - protein, 104 aa, Zea mays
  misc_feature: Ceres CLONE 1447017-F
GAPRGGGRSRTSGSPGLQEFARDHYLEHPNRKLPDHTAPLLPSPRHHQPALIPVPTGSQLLALKCSHTLSLRVCPPNRASLSVASAHHSDGVVVPAQHRSWQHF

SEQ ID NO: 44569 - DNA, 743 bp, Zea mays
  misc_feature: Ceres CLONE 1447019-F
  misc_feature: Encodes the peptide sequence at SEQ ID NO. 44570
  misc_feature (339)..(339): n is a, c, t, g, unknown, or other
  misc_feature (399)..(399): n is a, c, t, g, unknown, or other
  misc_feature (463)..(463): n is a, c, t, g, unknown, or other
  misc_feature (477)..(477): n is a, c, t, g, unknown, or other
  misc_feature (492)..(492): n is a, c, t, g, unknown, or other
  misc_feature (494)..(494): n is a, c, t, g, unknown, or other
  misc_feature (562)..(562): n is a, c, t, g, unknown, or other
  misc_feature (644)..(644): n is a, c, t, g, unknown, or other
  misc_feature (669)..(669): n is a, c, t, g, unknown, or other
  misc_feature (676)..(676): n is a, c, t, g, unknown, or other
  misc_feature (677)..(677): n is a, c, t, g, unknown, or other
  misc_feature (706)..(706): n is a, c, t, g, unknown, or other
  misc_feature (730)..(730): n is a, c, t, g, unknown, or other
agctccccgcggtggcggccgctctagaactagtggatcccccgggctgcaggaattcgcacgagaccattacctagaacatcctaatcgaaaagtgcggctactgggtaaccgccgccgctgccgccctacgccaggttctcaggtcattgtcagtccccttacttcgccggctcattcggcggcgacgagcaccagaaatcctagctgctttgagtatggaggcgctgtttgggtgcaacaaacatggcggggacaaggccgctgatttggcctcgtttataatcgtgcaggctgccttggaggtgccaaggttacttgggctccttgccatgattnctcataattaaatctttacatctggtggagatcagaatttgattaataggattctgagcnaaaacaaaaatgcaactgaattcgagaacaggatgatggagagtctgatgatgataatgatgangagggagacgatgnagatgctgaaaaccnanaagatgatggtggtgatgagggatcagatgacattgggaatgaggaggaagatgacgacgacgatgantacgatcctgcagcccaacgtgaaggaggaagtgaccaccatgatgatggtggagaggatgaaaaggaggatgatgaccacnatgatgatggggatggtgacatgangaaaatnngagagaagaagaagaaggagatgatgacnatgatgcccccaccccactactangaagagaaatgat

SEQ ID NO: 44570 - protein, 43 aa, Zea mays
  misc_feature: Ceres CLONE 1447019-F
  misc_feature (41)..(41): Xaa is any aa, unknown, or other
MEALFGCNKHGGDKAADLASFIIVQAALEVPRLLGLLAMIXHN

SEQ ID NO: 44571 - DNA, 746 bp, Zea mays
  misc_feature: Ceres CLONE 1447022-F
  misc_feature: Encodes the peptide sequence at SEQ ID NO. 44572
  misc_feature (563)..(563): n is a, c, t, g, unknown, or other
  misc_feature (589)..(589): n is a, c, t, g, unknown, or other
  misc_feature (623)..(623): n is a, c, t, g, unknown, or other
  misc_feature (673)..(673): n is a, c, t, g, unknown, or other
  misc_feature (684)..(684): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaatcgaaaaaaaccctaaacccctctgatctccctctcgcgccgccgccaccatgtcgccgccgcagccaccacacccggtgccccgagagacggtggccagcgctgtcgcttccctgacaacgtggatgaagaagcgcgctgcggaggcgcgcccgaacctcctcgccgacgagcgcgacgacatcgtggtcctccagctctcgctacgccgcatccccgcctcgcgcagcaccaagccgcgcctcctcccgatgccacatcccgttgttgggcacgacggcgcctccgtctgcgtcatctcggacgaccgcaccaagtcgcggtccccttccgcctccgacctccacgcgtccatgtcgctccaccgtttccccgtctccgaagtcatcccgctctctacgctccgcacggattacccgccgtacgagtctcggcgccgtctcgcagcctcccacgacctcttcgtcngcgaccgcgccatcctccccctgctngcgcgcgtcctcgggaaggcgttctactccaccnagaaggctccgattggagtcgatttcaccccgcatcgatggccggagcangtccgcagggntctttgctctgcttttctgtacctgcggtcagggacctgctcggggaaaanggttggtaggc

SEQ ID NO: 44572 - protein, 200 aa, Zea mays
  misc_feature: Ceres CLONE 1447022-F
  misc_feature (140)..(140): Xaa is any aa, unknown, or other
  misc_feature (160)..(160): Xaa is any aa, unknown, or other
  misc_feature (176)..(176): Xaa is any aa, unknown, or other
  misc_feature (180)..(180): Xaa is any aa, unknown, or other
  misc_feature (197)..(197): Xaa is any aa, unknown, or other
MSPPQPPHPVPRETVASAVASLTTWMKKRAAEARPNLLADERDDIVVLQLSLRRIPASRSTKPRLLPMPHPVVGHDGASVCVISDDRTKSRSPSASDLHASMSLHRFPVSEVIPLSTLRTDYPPYESRRRLAASHDLFVXDRAILPLLARVLGKAFYSTXKAPIGVDFTPHRWPEXVRRXLCSAFLYLRSGTCSGKXVGR

SEQ ID NO: 44573 - DNA, 764 bp, Zea mays
  misc_feature: Ceres CLONE 1447023-F
  misc_feature: Encodes the peptide sequence at SEQ ID NO. 44574
  misc_feature (415)..(415): n is a, c, t, g, unknown, or other
aagctggagctccccgcggtggcggccgctctagaactagtggatcccccgggctgcaggaattcgcacgagaccattacctagaacatcctaatcgaaaaccgaaagcgtcatttaaagcccacgggtaccaccactctactcttcgtcctcctcgatcgtcccaacaaccgcaatggcgcagcagaggcttctcgctctcctcctggtggcggccctcctcgtgctctcctgctcgcaagggctggtggaagcgcggaaggtgcaggtgcggcgcgcgcccctcggcggcggccgcctgcttccggaggcgatgatggcgtacacgacgacggactacgggccccccactgccaacaccaacacccacggcggcatggtcccgtcgccggacgacccctcctcgccgccgacncactgaccggccagtcgatctcaccggcaacaactgtcttgttctttgggattggagctttggaagagaaaaatggaggataggatcggaagaagctggtggtcgtgttcttctcccttttttggcgcgcgtgttgtgtgctgctgtgtctgtgtactccagctgtagctgctgctgtgcttagctgattgaagtttgaactgtattgggtcacagtattatgcatgttttgtttggtgagacgtcagaacccatcattgaatctggtctgaatctagtcagctctatgtaaagtggaggcgatacatgaatgtacgtagtaaattgaacagaattcgttcgccaaaaa

SEQ ID NO: 44574 - protein, 81 aa, Zea mays
  misc_feature: Ceres CLONE 1447023-F
MAQQRLLALLLVAALLVLSCSQGLVEARKVQVRRAPLGGGRLLPEAMMAYTTTDYGPPTANTNTHGGMVPSPDDPSSPPTH

SEQ ID NO: 44575 - DNA, 761 bp, Zea mays
  misc_feature: Ceres CLONE 1447024-F
  misc_feature: Encodes the peptide sequence at SEQ ID NO. 44576
  misc_feature (620)..(620): n is a, c, t, g, unknown, or other
aaactggagctccccgcggtggcggccgctctagaactagtggatcccccgggctgcaggaattcgcacgagaccattacctagaacatcctaatcgaaaactacgccggcgcacagaagaacgtcgggccctccggcgtcaccatcgccatcgtgcgcaaggacctcatcggcgccgctcagcccatcacgcccgtcatgctcgacttcaagacgcacgccgacaacgcctccctctacaacaccccgccctgcttcgccatctacgtttgcggtctcgtcttcgaggacctgctcgcgcagggcggcctcgccgaggtcgagaagaagaacgcgcgcaaggccggcgccctctacgacaccatcgacgccagcggagggtactacgtctgccccgtcgacaagtccgtgcgctcccacatgaacgtgcccttcaccctggccaagggcccggacttcgagaagcagttcatcgccgaaggcgccaaggagggcatggtgcagctcaaggggcacaggtctgtcggcggcgtccgcgccctcatctacaatgccatgccgctcgcccgcgtgaagaagctcgtcgccttcatgaaggacttccaagccaggaacccttngatgcccttgtgctatggtcatttggtattgctactcagtcttttcttctagaataggtgggctcgtgcaagagctgtctcgcgttgcgcactgggatctatctgtagtattagtaccataacgtaacggctactgtattt

SEQ ID NO: 44576 - protein, 157 aa, Zea mays
  misc_feature: Ceres CLONE 1447024-F
  misc_feature: SWISSPROT Homolog: EC 2.6.1.52 Phosphoserine transaminase
  misc_feature (141)..(141): Xaa is any aa, unknown, or other
MLDFKTHADNASLYNTPPCFAIYVCGLVFEDLLAQGGLAEVEKKNARKAGALYDTIDASGGYYVCPVDKSVRSHMNVPFTLAKGPDFEKQFIAEGAKEGMVQLKGHRSVGGVRALIYNAMPLARVKKLVAFMKDFQARNPXMPLCYGHLVLLLSLFF

SEQ ID NO: 44577 - DNA, 883 bp, Zea mays
  misc_feature: Ceres CLONE 1447029-F
  misc_feature (85)..(85): n is a, c, t, g, unknown, or other
  misc_feature (418)..(418): n is a, c, t, g, unknown, or other
  misc_feature (423)..(423): n is a, c, t, g, unknown, or other
  misc_feature (434)..(434): n is a, c, t, g, unknown, or other
ccagctggagctccccgcggtggcggccgctcttcaactagtggatcccccgggctgcaggatttcacacgagaccattacctanaacatcctaatcgaaaaagatcagatcgggtatttccacaccaaatcccaaagcgacaacaaaaaagctcgagctcttgcttgggtggacgagcgaacagagcgccgatcgcaacagtagcaccaggaagaacatgtcatcggagttcatcgcctatgagaccgccgccttcttggctttctcagcgccgccgcggcgctcgtcttctcatgtatggcagcggccaacggggacagccaacaacggcaacggcatggggaacatgggaagtcatgcgctcgtgagctggtgaaaaaagttaatatgtgaaccaaggcataggaaggaatgttnccttnccccacaggtntatattatcgcccaatcattcaacaataacctggaaaccacctcccacaaacaaaaccacaaactacaaacaaccaaaatgcctactccccatcttcatcctttcggtcacacctctctgtgcctccattgcagagtatattgattgctctgggcttggagttatccctccctccttctagttctattcttgggacctccatggatatagggtgtcaagagataccaaactcttccacagattacgaacggtaatctacggtcccgcagtacctcctcaaacaaccgctgccaggtctcaagcgccctcaatatagtgtgtccttcctctcaacaaactatcctgggcacgagtacatactctcctttctttgattgacgcactgtactcgctgactccgctcacctatttggtctcgtcgcttccctgaatagttgtattggaagggg

SEQ ID NO: 44578 - DNA, 780 bp, Zea mays
  misc_feature: Ceres CLONE 1447030-F
  misc_feature: Encodes the peptide sequence at SEQ ID NO. 44579
  misc_feature (340)..(340): n is a, c, t, g, unknown, or other
  misc_feature (780)..(780): n is a, c, t, g, unknown, or other
aagctggagctccccgcggtggcggccgctctagaactagtggatcccccgggctgcaggaattcgcacgagaccattacctagaacatcctaatcgaaaaaaggtccaaagcccacccgtactcatccgagatccccaaccatggccgtcggcgacgtggagacggcggcgccgctgctgcccccgccggcgtctgccctggcggacgagccctccgcgggcccgcccccagacgaccggctcggcatcggctacctcatcttcttcaccctgggcgccggcttcctgctcccctggaacgcgttcatcaccgccgtcgactacttcgacttcctctanccgggggcccccgtcgaccgcgtgttctccatatcctacatgctctccgccttactgcccctgctcgtcatcgtgctcttcttcccaaagtcagcgcccccatccgcatcaacacggggctcacgctcttcacgctcacgctcgtgctcgtgcccgcaatggacctcatctacgtcaaggggagggccgggctgtacggagcgttccatgtgactgtcgccgccacggctctgttccggggtcgccgacccgctcgtgcaaggaggcgtcatccgccccccgggggaaactgcccaaaccgtacatgcaggccgtcgtccccggaaccgccccctcaggggtggcaggggtccctcccccccctaaatttcccttccccccccccttctgatcctcttctccaatactcccccaatcgaagttacccacctctttcaatn

SEQ ID NO: 44579 - protein, 136 aa, Zea mays
  misc_feature: Ceres CLONE 1447030-F
  misc_feature (66)..(66): Xaa is any aa, unknown, or other
MAVGDVETAAPLLPPPASALADEPSAGPPPDDRLGIGYLIFFTLGAGFLLPWNAFITAVDYFDFLXPGAPVDRVFSISYMLSALLPLLVIVLFFPKSAPPSASTRGSRSSRSRSCSCPQWTSSTSRGGPGCTERSM

SEQ ID NO: 44580 - DNA, 706 bp, Zea mays
  misc_feature: Ceres CLONE 1447033-F
  misc_feature: Translation starting site: 160
  misc_feature: SWISSPROT Homolog: EC 2.1.2.10 Aminomethyltransferase
  misc_feature (239)..(239): n is a, c, t, g, unknown, or other
  misc_feature (255)..(255): n is a, c, t, g, unknown, or other
  misc_feature (323)..(323): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
ctccccgcggtggcggccgctctagaactagtggatcccccgggctgcaggaattcgcacgagaccattacctagaacatcctaatcgaaaaaacagaccaacagcatctaatcaatcaagacagccccgtgctagctcacccgccggggctcgccacgatgagaggcctcctcgcgtgcgccaccctcgcccgccgcgccgccgcctcctccgcgcccgcgcgcgtccgccacctggncggcgccgcgaaggcngcggaagccaagctcaagagacggcgctctacgacttccacgtcgcccacggcggcaagatggtgccngttcgccggctggagcatgcccatccagtacaggaactccatcatggactccaccgtcaactgcccgggccaagggaagccccccccacccccccacatgggcgccccccccccaaggcccgggggccctccccttccccaaatcccctttttcccccaaatcccccctttaaggaagggaccgggcccctcccgttttttccaaaaagaaggggggggcaaaaaaaacccccctctccccagggtgttgtggtgcccccccccccccnnnaaagggggggggggggggtgggtgcccccccccctttagggcgaaaaagggggttttcaaaaaaaaggggggggggccatttgggggtattccccaaaaaagaattgttcgg

SEQ ID NO: 44581 - DNA, 709 bp, Zea mays
  misc_feature: Ceres CLONE 1447034-F
  misc_feature: Encodes the peptide sequence at SEQ ID NO. 44582
  misc_feature (425)..(425): n is a, c, t, g, unknown, or other
tggagctccccgcggtggcggccgctctagaactagtggatcccccgggctgcaggaattcgcacgagaccattacctagaacatcctaatcgaaaaaccgcagccctagcgcgccgccaccttcaccttcgcagccctagccgccgccgccgcctccattgctgctatacccgcaaccatgggtcccgtgctgaagcgcccgaccccgggcacagtgcagtgtttcgggcgcaagaagacggccgtggccgtggcctacacgaagccaggccgagggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcncagatctacgccatccgccaggccgtcgccaagggtctcgtggcatactaccagaagtacgtcgacgaagcggcgaaaaaggagatcaaggacatcttcatgcgctacgagcgcaccctcctcgtcgccgacccccgccgctgcgagcccaagaagttcggcggccgcggcgcccgcgccaggttcagaagtcctaccgctgagcgccagcgcctgccggaacgctgtcgtggctccgtttagctacgactttacagaactctgataataacatggtttggcga

SEQ ID NO: 44582 - protein, 162 aa, Zea mays
  misc_feature: Ceres CLONE 1447034-F
  misc_feature (17)..(145): Pfam Name: Ribosomal_S9 Pfam Description: Ribosomal protein S9/S16
MGPVLKRPTPGTVQCFGRKKTAVAVAYTKPGRGMIKVNGVPIELLRPEMLRLKAMEPVLLAGRSRFKDIDMRIRVRGGGKTSQIYAIRQAVAKGLVAYYQKYVDEAAKKEIKDIFMRYERTLLVADPRRCEPKKFGGRGARARFRSPTAERQRLPERCRGSV

SEQ ID NO: 44583 - DNA, 770 bp, Zea mays
  misc_feature: Ceres CLONE 1447037-F
  misc_feature: Encodes the peptide sequence at SEQ ID NO. 44584
  misc_feature (529)..(529): n is a, c, t, g, unknown, or other
  misc_feature (606)..(606): n is a, c, t, g, unknown, or other
  misc_feature (656)..(656): n is a, c, t, g, unknown, or other
  misc_feature (728)..(728): n is a, c, t, g, unknown, or other
  misc_feature (729)..(729): n is a, c, t, g, unknown, or other
  misc_feature (733)..(733): n is a, c, t, g, unknown, or other
  misc_feature (734)..(734): n is a, c, t, g, unknown, or other
  misc_feature (737)..(737): n is a, c, t, g, unknown, or other
  misc_feature (770)..(770): n is a, c, t, g, unknown, or other
agagctggagctccccgcggtggcggccgctctagaactagtggatcccccgggctgcaggaattcgcacgagaccattacctagaacatcctaatcgaaaaaaccgcccaagcctttgggcgctcggctatgtatagatgagcgaccctctgctgcccaattccaacactcaggcaacccagctttggctgcccttgcttgctgctcagttctttgccccctgttcctcctcttctcgcacctcggcgcctgcttcggcatcaactgcgaccgagatggaggcgcaagacgactgcaagtggcgccaggtcccggcgttcggcgactggaacctgtgggacgacatgcccgtcacccagtactttcaggcagggaccttcttcttcgccgcgccgacggcagagaaggacgacgaccacgacgaggatctcttcaaggtgccccagtttcctgccacgccctacagctacaagaagtgcgttgttcgagtgaagggggagaaagaaactgctgtgcctccggcggctnagaagggaggcaggaggcgccgcgtgaacgagcagcagaagtggaagcccaagggagctgtggacgaagacctctancagatatcccgcagcttctctgcaagaagaagctccctgagaatctgctnggagggtgcctgggcctgagctgcatcgcatgaccgagagacgcatcgcttaataaagtttctggggagttnngtgnntcngtgggtgctctgaagaagtgtatagtgtctacn

SEQ ID NO: 44584 - protein, 132 aa, Zea mays
  misc_feature: Ceres CLONE 1447037-F
  misc_feature (85)..(85): Xaa is any aa, unknown, or other
  misc_feature (110)..(110): Xaa is any aa, unknown, or other
  misc_feature (127)..(127): Xaa is any aa, unknown, or other
MEAQDDCKWRQVPAFGDWNLWDDMPVTQYFQAGTFFFAAPTAEKDDDHDEDLFKVPQFPATPYSYKKCVVRVKGEKETAVPPAAXKGGRRRRVNEQQKWKPKGAVDEDLXQISRSFSARRSSLRICXEGAWA

SEQ ID NO: 44585 - DNA, 758 bp, Zea mays
  misc_feature: Ceres CLONE 1447040-F
  misc_feature: Encodes the peptide sequence at SEQ ID NO. 44586
  misc_feature (309)..(309): n is a, c, t, g, unknown, or other
  misc_feature (414)..(414): n is a, c, t, g, unknown, or other
  misc_feature (415)..(415): n is a, c, t, g, unknown, or other
  misc_feature (428)..(428): n is a, c, t, g, unknown, or other
  misc_feature (429)..(429): n is a, c, t, g, unknown, or other
  misc_feature (432)..(432): n is a, c, t, g, unknown, or other
  misc_feature (433)..(433): n is a, c, t, g, unknown, or other
  misc_feature (437)..(437): n is a, c, t, g, unknown, or other
  misc_feature (438)..(438): n is a, c, t, g, unknown, or other
  misc_feature (442)..(442): n is a, c, t, g, unknown, or other
ctccccgcggtggcggccgctctaaaactagtggatcccccgggctgcaggaattcgcacgagaccattacctagaacatcctaatcgaaaattctttcgagccaatgttttcttcaaaaatttccatgtgaaatgctcagcagacaagttattgatctatctgacgttttatatcaatattgccttaaaaagactagaaggttgccggacactagctgttgggactaaagcaatcattaatctgggattggagaaagttcctgtacctggggaaccagggtttcctttccctggacttttcactcttncccagtcccaggaggaagcagtaggactgattaagtctgcaaaacgactgtactcatgcattccagtgataaattgacgattgcccattctgtgttttggccagnncacccccaccaannatnnaaannaaanaaaggagggaaacaaggggaaaaatgctcacttgtgcatacagagcttatgggcttttcaaaacaagggggggttggccttttgctaaaaggaagttcatggactttggcttcctttaaaattggggctttttttacccacgggttcagctgttttttccccctggatcgtgtaaggttcccaccccaccaaaaatattatcctcccctcccaagaaccagccaaaacctccctgatgggaaggggaggacactacaaattttttttccccattcccaattaaaccggggaaacaatttcttgtttggggctccgg

SEQ ID NO: 44586 - protein, 127 aa, Zea mays
  misc_feature: Ceres CLONE 1447040-F
  misc_feature (17)..(125): Pfam Name: P21-Arc Pfam Description: P21-ARC (ARP2/3 complex 21 kDa subunit)
  misc_feature (103)..(103): Xaa is any aa, unknown, or other
PRGGGRSKTSGSPGLQEFARDHYLEHPNRKFFRANVFFKNFHVKCSADKLLIYLTFYINIALKRLEGCRTLAVGTKAIINLGLEKVPVPGEPGFPFPGLFTLXQSQEEAVGLIKSAKRLYSCIPVIN

SEQ ID NO: 44587 - DNA, 761 bp, Zea mays
  misc_feature: Ceres CLONE 1447044-F
  misc_feature: Translation starting site: 227
  misc_feature (320)..(320): n is a, c, t, g, unknown, or other
  misc_feature (388)..(388): n is a, c, t, g, unknown, or other
  misc_feature (389)..(389): n is a, c, t, g, unknown, or other
  misc_feature (415)..(415): n is a, c, t, g, unknown, or other
  misc_feature (472)..(472): n is a, c, t, g, unknown, or other
aaagctggagctccccgcggtggcggccgctctagaactagtggatcccccgggctgcaggaattcgcacgagaccattacctagaacatcctaatcgaaaacagtccagccagcctcccgagccctatccttttccccactcccgggtctccagcattcctatcctctccccgcccgcccgtgccgccgccgccgccgcggcttcccttcctctcccgagccaagatgaatgttgaaaagctcaagaagatggcaggtgctgtgcgcaccggggggaagggtagcgtgcgcaggaagaagaagcagtccacaagactancaccacagatgacaaacggcttcaaagcaccttgaaaagaataggagtgaacagcattcctggtattnngaagagtcacatctttaaggatgatngtgttattcagtttgtaaatcctaaagttgcagcgtcaaatggtgctaatacatggntggtcagtggaactccaagaacaagtacctgcaagactgcttccgtcgattatcaacagcttggccctgacaactggaaaatcctgcggagctccgcaaaccaatccagaaacaagcccttggtgcttctggggcaaggctgggggcacccctgggcttttcaggacaaaaataaacatccctaaacttgcccggaaagaaatgtgggggcccggaaaaaaaaagggcccccaaaattcccaccccccggtgtgtaaccccccctaaaggggcctgtgaaaaccccccc

SEQ ID NO: 44588 - DNA, 867 bp, Zea mays
  misc_feature: Ceres CLONE 1447045-F
  misc_feature (267)..(267): n is a, c, t, g, unknown, or other
  misc_feature (431)..(431): n is a, c, t, g, unknown, or other
  misc_feature (650)..(650): n is a, c, t, g, unknown, or other
caagctggagctccccgcggtggcggccgctctagtactagtggatcccccgggctgcaggaattcgcacgagaccattacctagaacatcctaatcgaaaaaccctccgccggcgacggctcacgcatcgctcggcgcctgccccgcgtccccgaggcgacgaccggcacggcgcgccctcgcggcgctacccgacacctgcgacgaaacgcgccgagtccaggagcgcgtcgacgcaggggctcgagaacgcgatgtcgccatcncggaaccctaccgagatcgtcgggaaggtccgaaggccagcacgtggttgtgtaaccttttctccccttcccccctttgctgggcgggcccttcagcggcgacgagtgttttaccccccaccaggtttaattaacaaagtgtgcaagtttgcgacccaccccanttttttgctacatttgtctggacatatgcccctttggttccaatcgatctacccgcctcccttgaatgcccttaagaaaaatatttacgggaaagggccttcctggctttctgtcatcccggtgtcaaattatatttggggtgggactccataaagggggagggcgctctctatccccaaaagtacttgtaatcggaaggcgaaaagaaatcttttctnctgagacaataaaaccccattgttgggtcactgggaaaggccttgaaaaattttatttggcttggagcaatgatcacataaaggagggcgtctcttgtccgaagagagttgcgcaaatcgctcaaccgattgcgacataaactcggccttgttcacaaggagcttatctctacctgtcccaacccaagggttcattctcttcttggcagcacacccg

SEQ ID NO: 44589 - DNA, 765 bp, Zea mays
  misc_feature: Ceres CLONE 1447046-F
  misc_feature: Translation starting site: 151
  misc_feature (612)..(612): n is a, c, t, g, unknown, or other
  misc_feature (755)..(755): n is a, c, t, g, unknown, or other
tggagctccccgcggtggcggccgctctagaactagtggatcccccgggctgcaggaattcgcacgagaccattacctagaacatcctaatcgaaaaaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtaaaacgcgcgcgcgtgcgcctgtgctgcctgatccggatgcgcgcctaattaatctgccgcatatgcgcgcctttctgggttttactttgcaggtgggcggagctggagagcggggcgacgaccatcgcgttcacgccgctgcaccagcgggagacggacgagctgtcgggggcggtgcagctgccggactcgtcggccgccggccggggctccgtggaggtctgcttcgcctacgcggacgtcgacgccgcgtacaagcgcgccgtgaacaaacgggcggtggccgtgagcgcgccggaggacaagccctggggccagaagtccggcttcngtgcggacatggacggcaacatcgtgcgcatcgcgagctacgtgcgagagtagtcgcattccgctgcatcaccatcgatcaatcgatcagcctttcccatgcatgtctcgtatactacacgtctacacgtgtaccaaaaaaantaatcgttgt

SEQ ID NO: 44590 - DNA, 772 bp, Zea mays
  misc_feature: Ceres CLONE 1447047-F
  misc_feature: Encodes the peptide sequence at SEQ ID NO. 44591
  misc_feature (629)..(629): n is a, c, t, g, unknown, or other
  misc_feature (659)..(659): n is a, c, t, g, unknown, or other
  misc_feature (756)..(756): n is a, c, t, g, unknown, or other
aaagctggagctccccgcggtggcggccgctctagaactagtggatcccccgggctgcaggaattcgcacgagaccattacctagaacatcctaatcgaaaaacggcggtgtcatgtttgcaaaattctcacagagaaccggaggactgagaccagaggaggagacgtcacgcctgcgcggctgcgcccaccatggacgaggatgagtttcggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagctgatgatgaacaataggtagatgctgcttaagggtcggtagttgccaatgatctggaaagtgttgatgctgttgagattttgatcacaggcaaacttttaacacaggtagatgctngtgagcgcatactgataccgcctgattggntcaccgatcgcccgtagccagctcgtatgcagccaggctgtccagagactggtatttgggccgtagaagtggatgcactcaaataaatggtgcgttnactcgtgcaaaaaaaa

SEQ ID NO: 44591 - protein, 107 aa, Zea mays
  misc_feature: Ceres CLONE 1447047-F
MDEDEFRRMLDLFPVVRSRDYCCSDLGTSSRGTRQRSRVQEATKGDNKDSSGGRDMFMQKLKMAAENKIGATKAEFFCKTFEEVHEKLVHRELNLDAAKKFLSAYES

SEQ ID NO: 44592 - DNA, 738 bp, Zea mays
  misc_feature: Ceres CLONE 1447050-F
  misc_feature: Encodes the peptide sequence at SEQ ID NO. 44593
  misc_feature (672)..(672): n is a, c, t, g, unknown, or other
  misc_feature (732)..(732): n is a, c, t, g, unknown, or other
aaagctggagctccccgcggtggcggccgctctagaactagtggatcccccgggctgcaggaattcgcacgagaccattacctagaacatcctaatcgaaaaaaccctgtctagctccttcggtccagcttcgactggctggcaggtaggcacacgcgaagcgataaggtcggctaagccgcgatgtcgccgcggccgccgtccctcgtggtgctcccgctcctcctccccctcctcctcgccgctgtatcccacgctacggctaatgcggccggtgccagcgcccctcccccagtgccgacgccgtgtccggagcagttccacgcggtggtcttcaccaatctcaccgagagcggcggccggctgcagctgatcgacctgtactacgactggcccaggggccgcaacctcaacctcatccgggaccagctctccagcgacccgctctacgacgtcgagtggaccaacggcacctcctacttcttcgactccgggtcctgccgcaccatgcgtttccccgtggggatcctgccgcctgactggctcgccgccggcgccgtctatctcggccgcgagcacgtcgacggcttcgactgccacctgtggaccaaggtcgacttcgtctggtactacgaagaagtcgccaccggccgccccgtccgctggaatttnctcaatggatgcagcagcatgtgatgagcttttgagtgggaggaagtgctgaagactccnagtgca

SEQ ID NO: 44593 - protein, 170 aa, Zea mays
  misc_feature: Ceres CLONE 1447050-F
  misc_feature (163)..(163): Xaa is any aa, unknown, or other
MSPRPPSLVVLPLLLPLLLAAVSHATANAAGASAPPPVPTPCPEQFHAVVFTNLTESGGRLQLIDLYYDWPRGRNLNLIRDQLSSDPLYDVEWTNGTSYFFDSGSCRTMRFPVGILPPDWLAAGAVYLGREHVDGFDCHLWTKVDFVWYYEEVATGRPVRWNXLNGCSSM

SEQ ID NO: 44594 - DNA, 744 bp, Zea mays
  misc_feature: Ceres CLONE 1447054-F
  misc_feature: Encodes the peptide sequence at SEQ ID NO. 44595
  misc_feature (458)..(458): n is a, c, t, g, unknown, or other
  misc_feature (534)..(534): n is a, c, t, g, unknown, or other
  misc_feature (592)..(592): n is a, c, t, g, unknown, or other
  misc_feature (618)..(618): n is a, c, t, g, unknown, or other
  misc_feature (681)..(681): n is a, c, t, g, unknown, or other
  misc_feature (713)..(713): n is a, c, t, g, unknown, or other
  misc_feature (744)..(744): n is a, c, t, g, unknown, or other
tggagctccccgcggtggcggccgctctagaactagtggatcccccgggctgcaggaattcgcacgagaccattacctagaacatcctaatcgaaaaatcgtggcttccatttctttctcccccatctgagctccctctatccctccatttcctcgatctgagctccctctatccctccatttcctcggcgcccgttcccagctctccatggacgccagcagcaagcgcacaggtctgcacaggggcgtcatccttgtgcaggcctccctgccggatctctccctttggctgcggcgagttctacacatcccagccatggctggtcttctctccatggctgacccactcatctcctcaaagctcatccatggcgcctgttcatgctcaaaccaccgtgcgtgcgtgcagaaagtaaagaggaagaagaaagcatgtgaccgagagagaatgatcgtgncagtgatgtggtgccacccacaaggtgcagttggtggacgaaccaacgaaggatggacttaaccagtggatgctcngcaagcgagcacctcccccagcaaacactatctaagtggtaaaataaaggtacctccntgattttggtgatggtgtaacttggncctcatccctgcccacgggatagatgggcgagagggtactgcttccgcaggagaggaccagangagtagcgtggcaggcgttgcatggtactcgntttctcccgtagtatttcctgcataaaaatn

SEQ ID NO: 44595 - protein, 103 aa, Zea mays
  misc_feature: Ceres CLONE 1447054-F
  misc_feature (84)..(84): Xaa is any aa, unknown, or other
MDASSKRTGLHRGVILVQASLPDLSLWLRRVLHIPAMAGLLSMADPLISSKLIHGACSCSNHRACVQKVKRKKKACDRERMIVXVMWCHPQGAVGGRTNEGWT

SEQ ID NO: 44596 - DNA, 769 bp, Zea mays
  misc_feature: Ceres CLONE 1447056-F
  misc_feature: Encodes the peptide sequence at SEQ ID NO. 44597
  misc_feature (595)..(595): n is a, c, t, g, unknown, or other
  misc_feature (628)..(628): n is a, c, t, g, unknown, or other
  misc_feature (703)..(703): n is a, c, t, g, unknown, or other
aagctggagctccccgcggtggcggccgctctagaactagtggatcccccgggctgcaggaattcgcacgagaccattacctagaacatcctaatcgaaaaaagacgatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctggagagcgtgcaggagggcgccaggtccttggccagcgccgtgggccgcaccttcggtggcgccaaggacgcgaccgtggacaagacctcgcagacggcgcacaccgcgggcgacaagctcggcgagtacagggactacaccgccgacaaggcccgggaggccaacgacagcgtctcgcgtaagacgggcgagacggcggaggccacccggaacaagctgggcgagtacanggacagcgccgtggagaaggcgagggagaccanggacgcggtggcgcagaagacgagcgagaccgcggaagcgaccagaaacagctcggggagtacaaaggacgcgcngcccggcaagggcgcggagccccgaacacacccgccgcaaggcgaggaaggcaaggacgcgacatg

SEQ ID NO: 44597 - protein, 195 aa, Zea mays
  misc_feature: Ceres CLONE 1447056-F
  misc_feature (83)..(126): Pfam Name: LEA_4 Pfam Description: Late embryogenesis abundant protein
  misc_feature (127)..(170): Pfam Name: LEA_4 Pfam Description: Late embryogenesis abundant protein
  misc_feature (138)..(138): Xaa is any aa, unknown, or other
  misc_feature (149)..(149): Xaa is any aa, unknown, or other
  misc_feature (174)..(174): Xaa is any aa, unknown, or other
MASRQNTREARAEADARRAVEELARARDEHLEKAEVNARSAADEIARSRADRGAAGGGGILESVQEGARSLASAVGRTFGGAKDATVDKTSQTAHTAGDKLGEYRDYTADKAREANDSVSRKTGETAEATRNKLGEYXDSAVEKARETXDAVAQKTSETAEATRNSSGSTKDAXPGKGAEPRTHPPQGEEGKDAT

SEQ ID NO: 44598 - DNA, 769 bp, Zea mays
  misc_feature: Ceres CLONE 1447060-F
  misc_feature: Encodes the peptide sequence at SEQ ID NO. 44599
  misc_feature (245)..(245): n is a, c, t, g, unknown, or other
  misc_feature (302)..(302): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (433)..(433): n is a, c, t, g, unknown, or other
  misc_feature (434)..(434): n is a, c, t, g, unknown, or other
  misc_feature (436)..(436): n is a, c, t, g, unknown, or other
  misc_feature (463)..(463): n is a, c, t, g, unknown, or other
  misc_feature (464)..(464): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (497)..(497): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (525)..(525): n is a, c, t, g, unknown, or other
  misc_feature (544)..(544): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (584)..(584): n is a, c, t, g, unknown, or other
  misc_feature (606)..(606): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (635)..(635): n is a, c, t, g, unknown, or other
  misc_feature (636)..(636): n is a, c, t, g, unknown, or other
  misc_feature (665)..(665): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (718)..(718): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
ctggagctccccgcggtggcggccgctctataactagtggatcccccgggctgcaggaattcgcacgagaccattacctagaacatcctaatcgaaaacttcttatccccacctccctcgcggatcactcgccgccgccgccggccgcagccatcgccgtgatgctgtccctgtcgagggcgatcgggaggcggctcttctcgtctgccgaggccgcgtcgacggctgcggtgaggacggcgcanaacccgctcgaggagttcttcgaggtcgagctgatccaccgagaggacaaggttcanaacaaagtacgctatcctgatcgacgacgtggnnncaaaacgggaaagtaatgtttttttttttttgtggggccccccccccgccacaaagccgggggggtggagggacccccccccccccnnnaaccaanntnattccactacctaacaccacacccatnnaacaaacacccaaaaaatnnnnnnccccacccncaccaaaccgcacnnnnnaaccaccacnccgagacactgagtacacnttccatcctagnnnataaccgnnnccaactcaaaaaaagnaaaaacctcaatcaactaaganannnaccccnnntaaatcagcaacaccgnntgacaaaaaaccaacacacacacccgcgngnnnngaccgcacgcacacgctacctannnnaacagagaaccacagtaagggncagatccatcacactcccaaacagtnnnnnnnnttactcgcaccgtnnnnn

SEQ ID NO: 44599 - protein, 63 aa, Zea mays
  misc_feature: Ceres CLONE 1447060-F
  misc_feature (28)..(28): Xaa is any aa, unknown, or other
  misc_feature (47)..(47): Xaa is any aa, unknown, or other
  misc_feature (59)..(59): Xaa is any aa, unknown, or other
MLSLSRAIGRRLFSSAEAASTAAVRTAXNPLEEFFEVELIHREDKVXNKVRYPDRRRGXKTGK

SEQ ID NO: 44600 - DNA, 880 bp, Zea mays
  misc_feature: Ceres CLONE 1447064-F
  misc_feature: Encodes the peptide sequence at SEQ ID NO. 44601
  misc_feature (371)..(371): n is a, c, t, g, unknown, or other
  misc_feature (372)..(372): n is a, c, t, g, unknown, or other
  misc_feature (467)..(467): n is a, c, t, g, unknown, or other
aagctggagctccccgcggtggcggccgctctagaactagtggatcccccgggctgcaggaattcgcacgagaccattacctagaacatcctaatcgaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtccccgattgagctcatcaggcccggagatgctccgccctcagggccttcgagccccatcctgctgggcnngggcgctccagcgttcaaggaacatcgacatggaggatcccgcgtcccgaaggccgccggaaagaccgtcgcaaaatctacgcccatcccgccanggccggtcggcaaagggggctcggttcccctaactaccaagaagttacggtccgacggaagcccccccaagaaaggaaggtcaaaggaacatcctttcaaccccggtaacgaaccgcaccccttttttcggttcccccgaccccccaaggggcttggcgaagccaaaaaaaaatttcgggggggtccgtggccgccccccgccccgggtttccaaaaaattccctaacccgtttgagcgccctcgcggttgccccgcgccttgtgcgggaaacgttttgcccttgggttttttcccacaccttgcccaagttccaatgcccttgaacccccgggggtttaaatttttctaacaacccgggagcctccttttttgtgggttctcaaaaaacaaagaaggctgtgttttatcccc

SEQ ID NO: 44601 - protein, 42 aa, Zea mays
  misc_feature: Ceres CLONE 1447064-F
MSTVLQRPTPGTVQCFGRKKTAVAVAYTKPGRGLIKVNGVPD

SEQ ID NO: 44602 - DNA, 1623 bp, Zea mays
  misc_feature: Ceres CLONE 1447068
  misc_feature: Encodes the peptide sequence at SEQ ID NO. 44603
aattttccgctcccatttacgccggatggaacaaaaaaaaatatcagcgagaaccctcgttttcttttttgtttagcagggggcacaagagcaagctgcaagcagattacagggccacgaagctcgcccctgctctgctctctatcttattagtccttcaattgggctttcctctgctgcggggttctgttctcgtctgggtttcagacgccagatttggagcagaacacaccggtccttggtttccttgccggctgcaatgttatggcgcttcgggggtatgtagagcctgaattctgtgatgacgggggagttagcggcgtggggagattttttctgtgctttgtcttttcttagctgagaaatctggtgctatttggtgctcgccgacgccgagccggagggcgtcatcgttgctgtgtcctctgtagctggatttgtggccattggtagagagaagcgttcttcctcggggaatccgtgggaagaagcggtctccggtgcaatcccatggcttctagggatttcctgggagggttcggccgggatggagggcaagcgcctgtgggtggcgctggcgccgccccggggcccggcggggagtcggacgagatcgagctcagcctcggcctgtccctcggcggctgcttcggcgccgagccttcgcaggaggggaggagcgccgaccctcggctccagcgctcgtcctccgtcgcgtcgatctgctccttgcctgctgccaccaccggcaccagctgcggggcgcaggacgccggcccaggccccgccgccgcgcctccgccggacctgctccgcacctcctccctgcccgcggagtacatggaggaccggctccgccgccgcgcgatgcagagccagcggcgcctcgaggccaagcgcaagcgcctcgagcgccgcaactccatgagctcgggaaggccggttccggcggccggtggccgcgacgacggcctcgagcacaccgtgcccagcggcttccagctccgccgttcggtcgccttgacgacggcggggtcgccgacgcccagccggccgcagcaagggcccgcggaccgccgtgcggcggaggcgaccggaccggacggcgcggcctgccacgacgagccgcagccgctgccgctgcgcctgcgcacgctgcggtcgctgacgatgcggacggcgagcacgggcgacctccggagcgccatggcggaggacatgcccatggtgtcgtacaaggcggagggccccggcgggcgcaagacggacgggttcctgtacaagtacaggaagggggaggaggtgcggatcgtgtgcgtctgccacggcagcttcctcacgccggccgagttcgtggagcacgccggcggcggcgaggtccccaacccgctgcgccacatcgtcgtcaacccgcagcagtcggtgttcttgtagcgcccggccgcctcggcctcgcgatggagatggaggtggtggctgtaccgtcggagctgcagaagctggaaaccttctctctcttttttttttattttgctttgtttcttttctgtttgttttggtactcatgtagtcatgtggttgctattattattacaattattattaacaaaaaaaaaaaaaaaa

SEQ ID NO: 44603 - protein, 307 aa, Zea mays
  misc_feature: Ceres CLONE 1447068
  misc_feature (34)..(298): Pfam Name: DUF1675 Pfam Description: Protein of unknown function (DUF1675)
MASRDFLGGFGRDGGQAPVGGAGAAPGPGGESDEIELSLGLSLGGCFGAEPSQEGRSADPRLQRSSSVASICSLPAATTGTSCGAQDAGPGPAAAPPPDLLRTSSLPAEYMEDRLRRRAMQSQRRLEAKRKRLERRNSMSSGRPVPAAGGRDDGLEHTVPSGFQLRRSVALTTAGSPTPSRPQQGPADRRAAEATGPDGAACHDEPQPLPLRLRTLRSLTMRTASTGDLRSAMAEDMPMVSYKAEGPGGRKTDGFLYKYRKGEEVRIVCVCHGSFLTPAEFVEHAGGGEVPNPLRHIVVNPQQSVFL

SEQ ID NO: 44604 - DNA, 760 bp, Zea mays
  misc_feature: Ceres CLONE 1447073-F
  misc_feature (446)..(446): n is a, c, t, g, unknown, or other
  misc_feature (743)..(743): n is a, c, t, g, unknown, or other
  misc_feature (744)..(744): n is a, c, t, g, unknown, or other
  misc_feature (760)..(760): n is a, c, t, g, unknown, or other
ctggagctccccgcggtggcggccgctctagaactagtggatcccccgggctgcaggaattcgcacgagaccattacctagaacatcctaatcgaaaagattcaccattgccctagcacacgtacgcgcagatccgtccgctccaatccgccccggtcacccaacccacgttttcccccacgcccccatcctttcgattcaccattgccctaccacacgtacgcgcagatccgtccgctccaatcccccttccccatcgtctcgcgacgccctcgccgccgcctcgcccccaacgatccactcgcccccacaacgattcgcttcgtggtgaagaagccacccgcgcctcgccggaaacggaagcagcaacccctagccacgctgaccctccacggcgccggcgatggggctgaagcggcctacggcgggagcgggggaggcagcancgcagaccatcacgttgtccatgtcggccatgtgggacacggtgcgcgccgccatgagggaggccgaagcagcagcactggagccaactcaaaggtgagatactcttcgattggatcttgatctcgcttctcagttctaaatcccctgcagaaacgacgccgctggtgtccatctccggcgtggcgccgccgccattttcagctgtgtatcggctgtagctcagtcgacatcttctgctacagccctcccatctctgcaaaagaatggaaccgtggatgggagggagcatccctgcnngcgatggagcagcggn

SEQ ID NO: 44605 - DNA, 757 bp, Zea mays
  misc_feature: Ceres CLONE 1447074-F
  misc_feature: Encodes the peptide sequence at SEQ ID NO. 44606
  misc_feature (374)..(374): n is a, c, t, g, unknown, or other
  misc_feature (622)..(622): n is a, c, t, g, unknown, or other
ctggagctccccgcggtggcggccgctctagaactagtggatcccccgggctgcaggaattcgcacgagaccattacctagaacatcctaatcgaaaacgggttctggctcgccaaaccctagccgccgagtgccgcccaccgcccgcccgccctccgccgcgcgtcggacggtgccgagggaagaggcaccatgaggttggagaagtgctggttctgctcctctaccatctaccccggccatggaatccagttcgtccgcaacgacgccaaggtcttccgcttttgccggtcaaagtgccataaaaacttcaagatgaagaggaaccctcgtaaggttaagtggacaaaagcatacaggcatttgcatggcanggacatgaccccaggatacacctttgagtttgagagcaacaggaacaggcccgagcgctacgaccgcaatttgacggagcagactctgaaggctatcccgcttattgcaaagattaggcatgaccgtatgggaaaacacatctcaaacagacataaacctggtaaacgcaaggagatggaaaaggactcccaggagctggagcaggacatcggcatgctcccgaagaagcttattatcaaccatctcngcggctgaaaaaacgaaggtcaagggttgaatttgttccccagcagacagaaaaataaccctattgaagagtagtgcctggcattttggggggcttggggtttccaggcctaaggcaaatccttttggatttgcc

SEQ ID NO: 44606 - protein, 145 aa, Zea mays
  misc_feature: Ceres CLONE 1447074-F
  misc_feature (1)..(75): Pfam Name: Ribosomal_L24e Pfam Description: Ribosomal protein L24e
  misc_feature (61)..(61): Xaa is any aa, unknown, or other
  misc_feature (144)..(144): Xaa is any aa, unknown, or other
MRLEKCWFCSSTIYPGHGIQFVRNDAKVFRFCRSKCHKNFKMKRNPRKVKWTKAYRHLHGXDMTPGYTFEFESNRNRPERYDRNLTEQTLKAIPLIAKIRHDRMGKHISNRHKPGKRKEMEKDSQELEQDIGMLPKKLIINHLXG

SEQ ID NO: 44607 - DNA, 740 bp, Zea mays
  misc_feature: Ceres CLONE 1447075-F
  misc_feature: Translation starting site: 568
  misc_feature (524)..(524): n is a, c, t, g, unknown, or other
  misc_feature (613)..(613): n is a, c, t, g, unknown, or other
  misc_feature (615)..(615): n is a, c, t, g, unknown, or other
  misc_feature (630)..(630): n is a, c, t, g, unknown, or other
ctggagctccccgcggtggcggccgctctagaactagtggatcccccgggctgcaggaattcgcacgagaccattacctagaacatcctaatcgaaaaatcccgtctcgtttcgtctcggtgtcgcacctctcacgacggcaccaccccagcgcggcgcgagtggagacgccgctgctccgtgcttcgccgcgcctacctaacccaagacctgccagacctgagtggctgagtgttcgtgttcggtcaaaacccaccgcgcgagcgcctccagagtccaaacccgctacaaatctcgcgctgcgcattctccccgtacgatacggcggcacggcccacgagccaggcggtggcggcagctagctagctgcggagtagcaccagccaccggagggaagtgagcggcgcgatggggcacaagccggaacgggaggcggaggagtacctcttcaggttgtgatcatcggcgacagcgcggtggggaagagcaacctgctgtcccgctacgcgcgcaacgagttcaanccccactccaaggccacatcggggtggagttcagacgcagagcatggccatcgaaggcaaaggagtcaaggcccagatctgggacacgncnggcagaagcgcttcngcgccgtcacctccgctactacggggcgccttcgggcgctctcgtctatgaatacccgcgctccacttcgacacgtcggcgctggtccagagctcaaccacattcgaccg

SEQ ID NO: 44608 - DNA, 753 bp, Zea mays
  misc_feature: Ceres CLONE 1447081-F
  misc_feature: Encodes the peptide sequence at SEQ ID NO. 44609
  misc_feature (341)..(341): n is a, c, t, g, unknown, or other
  misc_feature (424)..(424): n is a, c, t, g, unknown, or other
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaaaccaggccgccagtcccgacctccccggctccagcccccgcgcacgaccagctctgacgaccccgctcctgcctcccacctcctccggtggcctcgcgcctgactccctcctccggcacccaggccagccgcgccccgcctctcgcacaggacggaaatgatgccttctcctttttgttagctgattctgatcaaactggttagttcgatagagaatatcagtaatatcttgctgcccnaactgcagcttcaactgattccgcgtcaggagcacttagagcaaccatgggggggaaatcggagcagaagtctcgaaaagagnaggcngaaaagagcgagatcagagaaagcacagctgcgatttctttcttgggttgggcatcaggtgagtttaccaagtccctggaaaagaagagtgcaataacttgttttgctttctttactgtcttagttctgatgcacaaatccatcgagttagggtgggaaaaagaagaacccgtcatgtcagtaataaagccagttcggttgaggagaaccaaaaaaagacctgatggctgatgaaaaaaagagaagagggaacaaaaggtaagcgaagcccagtccactttcaggatatctgaaatggaaatgtggactgtaacatggagaaga

SEQ ID NO: 44609 - protein, 90 aa, Zea mays
  misc_feature: Ceres CLONE 1447081-F
  misc_feature (13)..(13): Xaa is any aa, unknown, or other
MGGKSEQKSRKEXAEKSEIRESTAAISFLGWASGEFTKSLEKKSAITCFAFFTVLVLMHKSIELGWEKEEPVMSVIKPVRLRRTKKRPDG

SEQ ID NO: 44610 - DNA, 743 bp, Zea mays
  misc_feature: Ceres CLONE 1447083-F
  misc_feature: Encodes the peptide sequence at SEQ ID NO. 44611
  misc_feature (643)..(643): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcgaaaattttgggtccacaattccgcattgccatctagtccagttccagtccgagcagcagcaagcggcggcggcgatgggctctggatccaactccaaggagggagaggagcgggtgctgagccacggtgacgtggtgctcatccgctccgacctcgcaatccttcgcggtccctgcttcatcaacgaccgcatcattgccttctacttcgcacacctctccgccagcctccaggacgacgacctcctcctgcttccgccctccatcccctacctcctctccaacctccctgactcggccgccgtcgccgccgtcgccgagccgctccgcctcgcctcccgccgcctcgtgctgcttcctgtcaacgacaatcccgatgcctccatcgccgagggcggttcccactggaccctcctcatccttgataacatcactagcccctccgtgccccgctttgtcaccacgacagcatcgctggagcgcccaacctccatcgctgcccgccctcgcgacgcactccgccccctgctgtcaggcagcattccnnagaggatactgttccgcttatcgaggggcccacccccaggcagaccaacgctatgactggggtgtctatgtcatggccatcgccagggctctgtgcgcc

SEQ ID NO: 44611 - protein, 175 aa, Zea mays
  misc_feature: Ceres CLONE 1447083-F
  misc_feature (158)..(158): Xaa is any aa, unknown, or other
MGSGSNSKEGEERVLSHGDVVLIRSDLAILRGPCFINDRIIAFYFAHLSASLQDDDLLLLPPSIPYLLSNLPDSAAVAAVAEPLRLASRRLVLLPVNDNPDASIAEGGSHWTLLILDNITSPSVPRFVTTTASLERPTSIAARPRDALRPLLSGSIPXRILFRLSRGPPPGRPTL

SEQ ID NO: 44612 - DNA, 740 bp, Zea mays
  misc_feature: Ceres CLONE 1447086-F
  misc_feature: Encodes the peptide sequence at SEQ ID NO. 44613
ggagctccccgcggtggcggccgctctagaactagtggatcccccgggctgcaggaattcgcacgagaccattacctggaacatcctaatcgaaaatatcggaagagtgtggcccgcaggggcttcccattgatctcagaggtaaaagggcattcattgctggagttgctgatgataatggctatggatgggcaattgcgaaggcacttgctgcagctggtgctgaaattcttgtgggtacatgggtgcccggcacttacatatttgagacaagtctgaggcgtgaaaagtttgatgaatcacggaagctgccagatggatctcttatggatattgttaaagtctatccacttgatgctgtctacgattcccctgatgatgttcctgaagatgtcaaatcgaacaaaagatatgcaggggcatcaaactggacagtaaaggaaagttgtgaaatcagtgagaatgattttggcagcattgacatactagtgcattctcttgctaatggcccagaggtaacgaagcctttgttggaaacctcaagaagaagctatcttgcggcaatttctgcatccagttactcctatgttccattgcgtcagcaccttcttcctataatgatcccggtggtgctagcatctctctaaactacattgcatctgaaagggccattcctgggtatggtgttgggaatgattctgctaaagcaaccccttgaaagtgatccccgggtgcttgca

SEQ ID NO: 44613 - protein, 106 aa, Zea mays
  misc_feature: Ceres CLONE 1447086-F
  misc_feature: SWISSPROT Homolog: EC 1.3.1.9 Enoyl-[acyl-carrier-protein] reductase (NADH)
MDIVKVYPLDAVYDSPDDVPEDVKSNKRYAGASNWTVKESCEISENDFGSIDILVHSLANGPEVTKPLLETSRRSYLAAISASSYSYVPLRQHLLPIMIPVVLASL

SEQ ID NO: 44614 - DNA, 761 bp, Zea mays
  misc_feature: Ceres CLONE 1447092-F
  misc_feature: Translation starting site: 336
  misc_feature (402)..(402): n is a, c, t, g, unknown, or other
  misc_feature (474)..(474): n is a, c, t, g, unknown, or other
  misc_feature (507)..(507): n is a, c, t, g, unknown, or other
  misc_feature (761)..(761): n is a, c, t, g, unknown, or other
ctggagctccccgcggtggcggccgctctagaactagtggatcccccgggctgcaggaattcgcacgagaccattacctagaacatcctaatcgaaaagatcacggacgacacagacggccaccaaatctgcacctgccccagatgcagcagaggtagtcgccacggcgccacctgcccactgcactgcccccagagcctccaagctgcatatcggaagtgaagcgcctcgcagtcctcctctcggatctcgcggtggaagtcgccggtccactcgatcagcgagcgagtcggtgccgcgcggcggattccccgacccgagcaaaggaaccggacatgcggccgcggctggtgctcttcggcgactccataaccgagctgtccttcgcgtccggcggatggngggccgcgctcaccgaccgcttcgcccgccaggctgacgtggtgctgcgcgggctcagcggctacaacacgncgtgggcgctcaaggtgctgcccgcggccatgnagggcgcggcgggcgcggggcgcggcgccgacctggcgcccgtgacagtcttctttcgcagcaacgacgcctctctgcccgaccagtgcaggcgcaccagcacgtgccgctcaagggagtacagagcaacctccgcgccatctgcgcctatttcaaggagcgatggccctccactgctgtcatactcatcactcccccaccgaattacgagccaccgagaatccgagacatgtatggagacgacgagccttccn

SEQ ID NO: 44615 - DNA, 743 bp, Zea mays
  misc_feature: Ceres CLONE 1447097-F
  misc_feature: Encodes the peptide sequence at SEQ ID NO. 44616
  misc_feature (281)..(281): n is a, c, t, g, unknown, or other
aagctggagctccccgcggtggcggccgctctagaactagtggatcccccgggctgcaggaattcgcacgagaccattacctagaacatcctaatcgaaaaaagaccaggagcccggtgaatccacctcgcccgcagcgatgtcggcgagcagcacccccgtagacgcctcgggggagccgatcccgacttcgtcggtgctgatggcggcgtcaaagcacatcgcggtccggtgccgcccggagaacgttgccttccctcaactgcagaagaaggaccctnaacccgagaagtgcctcgagaagggccgccaggtcacacgctgcgtcctcagcctgttgaaagaacttcaccaaaagtgtcccaagggaatggatgaatatgctggttgcatgtattactacaccaacgaatcccacttctgccgtaaggagcagcaagcttttgaggaagccttgcccatttccgagtagatcttgaagagtttacttgcagtggtcttcgccaaataaggaaaaaaagcagaaaaacagcgttcatgataccccatggttggtggcctccggaaatttggacgggaaaatgaaacccaccgctggagcttttcccccatttgccgcccctaggattttaaagcggcaatgcccaaaagggggagaggggttttccttttgggcccaaaaaaaaaaaaaacttttctttcccccccctcggggggggccggtccaattccccttagggggc

SEQ ID NO: 44616 - protein, 110 aa, Zea mays
  misc_feature: Ceres CLONE 1447097-F
  misc_feature (48)..(48): Xaa is any aa, unknown, or other
MSASSTPVDASGEPIPTSSVLMAASKHIAVRCRPENVAFPQLQKKDPXPEKCLEKGRQVTRCVLSLLKELHQKCPKGMDEYAGCMYYYTNESHFCRKEQQAFEEALPISE

SEQ ID NO: 44617 - DNA, 776 bp, Zea mays
  misc_feature: Ceres CLONE 1447099-F
  misc_feature: Encodes the peptide sequence at SEQ ID NO. 44618
agaagctggagctccccgcggtggcggccgctctagaatacgtggatcccccgggctgcaggaattctcaccagaccattacctggaacatcctaatcgaaaaaccatcacctcctatcgtcttttaaccaccgaatccaccgcatcgcagagacgagtagaggttagatttaggctgaggtaagatggtgtgcatccggcaggcgaccatcgaagacctgctggcgatgcaggcgtgcaacctgatgtgcctgccggagaactaccagatgaagtactacttctaccacatgctctcgtggccgcagctcctcttcgtcgccgaggactacggaggcagcatcgtcggctacgtgctcgccaagatggaggagtacttttgcaacccctgccacggccacatccactccttcggggcccccccctcccaccgcaagttcgggttcgccactaagctcatgtcccccgcgcaggcccccatgaaccaggtctttcggggctgagtacgtgtcactccacgtccggccgatccaaccgcgctgccttcaacctctacccctctaccctcgggtaccagatccaagacattcaggccaagtcctatgtctaatgggaaggaccccgttcaacttgcccaggctgctcccgcagcccccggcccaagaaggccccccccccaccaccatctcgggcccgggtgggtcttggtcccactaagcaacagtttgcgggaacgggttcttcctcccagtctttctgggttccccaaaaaaagg

SEQ ID NO: 44618 - protein, 105 aa, Zea mays
  misc_feature: Ceres CLONE 1447099-F
  misc_feature: SWISSPROT Homolog: EC 2.3.1.88 Peptide alpha-N-acetyltransferase
MVCIRQATIEDLLAMQACNLMCLPENYQMKYYFYHMLSWPQLLFVAEDYGGSIVGYVLAKMEEYFCNPCHGHIHSFGAPPSHRKFGFATKLMSPAQAPMNQVFRG

SEQ ID NO: 44619 - DNA, 844 bp, Zea mays
  misc_feature: Ceres CLONE 1447100-F
ctggagctcaccgcggtggcggccgctctagaactagtggatcccccgggctgcaggaattcgcacgagaccattacctagaacatcctaatcgaaaatcaaatcccagacgccacgccacccaacacatacaaacacacgcacgcgcgcgcgcgcgcctcccgctgttccgcaaaacaaaggaaacgaaggagaggaggccatggcgccgagaacgtcagagaaacccatggcaccggcggcggccgctgccacgggggctcacaaaccactccgacaccaagacagtacccaccgcagccccaacagtcccccaccagggctaaaatgatccccccgcaccccgccccgatatgatgttggtatatgtgtaccccggtcccgggcgtggccagtggaatcaatagatcaataaaaaccccccccggcaccacccatcaagggagctaccccacctacagtcacaataccgccccccacccgcaaccagagtcagggagaaatgaatttatcgcgcgaggccacctagtccgctgacaccgaggtgttctacgatcacaaggtttcttggacaacatgagcagcgtcgcgctaactcgccggccgccgatgggtgaagctcttgtgtgcccgagcacatcccaacctatcaagaggtgtaaggctgcctcgcaagtgggaccatactcgcgaggaggagaatactagtccactaatacgtcgcacccgcggacacggtgaccaggaaggctcgcacacaccagaagccagcactccaggagatcggttgcgccgcgctctgcgcagctcatcgcccactctcttctactgtctctggctcccg

SEQ ID NO: 44620 - DNA, 743 bp, Zea mays
  misc_feature: Ceres CLONE 1447106-F
  misc_feature: Encodes the peptide sequence at SEQ ID NO. 44621
  misc_feature (492)..(492): n is a, c, t, g, unknown, or other
  misc_feature (493)..(493): n is a, c, t, g, unknown, or other
  misc_feature (504)..(504): n is a, c, t, g, unknown, or other
  misc_feature (505)..(505): n is a, c, t, g, unknown, or other
  misc_feature (514)..(514): n is a, c, t, g, unknown, or other
  misc_feature (515)..(515): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (593)..(593): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaagactgcatcgatctgacggcctttctacgcgcaacgacgaagcttcgcgaatcccctccttccttcggcctcaccttcttattcttcgccgaacaagtcttagacgcctaatccgtagtttacatcccgaagggcggcaagggtgatccaggccgatcatggcttacgtcgagagaggtgttgtgaaagacaagcggactatatggcgactgagcataatctcagacttctttcgggctattgtcaacttcatcagaatcttctttgacacactgttctcagtggacaaaactgacagctacaagaaagggtatggtgctggtaagaagtgggatggtggacctggtggtggtggtgggcggggcccatatggaggtggagggtgaggtnngtgatttcgcnngcgaggganntnnnnnaaagggtcctcccactctatctgacatccatccaatgaccacagttctctccctggctggtgatcctgctgncgctaatgagcgcacagccgttctgcctgatgactgcttaacagatgntacacatgcttcaatatggtctgaagaacatcatagctatcgatatgttttcactgtcggacgattggatatatataatttagtgggtcggttataaacgta

SEQ ID NO: 44621 - protein, 75 aa, Zea mays
  misc_feature: Ceres CLONE 1447106-F
MAYVERGVVKDKRTIWRLSIISDFFRAIVNFIRIFFDTLFSVDKTDSYKKGYGAGKKWDGGPGGGGGRGPYGGGG

SEQ ID NO: 44622 - DNA, 785 bp, Zea mays
  misc_feature: Ceres CLONE 1447114-F
  misc_feature: Encodes the peptide sequence at SEQ ID NO. 44623
  misc_feature (397)..(397): n is a, c, t, g, unknown, or other
  misc_feature (399)..(399): n is a, c, t, g, unknown, or other
  misc_feature (411)..(411): n is a, c, t, g, unknown, or other
  misc_feature (419)..(419): n is a, c, t, g, unknown, or other
aagctggagctccccgcggtggcggccgctctagaactagtggatcccccgggctgcaggaattcgcacgagaccattacctagaacatcctaatcgaaaaaactcctgttaaaccctcgcctttccgccgcccgtcgcttcccccaaactatcgtgttcaccaccgacggcggcggcgaaacaccttgtcgccctctaccgaaatcccagcccaagcgtgagcgcccgctccccaccagtcaccatggcgccgcgctcccgcaagcgggcttcgcgccccaagccccgcccaggctcccgacgtggtggcggcggaggggacgacgaccccttcttcgagtccgcgcccaagcgccgccgcggggaccgtgaccaggacatagagagcgaggacancnacgacgacggcntggctgcncttggccgcggatttgatgaggatggggacgagggcgttaaggaggatgaggaccaggaaacggtgggggaaaaaagatccggataccgaaggattggctgaaaaaggtcactgaaattcctaagagggggcaggaggaataaccattaggatgaaaaccttttcccgaagaaaaacgggtggccgaaaatcctgccaaaaaaagcacctccaggaaaacccgcaaggaagcgggcggagaaattgcccccaggttatttccaccccgcccccccggaagggctttaagggtctttgggaaagaccccgccaacctggttaaggggggttggttttaacccaggggaaagggaaaggggggtttta

SEQ ID NO: 44623 - protein, 91 aa, Zea mays
  misc_feature: Ceres CLONE 1447114-F
  misc_feature (51)..(51): Xaa is any aa, unknown, or other
  misc_feature (52)..(52): Xaa is any aa, unknown, or other
  misc_feature (56)..(56): Xaa is any aa, unknown, or other
MAPRSRKRASRPKPRPGSRRGGGGGDDDPFFESAPKRRRGDRDQDIESEDXXDDGXAALGRGFDEDGDEGVKEDEDQETVGEKRSGYRRIG

SEQ ID NO: 44624 - DNA, 764 bp, Zea mays
  misc_feature: Ceres CLONE 1447116-F
  misc_feature: Encodes the peptide sequence at SEQ ID NO. 44625
  misc_feature (414)..(414): n is a, c, t, g, unknown, or other
  misc_feature (473)..(473): n is a, c, t, g, unknown, or other
  misc_feature (477)..(477): n is a, c, t, g, unknown, or other
  misc_feature (580)..(580): n is a, c, t, g, unknown, or other
  misc_feature (592)..(592): n is a, c, t, g, unknown, or other
ctggagctccccgcggtggcggccgctctagaactagtggatcccccgggctgcaggaattcgcacgagaccattacctagaacatcctaatcgaaaagcccgatcacggcgtcaactcaagccttcactgttcactctgacatctcgactctaaaccttcgcccgccgtcgccgcagccttcgccctcccctccatccccgcatccgaatcacgcacgcgacccttgacatggccacttacagcgacggcggcggcgaccagcggcgccttctcaccatccccaaggaaggcgagcgcatcatcgcgcccacgcgccgtcccgacggcacgctccgcaaggccatccgcatccgcgccggctatgtgccccaggaagaggtcgccatctaccagtccaagggcgccctaatgnagaagtcaggacccgacgtgcccgcggggtacgatccggcgcaagtggccgatgccaancccnagacgaaggcggccaaagagaacgagcgacggaaagagaacggcagcaggccagttcgacaaaatataaaggaaagagtatggacatagagggaactgatgcntggagaactgancaagctcttttcttcaaaacggtaaagcagaaggattcggtggaaagtgtaataaaacagaataagtggcattgcctatttccgagtcacatggcacggccgtcaccaatactacaaacaattcacaaccggaatcatctgctccagaactaaataagaaaattcgagcatt

SEQ ID NO: 44625 - protein, 111 aa, Zea mays
  misc_feature: Ceres CLONE 1447116-F
  misc_feature (21)..(47): Pfam Name: Mago-bind Pfam Description: Mago binding
  misc_feature (62)..(62): Xaa is any aa, unknown, or other
  misc_feature (81)..(81): Xaa is any aa, unknown, or other
  misc_feature (83)..(83): Xaa is any aa, unknown, or other
MATYSDGGGDQRRLLTIPKEGERIIAPTRRPDGTLRKAIRIRAGYVPQEEVAIYQSKGALMXKSGPDVPAGYDPAQVADAXPXTKAAKENERRKENGSRPVRQNIKERVWT

SEQ ID NO: 44626 - DNA, 755 bp, Zea mays
  misc_feature: Ceres CLONE 1447118-F
  misc_feature: Encodes the peptide sequence at SEQ ID NO. 44627
  misc_feature (285)..(285): n is a, c, t, g, unknown, or other
  misc_feature (310)..(310): n is a, c, t, g, unknown, or other
  misc_feature (311)..(311): n is a, c, t, g, unknown, or other
  misc_feature (387)..(387): n is a, c, t, g, unknown, or other
  misc_feature (405)..(405): n is a, c, t, g, unknown, or other
  misc_feature (453)..(453): n is a, c, t, g, unknown, or other
  misc_feature (574)..(574): n is a, c, t, g, unknown, or other
ctggagctccccgcggtggcggccgctctagaactagtggatcccccgggctgcaggaattcgcacgagaccattacctagaacatcctaatcgaaaaatataaataaacgcaagcctgccattccagttaccaaattggcacttccgtaccccgaccccggccaccgtgtggaaacagaacagcaatggcggggaggctggtgccgagcacgaagaaggcgatggagcaccgggaggagaagccaaggtgccgtcgagcgacccgggctcccgacccgacctgntgcagctgggtggcgggcagcaccnncccacatctcggagatgaagccgctgacgcgggaggcgtacgggcggcggatgtaccccgcccgaggaggagggcngcccggcgatgggccccncgcggccgcgcgcaagcgcacccagagcgccgacgggcctgagaacancgcgctgggccgaggccatccaacccgccgcgcggtccactggggaccgcgacctcgacatcccggccagtcctacatccattacccgcatgtgccggctgccagccgccccccttggccnttgccctttggcgttgtgtgtgtgtccccggacagtacaggaaggacttgccagtaaccctggttgggaacctggccaaatgtcccttgaacacgtcccttttgtaaaaatgggaactaccttactattttccaaaaaaataaaggttgggactttgggtttcaaaaaaaaaaaaaaaaaa

SEQ ID NO: 44627 - protein, 86 aa, Zea mays
  misc_feature: Ceres CLONE 1447118-F
  misc_feature (33)..(33): Xaa is any aa, unknown, or other
  misc_feature (42)..(42): Xaa is any aa, unknown, or other
MAGRLVPSTKKAMEHREEKPRCRRATRAPDPTXCSWVAGSTXPHLGDEAADAGGVRAADVPRPRRRAARRWAPRGRAQAHPERRRA

SEQ ID NO: 44628 - DNA, 754 bp, Zea mays
  misc_feature: Ceres CLONE 1447119-F
  misc_feature: Encodes the peptide sequence at SEQ ID NO. 44629
tggagctccccgcggtggcggccgctctagaactagtggatcccccgggctgcaggaattcgcacgagaccattacctagaacatcctaatcgaaaaatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgcctgcatggacagcgcagggtacatgatgacctcggacgtgctggcgagcgtcaagaggcacgccaacgcggtctctgcggcggcggtcgacaaggcccagcgcgtctgcgcggaccacccgcacgttcaggtgaaaacaatggttgagagcggggacccgcgggacgtcatctgcgacgccgccacaagatgtccgcggacctgctcgtcatgggcagccatgtttacggcttcatccaaagggcttcttgggaaacgtcagcaaccactgcgcgcaaaactgcaaatgcccggtccctcattgtcaaagaggccaagggaataaaaggcccctcgcaatgtaccctgcaactttaaccaataagggttattgcgcgaaccatataggcttttttgtccc

SEQ ID NO: 44629 - protein, 165 aa, Zea mays
  misc_feature: Ceres CLONE 1447119-F
METAAVAAAGAGRRIMVAVDEGEESLHALNWCLANVVSPAGGDTLVLVHARRPRPVYACMDSAGYMMTSDVLASVKRHANAVSAAAVDKAQRVCADHPHVQVKTMVESGDPRDVICDAATRCPRTCSSWAAMFTASSKGLLGKRQQPLRAKLQMPGPSLSKRPRE

SEQ ID NO: 44630 - DNA, 731 bp, Zea mays
  misc_feature: Ceres CLONE 1447127-F
  misc_feature: Encodes the peptide sequence at SEQ ID NO. 44631
  misc_feature (731)..(731): n is a, c, t, g, unknown, or other
ctggagctccccgcggtggcggccgctctagaactagtggatcccccgggctgcaggaattcgcacgagaccattacctagaacatcctaatcgaaaaggaggctttatttatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctccagctccaacacacatgtctcatcatccccaaagtcaatgatggactaacttggcctgggaaacgccggaagaaaggcccattgaaatacttggctatccccccccatgcttgccaaagtttgtttcccaaaacaaggaaaggactttaaaaattggctatccgcggaccgtcattcaattgaacggcccccaagtgggatggtcaatcccggttttaccacattcccacggtcccttctccccccggagggccgggcaaattgaacctgggcccccccagcctcaaaaaaaaaccttgtggaatggaacccagggcttaatggccccaaggaacggccaaccccccttttccccctagaaaaaaccccccggaaaatttcccataaaaaaattatttgcgcacagggcctcttcn

SEQ ID NO: 44631 - protein, 60 aa, Zea mays
  misc_feature: Ceres CLONE 1447127-F
MSSEKEAALAAVLDDSPTIFDKIIKKEIPSTVVYEDEKVLAFRDINPPAPTHMSHHPQSQ

SEQ ID NO: 44632 - DNA, 724 bp, Zea mays
  misc_feature: Ceres CLONE 1447129-F
  misc_feature: Encodes the peptide sequence at SEQ ID NO. 44633
ccccgcggtggcggccgctctttcctagtggatcccccgggctgcaggaattcgcacgagaccattacctagaacatcctaatcgaaaaatcgatattcggaatacccagccccattccccgtcgcccggtcggacgcaccactcgctaccagggatgtctggcgagcagaaggagaacgccgcggagctcgcgatcggcaaggagttcctcccggccaagagcctgatgaagtgcaagggggcgatccacctggagcaccaatccgaacatagcctccggcacgcggcgtcggagtcggacccgtcctcgcacgggtcgcaggtgatccagaagtctctgctctacatgaagcgcttcaggcgccacgagaatgctgaagccgtgcgtcaagtccgccacccactgagccgctacggcctcgacgagatcgagctctgctcgctcggacaactctgccacgacaccagccgtgaggcgaccgcgctcgtcccctcctcaggtccggctgttggttcctcggcgaccccggggactagaagatcgataagatgctccacgacctctccctcatcgcgaagttccagtaccgtgggagccctctcttctctcaccatctcttctcttggagtagcgggccatccacataggaggggaaattcaacattaggacgatgcaccgggtaacaattttccttgtcctcaacccactatccgttgaaggg

SEQ ID NO: 44633 - protein, 176 aa, Zea mays
  misc_feature: Ceres CLONE 1447129-F
  misc_feature: SWISSPROT Homolog: EC 2.7.7.6 DNA-directed RNA polymerase
MSGEQKENAAELAIGKEFLPAKSLMKCKGAIHLEHQSEHSLRHAASESDPSSHGSQVIQKSLLYMKRFRRHENAEAVRQVRHPLSRYGLDEIELCSLGQLCHDTSREATALVPSSGPAVGSSATPGTRRSIRCSTTSPSSRSSSTVGALSSLTISSLGVAGHPHRRGNSTLGRCTG

SEQ ID NO: 44634 - DNA, 676 bp, Zea mays
  misc_feature: Ceres CLONE 1447130-F
aagctggagctccccgcggtggcggccgctctagaactagtggatcccccgggctgcaggaattcgcacgagaccattacctagaacatcctaatcgaaaacttcaagtttaggaaaggaagcaccggagcaggcgatacggcgccgacgacaatggcagcaacaagggcttccccagtgcttctcttgctgctcaccgtccagctcagcttgctcttccgcctccccgactccccctccaccctcgccctcgccctcgccgcggaaccagagcaacagaacgccaagcagcatcgccagcccgcgctgctggtgcagtcgacgtgcaactccaccagcttctacgacctctgcatcggcgcgctcgccgccgaccccgccagctccaccgccgacgtcccgggcctcggccccatcgccgtgtccgcctccgcaaacaaacgcctccggcacggccgccttcctcggcaacgccagcgactccgctgccaccccgaaggcggaccgcgcgctcctgctagcctgcgccgggaaggtctccgccgccccgcgacacgctcgtggcggggcgcccgttcctcttcgtacagggcctaccactacacctccgttcacatgagcggccgccggggagcaccccctcggtgggccgcgcctctgtctcggcgagcgggag

SEQ ID NO: 44635 - DNA, 704 bp, Zea mays
  misc_feature: Ceres CLONE 1447137-F
  misc_feature: Encodes the peptide sequence at SEQ ID NO. 44636
  misc_feature (428)..(428): n is a, c, t, g, unknown, or other
  misc_feature (525)..(525): n is a, c, t, g, unknown, or other
  misc_feature (566)..(566): n is a, c, t, g, unknown, or other
  misc_feature (577)..(577): n is a, c, t, g, unknown, or other
  misc_feature (687)..(687): n is a, c, t, g, unknown, or other
ggagctccccgcggtggcggccgctctagaactagtggatcccccgggctgcaggaattcgcacgagaccattacctagaacatcctaatcgaaaaatctccagcccttcgccctcttctcggcccgacctcgacggtgttccaccatctcctaccctcttcttttcccgcccgcgccatccctttctccgctgtagccactgcaagccccgcgcgacgcacacggcagtggtccacgtcgaccaaatcgtccacagcatcgcgttctcctcggcgagggtctgtagcctgccggcgaggagctcgcagcgaagatccgtgcaagccaccctccagatcgtcacagctatgaatgactgcgacaaccaccattttcgccacaattcagcggatgcattgggttgttgggcattgatgattctatgcangctatgcagcatgtagcagccagactacaaccatgagtctcgcttgtcttgtatgccatggcatgagcagcccctcgcactctcttagaagctactncgtgtcaagctcaaaagaagaaagctcgtgtgaagctgtgntgcctgcttanctcaagaagtacacagctggaactctactagcgttgggacatcaaagggacccctttcccccggggggaaggatctaagtggacagagggggttctcgatttaaacgcanccggtttggtccaggac

SEQ ID NO: 44636 - protein, 64 aa, Zea mays
  misc_feature: Ceres CLONE 1447137-F
  misc_feature (22)..(22): Xaa is any aa, unknown, or other
  misc_feature (36)..(36): Xaa is any aa, unknown, or other
  misc_feature (39)..(39): Xaa is any aa, unknown, or other
MSLACLVCHGMSSPSHSLRSYXVSSSKEESSCEAVXPAXLKKYTAGTLLALGHQRDPFPPGGRI

SEQ ID NO: 44637 - DNA, 769 bp, Zea mays
  misc_feature: Ceres CLONE 1447144-F
  misc_feature: Encodes the peptide sequence at SEQ ID NO. 44638
aagctggagctccccgcggtggcggccgctctagaactagtggatcccccgggctgcaggaattcgcacgagaccattacctagaacatcctaatcgaaaaacttacctggacggggtcgacgagccgtcaagatggcccgtggcctaggtcagtggcccttattgcactccgagggtgtgctggcttaccatctcccaacgggagagtggacgtcgtaatttgttgtagagggggtacgcgttcgcgcggcccctgctaaatctactgtgttgaatatttttgtcgcagacgcattcttttgccctgcgttctcgtcggcgcaaagccgtctaggacactgacgtcccgtcgccagctgtgaacgttcccactgacaccgtgttcacaacgtattcttttaccctgcgttctcgtcggcgcacagccatcgtacatgcgagggcttcatgccttcacgcttctctctgcgcgactgcgtcaacgccggccagcgtatcaccggggtccggggacacagccacctccttctctgcggacgacgagcacgcacgccatgggtggatggaggcagcgcctgatggggagggaggttcggggagcaagtatgcacagagtggatggagacggtacatagagaagagacagtggtaggttgcagatgtacgtggtggggagacacggagaggtaggggacgtacgcgcacgtggacgggagggcgacgccgacgccgacgaaaactacgcctatgttggcagatgaagcagac

SEQ ID NO: 44638 - protein, 66 aa, Zea mays
  misc_feature: Ceres CLONE 1447144-F
MRGLHAFTLLSARLRQRRPAYHRGPGTQPPPSLRTTSTHAMGGWRQRLMGREVRGASMHRVDGDGT

SEQ ID NO: 44639 - DNA, 726 bp, Zea mays
  misc_feature: Ceres CLONE 1447147-F
  misc_feature: Pfam Name: 5_3_exonuc_N Pfam Description: 5'-3' exonuclease, N-terminal resolvase-like domain
tccccgcggtggcggccgctctagaactagtggatcccccgggctgcaggaattcgcacgagaccattacctagaacatcctaatcgaaaaaacctttctgtagaacctggtctgataaggtagccaccacatcatcagcctgatatccatcgactcttacaacctgaatttgccgtttccaaaattgacactcaataatctgagtctcgagctaagaataactgagtggctgcactagtttaaacatgtgcccccacccggacattgctttcgcggagaatgtttacgacacgcgtgtcagcgccagtgccaacacctcgagcgctatgcgccttgtactaaagtagcacccgccttcgaactgaaaaaaagggggggaatccccagcaacaacagggggctcggaccctgacttgcccgaaaaaaaaccgccgccaaaacacgaaaggccccaaggtcttcttgggagcccggaaccttaaaagattgaactccaagaaaaaaacccgggggctttgggtgggtttaaaggggggcgccccccttgccggaaaagaccttcccggaaaaggcccccccccgggggaccccttggtatttttccccaagtgggataatatttgggaaaaaaaaaaagaggaaggtggggtctctagtccgcgaaaaaagggaaagagaaagcacccccccggaggggggcgcggttctccccctggggggaggag

SEQ ID NO: 44640 - DNA, 726 bp, Zea mays
  misc_feature: Ceres CLONE 1447148-F
  misc_feature: Encodes the peptide sequence at SEQ ID NO. 44641
  misc_feature (344)..(344): n is a, c, t, g, unknown, or other
  misc_feature (383)..(383): n is a, c, t, g, unknown, or other
  misc_feature (386)..(386): n is a, c, t, g, unknown, or other
tccccgcggtggcggccgctctagaactagtggatcccccgggctgcaggaattcgcacgagaccattacctagaacatcctaatcgaaaaattcaacataaaacccttccttcgtcttcgattcagcgatttccgatctttccgtcctcggtcttcttgatttttccttcctacctccaccggttataccacctgctagcgccgtccgccgttcctcaggaaaatcctctcacctgagtatggagcagcaccccacttgcgcccagccaccggcgccggcgcccctggctgggcctgtcgtcccggtggacttcaaggtcgtcaagaagggacccgagatggngatgtatgacgcgatcggccgccgcgcgggcgggcgtcncgngcagcgccggcggggccacggcgctccaggatgacgctggaggtgtcctggtcaccgtcaggagcaacggccagggcgagtggcaagcattcagtgggaatagtttggaggagagacacatcattttcactgaaaagctatacctgcttcttcaatcgagaggaggacatgtgttcatctcaccagaaacattttgaagatcaaaacaagcttcagatcgaaggaagggattccgaaagcggcgcataaataagggggctccagcgttgcccaacaacccctggaacagctcaagaaaaatcttttccggcgaaatttcaaggctattttccctgaaata

SEQ ID NO: 44641 - protein, 77 aa, Zea mays
  misc_feature: Ceres CLONE 1447148-F
  misc_feature (12)..(12): Xaa is any aa, unknown, or other
  misc_feature (13)..(13): Xaa is any aa, unknown, or other
MTRSAAARAGVXXSAGGATALQDDAGGVLVTVRSNGQGEWQAFSGNSLEERHIIFTEKLYLLLQSRGGHVFISPETF

SEQ ID NO: 44642 - DNA, 706 bp, Zea mays
  misc_feature: Ceres CLONE 1447150-F
  misc_feature: Encodes the peptide sequence at SEQ ID NO. 44643
  misc_feature (638)..(638): n is a, c, t, g, unknown, or other
acccgcggtggcggccgctctagaactagtggatcccccgggctgcaggaattcgcacgagaccattacctagaacatcctaatcgaaaaagtaccctttctttctcttcgaaggcggcggcggcgtgtggtataaaccccgcccgtcacgccggcccgtccgtgcgtttccttttgtcttcgcttgcttgcttgcttcctttcgaaagtccttgcgtcacactcgccgatcgatcgagtctctccggattccagagaggcccaactgccgaagccatcgatcgccgccacctcttcgagcagaatagttgagaatggctgacgaggatatccagcctatcgtatgtgacaatggcactggaatggtcaaggccggtttcgctggtgatgatgcgccaagagctgtcttccccagcattgtgggaagaccacgccacaccggtgtcatggtcggcatgggccaaaaggatgcctacgtaggtgatgaggctcaggccaagagaggcatcctgacactgaagtacccgattgagcatggcattgtcaacaactgggatgacatggagaaaatctggcatcacaccttctacaacgagctccgtgtttcgcctgaagatcaccctgtgctgctgaccgangcccctctcatctcaaggccaacagagagaaaatgacgcagattatgtttgaaaccttcgaatgcccc

SEQ ID NO: 44643 - protein, 119 aa, Zea mays
  misc_feature: Ceres CLONE 1447150-F
  misc_feature (3)..(120): Pfam Name: Actin Pfam Description: Actin
  misc_feature: SWISSPROT Homolog: EC 2.7.10.2 Non-specific protein-tyrosine kinase
  misc_feature (108)..(108): Xaa is any aa, unknown, or other
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVSPEDHPVLLTXAPLISRPTERK

SEQ ID NO: 44644 - DNA, 661 bp, Zea mays
  misc_feature: Ceres CLONE 1447152-F
  misc_feature: Encodes the peptide sequence at SEQ ID NO. 44645
ctggagctccccgcggtggcggccgctctagaactagtggatcccccgggctgcaggaattcgcacgagaccattacctagaacatcctaatcgaaaaacgtccaggaaaaatatcgaaacaaggacgaaaaacacgaagaattacggaagagcaccccatcttcggtttctttcctccggacttcttcctgcttgcggcgtccgccaattcccttccctacccaaaccctagagcaaagctgaatggccctcgccacgagctcgcgagagactctgcgccgccgccggtgactgctgatccgcccgccgccgccgcgcccggtgctttgtcacgcaggaggcgacggtatggcgtcgaggcagcacaatgcacagttccacaaatccaagacgctcgacaacaaatacatgctcggagatgagatagggaagggggcgtacggccgcgtatacaaggggcttgacctggagaatggcgatttcgtggccatcaaacaggtctcgctggagaacattccgcaggaggatctcaacataataatggtgatatttttttttcttttaacttatcatgcacaggaactgacgaccagcagacgtgaggaattgcgtgaaatgtggtttcgggcggagctgtgtgcctgtgtacacagcggctgc

SEQ ID NO: 44645 - protein, 104 aa, Zea mays
  misc_feature: Ceres CLONE 1447152-F
  misc_feature (22)..(64): SWISSPROT Homolog: EC 2.7.11.1 Non-specific serine/threonine protein kinase
  misc_feature (18)..(51): SWISSPROT Homolog: EC 2.7.11.24 Mitogen-activated protein kinase
MASRQHNAQFHKSKTLDNKYMLGDEIGKGAYGRVYKGLDLENGDFVAIKQVSLENIPQEDLNIIMVIFFFLLTYHAQELTTSRREELREMWFRAELCACVHSGC

SEQ ID NO: 44646 - DNA, 649 bp, Zea mays
  misc_feature: Ceres CLONE 1447176-F
  misc_feature: SWISSPROT Homolog: EC 1.2.4.4 3-methyl-2-oxobutanoate dehydrogenase (2-methylpropanoyl-transferring)
  misc_feature (312)..(312): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (333)..(333): n is a, c, t, g, unknown, or other
  misc_feature (340)..(340): n is a, c, t, g, unknown, or other
  misc_feature (343)..(343): n is a, c, t, g, unknown, or other
  misc_feature (345)..(345): n is a, c, t, g, unknown, or other
  misc_feature (346)..(346): n is a, c, t, g, unknown, or other
  misc_feature (348)..(348): n is a, c, t, g, unknown, or other
  misc_feature (400)..(400): n is a, c, t, g, unknown, or other
  misc_feature (401)..(401): n is a, c, t, g, unknown, or other
  misc_feature (429)..(429): n is a, c, t, g, unknown, or other
  misc_feature (437)..(437): n is a, c, t, g, unknown, or other
ctggagctccccgcggtggcggccgctctagaactagtggatcccccgggctgcaggaattcgcacgagaccattacctagaacatcctaatcgaaaaaacgacgaaagcgagcaggcatggccgcgagcttatctctccacgtcactcccggctgcgggtccaagaagaagaagttcaagcaggcggggaagagcagagcagcagtgaccagtgagctgcttgtccaagaatcgctcccactcccggctgtcgggagagcgcaacccagctagccgcctccgcttcttggaggtcgatggccgcgaaggtnaaaaagggaggtgggnnnagnaggaggncancnnangtcgggcggcgctgcttgtccggcgggagcgctgggccgccggcgccgcggnncgaagcggaaggagggagggaaggcggngaaccggntcacggacgtcaaccaggcgctccacatcgccctcgacaccgacccccgcgcctacgtcttcggagaggacgtcgggttcggcggcgtcttccgctgcacgacaggcctcgccgatcggttcggcaagagcagagtggtcaacacgccgctgtgtgagcaggggattgctggatttgccatcggccaagcagcgatgggcaatcgagctatc

SEQ ID NO: 44647 - DNA, 765 bp, Zea mays
  misc_feature: Ceres CLONE 1447188-F
  misc_feature: Encodes the peptide sequence at SEQ ID NO. 44648
  misc_feature (765)..(765): n is a, c, t, g, unknown, or other
ggagctccccgcggtggcggccgctctagaactagtggatcccccgggctgcaggaattcgcacgagaccattacctagaacatcctaatcgaaaacttttcggtattcgccttgacacgcagactaggcgccagccttctgcgaactgtctctacccttgacgaaggaagaggcagccttctcaccgtcgcacccggcgatgcagcggcacgtcgcctccggccggccgtcgggcacggacggctccgacttttcttaccgcatggtcgtcgaatcccgtaaccatccaccgcccacaccgccaaagccacgcttccaacgcctctttcataacctcgcaattttgcagggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgaatgcggaccatgtcagtgctgcttcggctctacacaagcttgtcatcaattgcggttgcattctctgtgacgtgcattatccggtcagagttgttcttaaagtttgtctgccctgccctgatgcgtcttctttggtattggcggccatagaaagagtctgtaacacaagttcagcagaagaaaaatatctgtagatagatcaaagagaaaggatgggatgatatatctcn

SEQ ID NO: 44648 - protein, 64 aa, Zea mays
  misc_feature: Ceres CLONE 1447188-F
MAAGFLAIVVGELGRMRTMSVLLRLYTSLSSIAVAFSVTCIIRSELFLKFVCPALMRLLWYWRP

SEQ ID NO: 44649 - DNA, 716 bp, Zea mays
  misc_feature: Ceres CLONE 1447201-F
  misc_feature: Encodes the peptide sequence at SEQ ID NO. 44650
tggagctccccgcggtggcggccgctctagaactagtggatcccccgggctgcaggaattcgcacgagaccattacctagaacatcctaatcgaaaaaagctggatcaaacaggaacctcgtccatcacgcagcttttacatactccgtttccgaatccgttccaccattgcctattgccccaccctccccgctagggttttgccagcatggccgccgccgccgcccggaggctcctctcccgccgcgcctcctcgtcctccctctccgcgctcctccgtcgcggcgctgtcccggagcagtcgctggtgttgcgcccggctgttgtcgcggcggcctcccgcctcggcttccagcgcgggatggcgcggcggcctggcggggacggctacgtctcgacgcggtctggcgcgggcggggaccgcgcgcccatggccacggagatggcgccgctgttccccgggtgcgactacgagcattggctcatcgtgatggacaagcccggcggggagggcgccagcaagcagcagatgattgactgctacatccagaccctcgccaaggtccttggaagcgaggaggaggcgaagaagaagatctacaacgtctcgtgcgagcgctacttcgggtttgggtgcgagatcgatgaggagacatctaacaagctcgaggggctccctggtgttctctttgtgctcccggattcgtatgttgatg

SEQ ID NO: 44650 - protein, 169 aa, Zea mays
  misc_feature: Ceres CLONE 1447201-F
MAAAAARRLLSRRASSSSLSALLRRGAVPEQSLVLRPAVVAAASRLGFQRGMARRPGGDGYVSTRSGAGGDRAPMATEMAPLFPGCDYEHWLIVMDKPGGEGASKQQMIDCYIQTLAKVLGSEEEAKKKIYNVSCERYFGFGCEIDEETSNKLEGLPGVLFVLPDSYVD

SEQ ID NO: 44651 - DNA, 679 bp, Zea mays
  misc_feature: Ceres CLONE 1447203-F
  misc_feature: Encodes the peptide sequence at SEQ ID NO. 44652
  misc_feature (580)..(580): n is a, c, t, g, unknown, or other
aagctggagctccccgcggtggcggccgctctagaactagtggatcccccgggctgcaggaattcgcacgagaccattacctagaacatcctaatcgaaaaacccattcactcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaaacagcacgtgaagttcctcgccgacggatctggagcgtacaccaaggcgctcgacctcgagctcgatctcacggacaaggtctgggcgtgcgctcgaagaggtcgctctcctggncgacgacctcccggtcaccgtcgcaacatcgaggaggcgggcagtcacgatttctggccctgaggaaaccctgaaggccctttaaaaccccccacaaca

SEQ ID NO: 44652 - protein, 153 aa, Zea mays
  misc_feature: Ceres CLONE 1447203-F
  misc_feature (5)..(146): Pfam Name: Redoxin Pfam Description: Redoxin
  misc_feature: SWISSPROT Homolog: EC 1.11.1.15 Peroxiredoxin
MAPIAVGDALPDGQLGWFDENDQLQQVSVHALAAGKKVILFGVPGAFTPTCSNQHVPGFITQAEQLKAKGVDEILLISVNDPFVMKAWAKTYPEKQHVKFLADGSGAYTKALDLELDLTDKVWACARRGRSPGRRPPGHRRNIEEAGSHDFWP

SEQ ID NO: 44653 - DNA, 730 bp, Zea mays
  misc_feature: Ceres CLONE 1447213-F
  misc_feature: Encodes the peptide sequence at SEQ ID NO. 44654
  misc_feature (409)..(409): n is a, c, t, g, unknown, or other
  misc_feature (410)..(410): n is a, c, t, g, unknown, or other
aagctggagctccccgcggtggcggccgctctagaactagtggatcccccgggctgcaggaattcgcacgagaccattacctagaacatcctaatcgaaaaaaaaactctcgctccctctcgcagacgcgcctaggtctagctagggtctggtctcgctgccccgccgcgcgcgcattcacaagcttctagacgttccgaggaggaggggaggtacccgccgccgcagccatggcgtcgactaaggtccagcgtatcatgacccagcccatcaacctcatcttccggttcctacagagcaaagcgcgcatccagatctggctcttcgagcagaaggacctccggattgagggtcgcattatcggattcgatgagtacatgaacttggtcctcgaagacgctgaggaaanntcacgtcagaaaacactaggaaatccctggcccgggatcctcttcaaggggacaatttaacttggatgaagaacgtgggcaagggaaatttcttaggcagaacaaagttggggcgcccccttcaatattcgggacccaaggggccccccccccccccccaaaattaaaggaggaacccggccttgggggtttagggggagggtgaaacttttttccccccccccccccgggggggggggcggggacaattttcccctttaggggggtaataagccccgccccggggggccttttatacacgcggggggggaaaaccctgc

SEQ ID NO: 44654 - protein, 79 aa, Zea mays
  misc_feature: Ceres CLONE 1447213-F
  misc_feature (19)..(69): Pfam Name: LSM Pfam Description: LSM domain
  misc_feature (60)..(60): Xaa is any aa, unknown, or other
MASTKVQRIMTQPINLIFRFLQSKARIQIWLFEQKDLRIEGRIIGFDEYMNLVLEDAEEXSRQKTLGNPWPGILFKGTI

SEQ ID NO: 44655 - DNA, 969 bp, Zea mays
  misc_feature: Ceres CLONE 1447216
  misc_feature: Encodes the peptide sequence at SEQ ID NO. 44656
aaccgaagcggaaaagaagatcaaaaaatcggggagaaaccagaactggagagaagaaaataaataaatttatggccaaaccctagccgagacccgccccgcttgcgctctccgccgagcgccccaccccctctccgtccgcgatgcgccgggcgaagccgccgccgcagcagccctcgccgtcgccggagattcggtaccgcggcgtgcggaggcggccgtcggggcgctacgccgccgagatccgggacccggccaagaagaccccgatctggctcggcacctacgactgcgccgaggccgccgcgcacgcctacgacgccgctgcccgatctctccgcgggcccaccgcccgcaccaacttccccagcgctgcggtccgtgcgccgcggcacagggctccctccgcctccgccgcagctcccacggcgccggcggccgcggccacgtccagccacagcagcaccgtcgagtcgtggagcggcggcgcaccccgcgccgccgccctgccgcggagcgccgtgcccatggaggaggacgatgacgaggactgccacagctactgcggatcctcgtcgtccgtcctctgcgacgacgcatgcggcgacgacgcggtggcgtcccgcgcgcccctgccgttcgacctgaacctgccgccgcctcttgacgcggccgctgagacccatcagatgggtgcccgctacgacacactactccgcctctagctcccgagaacggccaggaatcagaggaaggatcgacattcgacaccgcttgttcttcttcggctgctgacccggtggtgctctctcgctagatgggataattcttgcctctttcccctttctttttttcttttcttaccaccacgacgatggtgaagattccacattatgtgaataattcagttacgtccatgtaatttgtgaggaaggaaatctgagcttttctttaaaaaaaaaaaaaaaa

SEQ ID NO: 44656 - protein, 193 aa, Zea mays
  misc_feature: Ceres CLONE 1447216
  misc_feature (17)..(68): Pfam Name: AP2 Pfam Description: AP2 domain
MRRAKPPPQQPSPSPEIRYRGVRRRPSGRYAAEIRDPAKKTPIWLGTYDCAEAAAHAYDAAARSLRGPTARTNFPSAAVRAPRHRAPSASAAAPTAPAAAATSSHSSTVESWSGGAPRAAALPRSAVPMEEDDDEDCHSYCGSSSSVLCDDACGDDAVASRAPLPFDLNLPPPLDAAAETHQMGARYDTLLRL

SEQ ID NO: 44657 - DNA, 681 bp, Zea mays
  misc_feature: Ceres CLONE 1447220-F
  misc_feature: Encodes the peptide sequence at SEQ ID NO. 44658
ggagctccccgcggtggcggccgctctagaactagtggatcccccgggctgcaggaattcgcacgagaccattacctagaacatcctaatcgaaaaacaacaccgcgcgcgcaatacacgggacacacgcagatccgagctaaccaccgcagatccgagattatccagccggagcgaccttttcttttttcttttacacagcgggacagagaaaggagtcaggcagccaaagccacccaccgcttttaccgatcggcgttgccgccaccgctagcattgtcggcttcagctccatcaaatcccacgccagcaagcaagccggcgccatgggtctgccgatgaggagggagagggacgcgaaggcggaactgaacctgccgcgggggtcccggtcccaccccacgacgacgagctggtggagcactacctgggccccaagggggcgggtaacccctcccccgggccctcatccccaagggggacctgaaaggttcaaccccggggaccggccggaagcgggccttttggggcccgaaggggttttcttcccccccggggaccggagttccccaagggcccccgccccaaaccccccccggaaaaggttttgagaggccccgtctttaaaaaaaccttccccccggggggcgccccgggaaaaaaaaaaaggcgccctctccc

SEQ ID NO: 44658 - protein, 94 aa, Zea mays
  misc_feature: Ceres CLONE 1447220-F
MGLPMRRERDAKAELNLPRGSRSHPTTTSWWSTTWAPRGRVTPPPGPHPQGGPERFNPGDRPEAGLLGPEGVFFPPGDRSSPRAPAPNPPRKRF

SEQ ID NO: 44659 - DNA, 692 bp, Zea mays
  misc_feature: Ceres CLONE 1447227-F
  misc_feature: Encodes the peptide sequence at SEQ ID NO. 44660
  misc_feature (437)..(437): n is a, c, t, g, unknown, or other
  misc_feature (669)..(669): n is a, c, t, g, unknown, or other
  misc_feature (672)..(672): n is a, c, t, g, unknown, or other
  misc_feature (689)..(689): n is a, c, t, g, unknown, or other
ggagctccccgcggtggcggccgctctataactagtggatcccccgggctgcaggaattcgcacgagaccattacctagaacatcctaatcgaaaagtaactttccagacccgaccgcagcagcccggggcaacaagcgaaccgacggcggcgatggggatcggtgagcacttcgagggcgtcaagcatcactgggcgagcaacttcgccttcctcgactacttcaagaaggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgccccactcggcggcgtcgcgctcaagtactccaagggcgccgcacgggcgtcctgctgggnaccggtttggggcgaataccggggcctggctggattctcagggggcggaaccctgggaaccaacctttccaaaaaagaaaaaaaagggggcccacccccccggttcctcatctggggggggggaaaaagggtccggccaaaaaaaaaaaaccccccgcggggggggggttgtttgtttttttccggggccccccggggggaaaaaaatatagggcgccctcctggggggggnttntttttttttttctcccnccc

SEQ ID NO: 44660 - protein, 178 aa, Zea mays
  misc_feature: Ceres CLONE 1447227-F
  misc_feature (95)..(95): Xaa is any aa, unknown, or other
  misc_feature (173)..(173): Xaa is any aa, unknown, or other
MGIGEHFEGVKHHWASNFAFLDYFKKVYGRAEPLPKWSDADVDEFIASDPVYGPQLKALRESRKFALAGALVGAAPLGGVALKYSKGAARASCWXPVWGEYRGLAGFSGGGTLGTNLSKKEKKGGPPPRFLIWGGGKRVRPKKKNPPRGGGCLFFSGAPRGEKNIGRPPGGGXFFFFS

SEQ ID NO: 44661 - DNA, 673 bp, Zea mays
  misc_feature: Ceres CLONE 1447228-F
  misc_feature: Encodes the peptide sequence at SEQ ID NO. 44662
ctggagctccccgcggtggcggccgctctagaactagtggatcccccgggctgcaggaattcgcacgagaccattacctagaacatcctaatcgaaaagagaagggcagcagaggggagaaaaaaaaggaaatctataggcggcggccggcgagcgagaacagcgcgcgctgtgccagggcgagggcgacttctacctgcgctactacgtgggacacaagggcaagttcgggcacgagttcctcgagttccagttccgccccgacggcaagctcctctacgccgacaactccaactacgagaacgacaccatgatccgcaaggaggtcttcgtctcgccctccgtcctccgcgaggccaggaggatcatccaggagtccgacatcatgaaggaggacgacagcgactggcccgagcccgaccgcatcggccgccaggagctcgagatcgtcatgggcaacgagcacatttcattcaccacttccaagatcggctccctcgtcgatgtccactccagcaaggacccggagggcctccggatcttctactaccgtggccaggatctgaagtgtttcgtgttctcgctcatcaaccttcacttcaagatcaagccaatccagtcttgagctccatcccaagccttcatgtagctggttcgtgacactgcgagtgtt

SEQ ID NO: 44662 - protein, 104 aa, Zea mays
  misc_feature: Ceres CLONE 1447228-F
  misc_feature (1)..(102): Pfam Name: Mago_nashi Pfam Description: Mago nashi protein
MIRKEVFVSPSVLREARRIIQESDIMKEDDSDWPEPDRIGRQELEIVMGNEHISFTTSKIGSLVDVHSSKDPEGLRIFYYRGQDLKCFVFSLINLHFKIKPIQS

SEQ ID NO: 44663 - DNA, 837 bp, Zea mays
  misc_feature: Ceres CLONE 1447234-R
tcgagacgaaagtgggttaataaaaaaatatagcattctatgtttacattgtgctgtaggaggagctgcacagcaccttacacaccagaatgagacatcctggaagaaacaatgaccatcgcgacatgcaagcaattgattaagcagaaaacctggagtcatctactccatccattcgcaatccaagaagaggcttcaagaatttgttttgggatcacaatgcaagccttcaataatttgaatcatcaatgggaccagtccctgttaagacatcgctgagccggagaggtatacagagggggaggagacgaagcagtcttttatgctgtcttagacaacattgacagcagattgggcagttgatgctgcaactaatggaaggtgtccaagtccctctgtcctgtagggactatctgtctggaggtgaaagcttcagctgggccttacagtcttgtgaactgtttcaagtcggcgtgtacgtacgtacgcagtagatcagtgggagagatcgttaataatttccccatttgtagcggcggaagaggtcctcggtctgcgcgttacggaacgcgctgcagccgacgacgtagacgaagatgagcgcgacggtggccctgcgccactgctcgcgcaggccgcccagcacgccgggcttgcatgaggcgcaggcgtaacagagcagggtcggggtcgttgctccacgccagcaattcgcgtccggcggccgggctcgtcaacgcgtcgggctcgggtacccgtacccgcaaacggtgggtggctgcaacaaccggactgcccattaagcatcgttaactaatcggaacaggtggagttgtt

SEQ ID NO: 44664 - DNA, 775 bp, Zea mays
  misc_feature: Ceres CLONE 1447242-F
ctggagctccccgcggtggcggccgctctagaactagtggatcccccgggctgcaggaattcgcacgagaccattacctagaacatcctaatcaaaagttgttggcttcgtggtccgtgtttaacgggcgtagagagagaaagagaacagagcgagagagggggaggacgaagccctccgcgtcgtctcctgctgttccatcccacatctattctgcctcggcttgcaccttcgacctcgctggtgaacatctctggttctattttcatcgtcgggtaacaagaaactaatcagggagtctcttcccatttcttgcagtggaggaatgtttagctacagccgcgcagcatgctttccagagcataaattggtggaagagaagtttgatgctaccactttgccagaagaaccgagccagacacaataacatcaaactgagtctgagatactgcactttacaaattctttcgatattggcagattgaagaccaacaagatttgaagagcagcaagatcagcttgcacctgcagtttgaagaaatcctttcaaagaagactgcttgcggcaatcttgccttcactccacaagcatgtgctgtgttatgcgtaccatgtaatgattgtagtacttgacaactgataccaaagtagtggatgcttttctttcgcatgaagtcatgttgatttttgtacgttctaacagcgtctcccatcatatcctattgaatctccaaaaaaaaaaaaaaaaagcttatcgataccgtcgacctcgagg

SEQ ID NO: 44665 - DNA, 756 bp, Zea mays
  misc_feature: Ceres CLONE 1447244-F
  misc_feature: Encodes the peptide sequence at SEQ ID NO. 44666
aagctggagctccccgcggtggcggccgctctagattagtggatcccccgggctgcaggaattcgcacgagaccattacctagaacatcctaatcgaaactcttgtttcgccgaaccccaaaccctaccttcgctcgttgcggcggcgagccggcgatggcgaagtctctgcgatccaaacgcgacaagcggcttcggacgttgcgccgggagatagcggagccgttctaccacaagaaggaggccgccaagctcgtcgcgcaggccgccgccctagctgctgccccgctcccggtccgcgggcccccgccatcccaggatgccggcagctcccgcgcagctagctcggcctcggctatggatgtggagatgtctgaagcaaggaacaacaggtctaagaccttcttgaggccactcgccaccattagcaagaagaaggtgcagcttcatttgaagatcaagaaagacaagagaaaagctaggaagaagggaaagttttcttttaagaagtagaggagtgtatgataaatcatgcaggtttgttcccagtttgtataacaaacgcactgcagtcatgtcatgtggcgcacctacctaagtccattcgagggtgacctactattacatatgttgaaatgggtacgaaaacaggatagtgctgacctatcagctgtttctgttctgcgcggactaacgtcaagtactcaaattgctgagatttggcttaagaagaaaaaaaaaaaggcttatcgatag

SEQ ID NO: 44666 - protein, 118 aa, Zea mays
  misc_feature: Ceres CLONE 1447244-F
MAKSLRSKRDKRLRTLRREIAEPFYHKKEAAKLVAQAAALAAAPLPVRGPPPSQDAGSSRAASSASAMDVEMSEARNNRSKTFLRPLATISKKKVQLHLKIKKDKRKARKKGKFSFKK

SEQ ID NO: 44667 - DNA, 700 bp, Zea mays
  misc_feature: Ceres CLONE 1447247-F
  misc_feature: Encodes the peptide sequence at SEQ ID NO. 44668
aaagctggagctccccgcggtggcggccgctctagaactagtggatcccccgggctgcaggaattcgcacgagaccattacctagaacatcctaatcgaaaacccgttcctcacgccgcctccacgcctccaacagaagaaccctaagctgccctcgctccggcgccgccacctcgtcgtccgtccgcatcgattcgatggcccgcgtctccgccttcgtcgccgccgtgatcaccgccgccgttgtcgttgacgcgctgttcacagccgcctccgccaccgaggcaccggcccccgccccgatgtccggcgcgggcgccctctcagcgcagctctccgtcggctgcctcgcggcgctcctcgccgctttcctccgccactgagcggtggggccgccccgtctgcgtgcgcgtcttcagatctagtggtacagtggtagtgagagttgcagtctaatgttagtcgcaggtatcgtagcggtggtgatagtgttatgaagatgaggcatttggttttgttccacgtggtggatggatggatggatgaatctgggcgtttggagagtttttctttttgatgctggatttgatttagcatgattggtgttagtttattactattattatttattatttgcgtttctgtacctactgctcaccggctctgaggggattattattatggatttatgatgttttat

SEQ ID NO: 44668 - protein, 61 aa, Zea mays
  misc_feature: Ceres CLONE 1447247-F
MARVSAFVAAVITAAVVVDALFTAASATEAPAPAPMSGAGALSAQLSVGCLAALLAAFLRH

SEQ ID NO: 44669 - DNA, 762 bp, Zea mays
  misc_feature: Ceres CLONE 1447249-F
  misc_feature: Translation starting site: 211
  misc_feature: SWISSPROT Homolog: EC 2.7.11.1 Non-specific serine/threonine protein kinase
aagctggagctccccgcggtggcggccgctctagaactagtggatcccccgggctgcaggaattcgcacgagaccattacctagaacatcctaatcgaaaacgcgtcctccctgccgttccccttcttcagttctgccgctgctgctgccgctgccaccctccgtccgcgtccagatcccgccaccccaaccgatctgccggcctccagcatggcggcggcggcgggggcgagggcgagggcgaaggcagcgggagccctggcgctggcgctcgtgctcgcgctagcgggggccaactccgagggcgacgcgctctcggcgctgcgccgcagcctcagggaccccggcggcgtgctgcagagctgggaccccacgctcgtcaacccctgcacctggttccacgtcacctgcgaccgcgacaaccgcgtcacccgcctgaaaactctctagggtagcagactggtcaggatttcatatttcattgaagaatttatgacaatttaagacacacacatgagatcttggtaatttgaacttatctggtcatctggtgcctgagcttgggaaattggagcatctgcagtacctggaactttacaagaacagcattcaaggaacaatcccttctgagcttggtaatttgaagaatctaataagcttggacttgtacaagaacaacatttcggggacaatacctccttcccttggaaagttgaaatcccttgtattcctgcggctcaatggcaatcatttgactgggcc

SEQ ID NO: 44670 - DNA, 702 bp, Zea mays
  misc_feature: Ceres CLONE 1447251-F
  misc_feature: Encodes the peptide sequence at SEQ ID NO. 44671
ggagctccccgcggtggcggccgctctataactagtggatcccccgggctgcaggaattcgcacgagaccattacctagaacatcctaatccaaacgggcacgggcacgggcaccggcacggcacgggccacggttataaataaccacacaccctcaagggctgaaccgaaccaagcagtaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggcgacggtgcagaagctgtgcagccactacttgacgctgacgctggacccactggccaacagcccgtcgctgttcgccggcatgtacacgctgccccccgcgacccacgccaagttccccaggtgctggtaggagggggcccatggcgctgacaccgataccgccccaggtggagttccacgttgggcataacacgaatgaatccgatctaacctggccccccaagccagctagacgagagcaagcgccgtcccaggtctggccattgccccggaaagggatcgccctgcgggcaagggccccatgccttcccccgatgcggagagcatacacattta

SEQ ID NO: 44671 - protein, 80 aa, Zea mays
  misc_feature: Ceres CLONE 1447251-F
MASPKPSSAALLLLAAAAVLALARADLTHDNCVKNKKATVQKLCSHYLTLTLDPLANSPSLFAGMYTLPPATHAKFPRCW

SEQ ID NO: 44672 - DNA, 829 bp, Zea mays
  misc_feature: Ceres CLONE 1447253-F
  misc_feature: Encodes the peptide sequence at SEQ ID NO. 44673
  misc_feature (269)..(269): n is a, c, t, g, unknown, or other
  misc_feature (277)..(277): n is a, c, t, g, unknown, or other
  misc_feature (351)..(351): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (794)..(794): n is a, c, t, g, unknown, or other
ggagctccccgcggtggcggccgctctagaactagtggatcccccgggctgcaggaattcgcacgagaccattacctagaacatcctaatcgaaaaacacggatcgaaaacgaattaccctcggtgccctccctctcggcggcggcgcaagtccccttcatctccggcgcggcaaatggcaggtggcagggttgcacatgctaccctcaagggccccagcgtggtgaaggagatcttcattggactgaccctgggtctgatcgctggangtatgtgnaagatgcaccactggaacgagcagaagaaactagatccttctacgacatgcttgacagggccagatcagcgtcnttcgtcaagaagtattcccacttgtcacctcaaaagttttttttttccagtggtttttaaaaaccccctctgagaggacccacaaaatgaaaggcttggaaaatttggccttgaaaaaaacccaaaccttttgaaaaaccccccccccggaaaaattgcttttctcggccagcaaaaaaaaaaaaaaaaaaaaatttttttttccccccccccccggggggggggccccgcgcaccccaccccccaaaaagagggaaataaaaacccccccctcgcgggccgttttttataacaccgcggggagaaaaaaacacggggccccaaaaataaattgtggggggaaacaccccttctctcccccgcgggagaaaaaaaaaaaaaaccccccccccccccctcccctcaaaaannnnngagagagggaggagaaaaaaaaacggccnttttttttttttccccccccccttttttttttcca

SEQ ID NO: 44673 - protein, 82 aa, Zea mays
  misc_feature: Ceres CLONE 1447253-F
  misc_feature (2)..(56): Pfam Name: COX5C Pfam Description: Cytochrome c oxidase subunit Vc (COX5C)
  misc_feature: SWISSPROT Homolog: EC 1.9.3.1 Cytochrome-c oxidase
  misc_feature (32)..(32): Xaa is any aa, unknown, or other
  misc_feature (34)..(34): Xaa is any aa, unknown, or other
  misc_feature (59)..(59): Xaa is any aa, unknown, or other
MAGGRVAHATLKGPSVVKEIFIGLTLGLIAGXMXKMHHWNEQKKLDPSTTCLTGPDQRXSSRSIPTCHLKSFFFPVVFKNPL

SEQ ID NO: 44674 - DNA, 709 bp, Zea mays
  misc_feature: Ceres CLONE 1447256-F
  misc_feature: Encodes the peptide sequence at SEQ ID NO. 44675
  misc_feature (597)..(597): n is a, c, t, g, unknown, or other
  misc_feature (613)..(613): n is a, c, t, g, unknown, or other
  misc_feature (624)..(624): n is a, c, t, g, unknown, or other
  misc_feature (690)..(690): n is a, c, t, g, unknown, or other
ggagctccccgcggtggcggccgctctagaactagtggatcccccgggctgcaggaattcgcacgagaccattacctagaacatcctaatcgaaaactagacgcatccgcaagctgcgactcactcgccctcgtccgcagcgcccacgaaacgcgccgccgccgccgtgacatcgcagcggcgtcggcgtcgtctcggccgctccccgccgtagggccattttcgctcgagctgccggagaccatgtcgagcggtctagacatgtccctggacgacctcatcaagcagtctaagtcccgacccaaggccaaccccgcgtcctcgtcggggcctgcccgccgcgcgcaccccgctcgcgccgcgccctacccaccggtcgctcccaaggcccgtgccaccgcccactcgccttacggggtctactccgagcagatcgccgctatagccgcggccgcgccgctgccggccaaagcaaggtcgctcgagacgggaatgaagctgcacatctccaatcttgactccggcgtcacggtcgaagatgtccaggaactcttctcagaagttggggagctcaagcgtttattcatgaactatgancaggatgggagatccnaggggactgcngaagttgttttttgcaaggaaagtggatgctttggatgctatcaagagatacaatggtgttctacnttgatgggaagcaaatgaa

SEQ ID NO: 44675 - protein, 154 aa, Zea mays
  misc_feature: Ceres CLONE 1447256-F
  misc_feature (118)..(118): Xaa is any aa, unknown, or other
  misc_feature (124)..(124): Xaa is any aa, unknown, or other
MSSGLDMSLDDLIKQSKSRPKANPASSSGPARRAHPARAAPYPPVAPKARATAHSPYGVYSEQIAAIAAAAPLPAKARSLETGMKLHISNLDSGVTVEDVQELFSEVGELKRLFMNYXQDGRSXGTAEVVFCKESGCFGCYQEIQWCSTLMGSK

SEQ ID NO: 44676 - DNA, 675 bp, Zea mays
  misc_feature: Ceres CLONE 1447263-F
  misc_feature: Encodes the peptide sequence at SEQ ID NO. 44677
ctccccgcggtggcggccgctctagaactagtggatcccccgggctgcaggaattcgcacgagaccattacctagaacatcctaatcgaaaaagatcaccaactggaaaaaataacacgcacgcaagaggagaaaacaatccgcaaatcggcgctcggcttccgtcctttccgtgcctccgccgatccgccgcaaccgcgtcgtccgtccccccgttcggtcgccgccctctttcccgcctcccttctcggcctccgtcctcctccgcgtccgcggcctcctcctcgtgcttcatgtctgcgctcttcaacttccactcgtttgtgacggtggtgctgctgctgatctgcacttgcacgtacctcaagatgcacttcccctccctcctcatccgccggacagggttccgtggtttcttttggaaggctgctaggataggtgaacgccttagcccctgggtagccattgggtgctctgtgatgggcatatcaattttattttggtgaaattggaagatttgtatggccttctttgcttacgattactccattaagagaagcatcagaattttgcagttacagtctgattcttcgagatgtcgcatgcttgtaatcttgtagctgtggtgtattattgtgctatgttatgcattttgactattgggcaccatcatgt

SEQ ID NO: 44677 - protein, 70 aa, Zea mays
  misc_feature: Ceres CLONE 1447263-F
  misc_feature (2)..(71): Pfam Name: DUF1242 Pfam Description: Protein of unknown function (DUF1242)
MSALFNFHSFVTVVLLLICTCTYLKMHFPSLLIRRTGFRGFFWKAARIGERLSPWVAIGCSVMGISILFW

SEQ ID NO: 44678 - DNA, 688 bp, Zea mays
  misc_feature: Ceres CLONE 1447280-F
  misc_feature: Encodes the peptide sequence at SEQ ID NO. 44679
  misc_feature (417)..(417): n is a, c, t, g, unknown, or other
ctggagctccccgcggtggcggccgctctagaactagtggatcccccgggctgcaggaattcgcacgagaccattacctagaacatcctaatcgaaaaacaaccagtcgcctacccactgcctcgcatcggcatcggcgtgccggtgctgccaagctaaaattccccaactcgcgtcgcgtcgtcagtgtgcgtgccagtcctccggcccaaaccccccgcacccaacccccagccccggcaaccgatggcggggtccgcggccgacgcggagcaggagcaaaagcgggcagcggcggcggcgtacgactacgagggcgacgcgcgctgggccgagtactggtccaacgtactcgtcccgccgaacctcgcctcccgccccgacgtcgtcgaccacttgaagcgcaagttctaccancgctacatcgaccatgatctggtcgttgagccaaggtcattcaccagttccactcaggccagcaggccagatgtaaggtcttcgtcttcgtcatccaccgagaacgtcagggagcgtaattcaggatctactgcaaggtcagcgccctcaccaccggcaccaacacatacagacagtgccgtccaaccctttacggttcgacgcacgcactatacatttctccatcaacgcatggatacttgtgggtgctggtctggggaatgcttttaat

SEQ ID NO: 44679 - protein, 146 aa, Zea mays
  misc_feature: Ceres CLONE 1447280-F
  misc_feature (57)..(57): Xaa is any aa, unknown, or other
MAGSAADAEQEQKRAAAAAYDYEGDARWAEYWSNVLVPPNLASRPDVVDHLKRKFYXRYIDHDLVVEPRSFTSSTQASRPDVRSSSSSSTENVRERNSGSTARSAPSPPAPTHTDSAVQPFTVRRTHYTFLHQRMDTCGCWSGECF

SEQ ID NO: 44680 - DNA, 677 bp, Zea mays
  misc_feature: Ceres CLONE 1447281-F
  misc_feature: Encodes the peptide sequence at SEQ ID NO. 44681
ggagctccccgcggtggcggccgctctagaactagtggatcccccgggctgcaggaattcgcacgagaccattacctagaacatcctaatcgaaaaaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccggctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaccacggctcagagattcaggatgccttacttgagatagttggcaggcgtactgtcccctcaagtttttgtccatggaaagcacctgggtggttctgacgatactgttgactcctacgaaagtggaaaattggctagacttctaaacatcggagtcaaggacgacctttagaggaaatgctcaatcggtcaaccctgttcgtttgggttcaaacccggaccggctcctaatactttcaatatgggttttggcccctaagagaaaag

SEQ ID NO: 44681 - protein, 111 aa, Zea mays
  misc_feature: Ceres CLONE 1447281-F
  misc_feature (44)..(105): Pfam Name: Glutaredoxin Pfam Description: Glutaredoxin
MVALLGRRIGVAAAAAAFIALVAFGSGSSSPKSFVKSTVSAHDVVIFSKSYCPYCKRAKAVFKELELKKEPYVVELDQRDHGSEIQDALLEIVGRRTVPSSFCPWKAPGWF

SEQ ID NO: 44682 - DNA, 669 bp, Zea mays
  misc_feature: Ceres CLONE 1447284-F
  misc_feature: Encodes the peptide sequence at SEQ ID NO. 44683
tggagctccccgcggtggcggccgctctattctagtggatcccccgggctgcaggaattcgcacgagaccattacctagaacatcctaatcgaaaactagttgttggttctttctattcagtctggcaaaagagcgcttggtgcctgtgaaaggcctcgcgaaggtggtccagtgggtgaaagaccacgggtacaagcgcgcggcggtgaccaacgcccccaggatcaacgcggagctgatgatctcgctcctgggcctctcggacttcttccaggccgtcatcgtcggaggcgagtgcgagcagccaaagcccgcgccgtacccttacctcagggccctcaaggagctccaggtgtccgcagagcacagcttcgtcttcgaggattctcctgctggtatccgggctggccccacggcggggatgcctgtcgtcggtgtggcgacgaggaacccggagaagtccttggtggaagcaggagccgcattgctcgtcaaggactacgaggatcctaagctctgggcagcgcttgaggagatggacggagaggaagctaacctgaagaaggccagcgaatgatctgatatgacgatgagccattgattagatttattgcagatttaatctgcctccagcatgattctgttcctagttatgcgctgcggagaga

SEQ ID NO: 44683 - protein, 112 aa, Zea mays
  misc_feature: Ceres CLONE 1447284-F
  misc_feature: SWISSPROT Homolog: EC 3.1.3.18 Phosphoglycolate phosphatase
MISLLGLSDFFQAVIVGGECEQPKPAPYPYLRALKELQVSAEHSFVFEDSPAGIRAGPTAGMPVVGVATRNPEKSLVEAGAALLVKDYEDPKLWAALEEMDGEEANLKKASE

SEQ ID NO: 44684 - DNA, 679 bp, Zea mays
  misc_feature: Ceres CLONE 1447288-F
  misc_feature: Translation starting site: 515
  misc_feature: Pfam Name: LEA_4 Pfam Description: Late embryogenesis abundant protein
ggagctccccgcggtggcggccgctctattactagtggatcccccgggctgcaggaattcgcacgagaccattacctagaacatcctaatcgaaaaattggctatgccgatccattccaagtactgtcgaggagaatgctaaagcgagtgacatttccccctgccgagctggttgtagaaaccgaagtggtctccatccagaactaggtgagttaccacgacggcaagaccgaggacggtgccgatgagaagaccgggcagatgtatgggcgcgacgcaggacaaggtcaggcatgaccacggaggccagcaagcagaaggccgacgagacggccgaggcaacgtagcagaggactgggcacttcaccgtaggctaccaagcataatgccggctagacggccgatgcctccaatcataacgccgccgatgccaaggacaagactgcgcagacggcgcaggcggccttgtagaagacgtacgagacggcgcactctgccaaggtacgcgcctcccatggcaggaccgtaccgccagcaccctcggcgagaagacggatgcagtgaaacacaagtcgccgatgacacggaggcggccagcccgaaagccgccgaggcgaccgatgcggtcaagcagaacgcgtcggaaactgcgcgttacaccatggagtccccctcacct

SEQ ID NO: 44685 - DNA, 651 bp, Zea mays
  misc_feature: Ceres CLONE 1447295-F
  misc_feature: Encodes the peptide sequence at SEQ ID NO. 44686
  misc_feature (390)..(390): n is a, c, t, g, unknown, or other
gctctttactagtggatcccccgggctgcaggaattcgcacgagaccattacctagaacatcctaatcgaaaaacacccatccaccgagctgccctgctacacggtcccctgccaagatccatcttcccggttacgccgcctgatcgaagtgaacaagcaaggaagagccatggcgagcgagcacgcggcggggggcgaggctaagcatgaccagaagcagagcctgatggacaaggcgaaggggttcgttgtggagaagatcgcgcacatccccaagcccgaggcgacgctggacggcgtgacgttcaagggcctgagccgggagtgcatcacgctgcacagcagcgtgaacgtgtccaacccctacgaccaccgcctccccatctgcnaggtgacctacacgctccggtgcgccggcaaggaggtggcgtccggcaccatgccggaccccggctggatcgccgccagcggctccaccgctgtggagatccccgccaaggtgccctacgacttcctcgtctccctcgtcagggacgtccggccgggactggagacatcgactaccagctccaggtcggactcaccgtcgacctccccatcgtcggcaacttcaccatccccgctcttccacctccgggcaagttcaagct

SEQ ID NO: 44686 - protein, 160 aa, Zea mays
  misc_feature: Ceres CLONE 1447295-F
  misc_feature (17)..(159): Pfam Name: LEA_2 Pfam Description: Late embryogenesis abundant protein
  misc_feature (74)..(74): Xaa is any aa, unknown, or other
MASEHAAGGEAKHDQKQSLMDKAKGFVVEKIAHIPKPEATLDGVTFKGLSRECITLHSSVNVSNPYDHRLPICXVTYTLRCAGKEVASGTMPDPGWIAASGSTAVEIPAKVPYDFLVSLVRDVRPGLETSTTSSRSDSPSTSPSSATSPSPLFHLRASSS

SEQ ID NO: 44687 - DNA, 669 bp, Zea mays
  misc_feature: Ceres CLONE 1447298-F
  misc_feature: Encodes the peptide sequence at SEQ ID NO. 44688
  misc_feature (372)..(372): n is a, c, t, g, unknown, or other
  misc_feature (669)..(669): n is a, c, t, g, unknown, or other
tccccgcggtggcggccgctctataactagtggatcccccgggctgcaggaattcgcacgagaccattacctagaacatcctaatcgaaaaaattcgcttcgatccccagaggcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgccttcggcgtcctcggcgtcatgctccgctacaaggtgtgctcgtggatcgcaatcatcttctgcgctcagtcgttggcaaacatgaagaactttganaacgatctgaagcagctttctatggccttcatgtttgctgttatgggtctggtgacgaactattttggccccgctcgtccaggcagtacaaagcgctaaactgcggaagaacatgtgctacattcttcataggactttttggtgcttccgatagctttgccatcggtgctgacattaatgatgtccaaatttgagcaaacggcatagggtatgggcatcaaattaatgggacggggacttgtatgaaggctcaattattttattgtgtgcaaaacttagctaaccgccttagactgn

SEQ ID NO: 44688 - protein, 112 aa, Zea mays
  misc_feature: Ceres CLONE 1447298-F
  misc_feature (12)..(111): Pfam Name: UPF0139 Pfam Description: Uncharacterised protein family (UPF0139)
  misc_feature (80)..(80): Xaa is any aa, unknown, or other
MKDGTSSGGGAFAAGSDPRQPSTAKPYAPPKLSPQDLPIDYAGFLAVAFGVLGVMLRYKVCSWIAIIFCAQSLANMKNFXNDLKQLSMAFMFAVMGLVTNYFGPARPGSTKR

SEQ ID NO: 44689 - DNA, 682 bp, Zea mays
  misc_feature: Ceres CLONE 1447301-F
ggagctccccgcggtggcggccgctctagaactagtggatcccccgggctgcaggaattcgcacgagaccattacctagaacatcctaatcgaaaaacacaccgctagcaatatactgcttccttccttcatctcggttcgcagagctcgcgagagagatacgacagggaaaagaagcgcctttgcccaccgcgcggatcgatcgatccggggtcccgcggcctgccatggtaaagctggcgacggccaacgacgcccggctgtacggaccggcgctggcggacatcctcagccagtccatcaacgctccgacatacatcgtctcacggcgctgcatctggatctggcctgggtactgaccttgtccgtgtccgcgggcatccctgggggtcgccctaagcgccatagccgatcgttaccctcgaagacttgggagcgccaaaaacccccccagcaccctccatgggaatgaactcccccctttgaaaatgcccagggtccaatggccccgctccgggttagggggatttccaaaatgcccgggcgggccctgaaatttgggtgtgcaaaaataagggccccccggggcggggccccttaatgggtttctccccccttctccgctattctaggtgaaacaaaaagcgggaaacccggggggcccccgtggttgttttttttc

SEQ ID NO: 44690 - DNA, 688 bp, Zea mays
  misc_feature: Ceres CLONE 1447302-F
ctggagctccccgcggtggcggccgctctagaactagtggatcccccgggctgcaggaattcgcacgagaccattacctagaacatcctaatcgaaaatacaccaaactacaactcgacaccgagaaaagcgcagcacatcaacgcaaagcccacgccgctacagtgctacagctagcgagcctcttgcctgccgctacgagccaacgactcgaacgcatacactaccatggcagcgacggtgatggtctacatgatacccctcgtctgcgccagcccaggaagagcgtctcgcttgccctgtacggctgatgggtccagaatatgaaatcgagccgccgccgtatcgcttggccgggaccgggaggccctgaacggcaaagcccaagccatggctaaggatgagggggcccccccccccccccccgggggccaaaatcaaggggggcggaaaagggaacccccgggtttttaaaaccctgggtattacaagccccttccccaagggaaaaagggccccccccccccagggggggtttttggggggcccccccggaaaaaacccccccggggggggccccccccaaaggggggggggggggggggctccccttgtgttgcccccaagatccccaattcccccaggaaattttggtcgcccccagagagggaaaaccccacaccccccc

SEQ ID NO: 44691 - DNA, 824 bp, Zea mays
  misc_feature: Ceres CLONE 1447305-F
  misc_feature: Encodes the peptide sequence at SEQ ID NO. 44692
  misc_feature (32)..(32): n is a, c, t, g, unknown, or other
  misc_feature (781)..(781): n is a, c, t, g, unknown, or other
aaataaacataaccacgaaacaaagaggttcngttttcttcgaaaagatcaaactgggactccccgcggtggcggccgctctattctagtggatcccccgggctgcaggaattcgcacgagaccattacctagaacatcctaatcgaaaaatcccaaacccaaagcactggagtagctatatcattctagcacacccacacaatcacaatggaccccagtgctgccctcttcatcgccctgagcctcctcctctccgccgtcgccgcccacggctgcggaagcacctattgccaagcgccggtggtcgtgccgacaccacccatcgtcttttcgtcgccttaccacggaggaggagggcacggtcacggcttgggcggggagcgttgcatcaacgtgatcaactggagcgtgaaaacaaacagcccacagaggactggatagggtttaaagataggcgagaaaagcggccccccccaccccttgccattagatggatggggttgagccgagcttcgaacttatgaccctcggacctctggggtaagaaaggtgagggatcaaacattcctgcggggtgccgatattctctgtggctgggcgtgagagttatccctccataccataaaaccaactgagcaaacgagggggctgcccgcggcgtggtgtgtaattttgggccgaaggccgaataaatcacgtaaggaagccgaatgtctcgacgttgggggcggcccctacacctggaatctcgacattataccccgcagacactcgaatacngtaccgagatagagtgggggaaaccttgtaatgattggtaact

SEQ ID NO: 44692 - protein, 77 aa, Zea mays
  misc_feature: Ceres CLONE 1447305-F
MDPSAALFIALSLLLSAVAAHGCGSTYCQAPVVVPTPPIVFSSPYHGGGGHGHGLGGERCINVINWSVKTNSPQRTG

SEQ ID NO: 44693 - DNA, 673 bp, Zea mays
  misc_feature: Ceres CLONE 1447306-F
  misc_feature: Pfam Name: CTP_transf_1 Pfam Description: Cytidylyltransferase family
  misc_feature (582)..(582): n is a, c, t, g, unknown, or other
  misc_feature (583)..(583): n is a, c, t, g, unknown, or other
  misc_feature (607)..(607): n is a, c, t, g, unknown, or other
ctggagctccccgcggtggcggccgctctagaactagtggatcccccgggctgcaggaattcgcacgagaccattacctagaacatcctaatcgaaaaacgccgctgtcctactccacataccgcgctcacctactccaatccagacccctctctccctcacccacagtccccgccggcgccgcgtccgcgtcctgtgcgcctcgctcactctgcttccgccgccgccgcagcagtcgtctcgcagcggagcggacccggagccggaggcctaccatggcatcggcaatctcgctggaggccggcggggccctggcccatgacctagggtctgcagtcgtcacaggtggtgtcgccctcgcgctcctcaaattctttgaggagctcgccaagcgcggcgtcttcgagcagggaacttctcaagggcccactgtattatgctgctactataacttttgccacgtctcttttatggagaacctcaccagttgctatagcacttatatgcaacttatgtgctggggatggtatagccgatgttgttgggagacgcctaggtaaagaaaagctcccatacatcccnnacaatcatatgctggaagcatagncatggcggtggctggttttctggcctcagtcgggtatatgcattacttccacactttcggttttat

SEQ ID NO: 44694 - DNA, 886 bp, Zea mays
  misc_feature: Ceres CLONE 1447309-F
  misc_feature: Encodes the peptide sequence at SEQ ID NO. 44695
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gggggtggcaaccccccccgtaacgcgggggggggnaaacggtnnnnnnnaaaaactggggctccccgcggtggcggccgctctatactagtggatcccccgggctgcaggaattcgcacgagaccattacctagaacatcctaatcgaaaagccagtcctcgcctagggttaggcatccagcggcggcggcctcgacagcgcgaggggaaggagatcgccggatgaggggggaggcgcggagatgagcggaagcgcgttcaaggcgttcaagacgcgggtgccgggggcggggactccccggctgtacatcacgctggtgcggggcctagcgggcacgcggcgcctccaccgccgcacgctcgaggccatgcgcctccgccgctgccaccgcaatgtaggaggatcataacgcaccattacctgctccaggcaccctcccccagtgtgaacgcgcttccgtcgacggtagagcccccccccacacggtacatggggggcgccaaggcagggccgtaggcgcgcaaaggtcgggccgctggaagaattgcatcggcgtcatgcgggcttatccgcgccgcttgaggcaagcggggtcgggcggggcttccggaataacccgaggatgtcctcgaccccactgggctggcaagggttggcatggtcgttgccactctgtgggaccataggcccggccgggggggcgcgcgggggaggggcgtgtgggacgagcgaggggatggtggccaccccgttattctgaattatacagcctcgttctccgtggatgattcttgggcattcctgccgtgtgtgttccctccaccgcccctctgggatgtgtcgtctatgccctctgggatatgccgtcgctaggaactctggcg

SEQ ID NO: 44695 - protein, 55 aa, Zea mays
  misc_feature: Ceres CLONE 1447309-F
MSGSAFKAFKTRVPGAGTPRLYITLVRGLAGTRRLHRRTLEAMRLRRCHRNVGGS

SEQ ID NO: 44696 - DNA, 727 bp, Zea mays
  misc_feature: Ceres CLONE 1447322-F
  misc_feature: Encodes the peptide sequence at SEQ ID NO. 44697
aagctggagctccccgcggtggcggccgctctagaactagtggatcccccgggctgcaggaattcgcacgagaccattacctagaacatcctaatcgaaaaaccaccgctccagcctcctctagagccttcgcgcctcggcggcagtcatcggatcggaacctgcacaagtagaagtacgcaacaagccttgccactaacatgccttcagtcgaggtcgaggtccaggtgggcggcgccggcgggtggaggccgaagcagcagcaccaccatccccttgagatccgtcaggtatgggcggacaacgtggaccgcgaattcaagctcatccgcgccgccatcgagcggttcccctacgtgtccatggacacggagttcccgggcgtcatccaccaccctcccccggccgtccaccactccacgctcaccgcgccgcagcgctacgccctgctcaagtccaacgtcgacgcgctgcacctcatccaggtcggcctggccctggcgccgtcccctggctccccgcccgcgctcgccttccagatcaacctccgcggcttcgacccgcgcgtgcaccgccacgcgccggactcggtccgcctgctcgccgccagcggcctcgacctcgccgcccaccgcgccaggggcgtccccgcgcgcgccttcgccgcgctgctcgcctcgtcgggcctcatctgcaaccccggcgtcgcgtgggtcaccttcagctc

SEQ ID NO: 44697 - protein, 175 aa, Zea mays
  misc_feature: Ceres CLONE 1447322-F
  misc_feature (29)..(175): Pfam Name: CAF1 Pfam Description: CAF1 family ribonuclease
  misc_feature: SWISSPROT Homolog: EC 3.1.13.4 Poly(A)-specific ribonuclease
MPSVEVEVQVGGAGGWRPKQQHHHPLEIRQVWADNVDREFKLIRAAIERFPYVSMDTEFPGVIHHPPPAVHHSTLTAPQRYALLKSNVDALHLIQVGLALAPSPGSPPALAFQINLRGFDPRVHRHAPDSVRLLAASGLDLAAHRARGVPARAFAALLASSGLICNPGVAWVTFS

SEQ ID NO: 44698 - DNA, 787 bp, Zea mays
  misc_feature: Ceres CLONE 1447325-F
  misc_feature: Encodes the peptide sequence at SEQ ID NO. 44699
aaagctggagctccccgcggtggcggccgctctagaactagtggatcccccgggctgcaggaattcgcacgagaccattacctagaacatcctaatcaaaaacggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaggacaccatatcacccaatgatagatgatgatggatcattgtcgcccacacgttctttccgacaaatgtcttgatgaaactgcccagcctgaagctaatcttacaagctttaatggggggggcttcttcaacctttacatttcaaaaggaaagggtgggggatccccaaattagaaacacaagcccataaaacaaaggttccccccaaacctaaaccaaaaaggtttaatttccaggagaccccccgcgcccccccaaaaaaaaccccccggggtaaagagttaaaagaacctccctcccttcttgggaggggcgcaaaaagaaaaaaaacctccccccccctccaaaaaaaaggggggggggaaagggggcgaaaaaaaaaacccccccccccccccaaaaggagagaaaaaagggggcctctccttttttttttttgttttttgcgcaacact

SEQ ID NO: 44699 - protein, 53 aa, Zea mays
  misc_feature: Ceres CLONE 1447325-F
MSSHRVKWNEDNLYEIESNKPVRQKITEPRTPYHPMIDDDGSLSPTRSFRQMS

SEQ ID NO: 44700 - DNA, 771 bp, Zea mays
  misc_feature: Ceres CLONE 1447326-F
  misc_feature: Translation starting site: 320
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaagttgagagaaacctgcaggatgccatgtccgttgcaaggaacattttgaaaaatccaaaactccttcctggaggtggcgctacagagctgactgtatcagcaacactgaagcaaaagagttcttcagttgaagtggccctatgaagctgctgctctagcatttgaggcaattccaaggactttggcccaaaattgcggtttgaatgttattaggataatgacacaacttcaaggaaagcatgctaatggtgaaaatgcgtgggttggcattgatggaaggactggtgatattgtcgatatgaaagagcgaaagatctgggattcctacagtgttaaagcacaaacgttcaagacagcaattgaggctgcttgcatgcttttgagaatcgatgacattgtcagcggtatcaagaagaagcaggctcctggagcctcagctccaaagcaaccccaaattgaaactgagggcgatgctgacaatgagcagatgattccagagtagaggctgtggcgaacctgcactggcaaagttatttactagtgtcaaggtagcacttcgagcagagttcatttttggtggttagccttagcttaaagatgcaccttgttttatantagtttgatgagtggtacgagggttttgggatccaggttttgagtgtggttgct

SEQ ID NO: 44701 - DNA, 745 bp, Zea mays
  misc_feature: Ceres CLONE 1447327-F
  misc_feature: Encodes the peptide sequence at SEQ ID NO. 44702
aagctggagctccccgcggtggcggccgctctagaactagtggatcccccgggctgcaggaattcgcacgagaccattacctagaacatcctaatcgaaaaacaaggagcactcattgcctccccatctcgtgtagtctctccccctcctccgcgctccatccgtctctcatcaccattccgccgccgccccacctctccctcctctcgccgccgcctccgaacccgccacggcgcggcggagatccaaccggacggatctggatcgacctactccgacaccgctttccgaagatagatagatagataacaaggttgtgctgtgcttgctgtctgttgggaagtggaggaagctcaagttgatatccgcctcgagctcgagggaaccggtgggcagggccccccgatcacgagcatggacagaactgccaataatgcggtattggatatcgagagccttcctcaaccgcctgataaatgctgctctgggagtccgaagatgatcagggccttgtcgcgtaagggttcgaaccggatggagaggaggggcggcggcggcggcaagcaggagcaagaagatttggcgaaaaaacttgtcatcaaagttgtgccgtctcaactggagcagcagcccctgggtcagaacaaggcgctggtcgctccacattgcacacctgtcttgtttgattctggggaaggggagagcaaaggatcattagccgggtcacgtccatcaaccctcggaa

SEQ ID NO: 44702 - protein, 110 aa, Zea mays
  misc_feature: Ceres CLONE 1447327-F
MDRTANNAVLDIESLPQPPDKCCSGSPKMIRALSRKGSNRMERRGGGGGKQEQEDLAKKLVIKVVPSQLEQQPLGQNKALVAPHCTPVLFDSGEGESKGSLAGSRPSTLG

SEQ ID NO: 44703 - DNA, 828 bp, Zea mays
  misc_feature: Ceres CLONE 1447328-F
  misc_feature (188)..(188): n is a, c, t, g, unknown, or other
  misc_feature (312)..(312): n is a, c, t, g, unknown, or other
  misc_feature (397)..(397): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (423)..(423): n is a, c, t, g, unknown, or other
  misc_feature (426)..(426): n is a, c, t, g, unknown, or other
  misc_feature (446)..(446): n is a, c, t, g, unknown, or other
  misc_feature (447)..(447): n is a, c, t, g, unknown, or other
  misc_feature (474)..(474): n is a, c, t, g, unknown, or other
  misc_feature (513)..(513): n is a, c, t, g, unknown, or other
  misc_feature (576)..(576): n is a, c, t, g, unknown, or other
  misc_feature (666)..(666): n is a, c, t, g, unknown, or other
  misc_feature (667)..(667): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (743)..(743): n is a, c, t, g, unknown, or other
  misc_feature (744)..(744): n is a, c, t, g, unknown, or other
  misc_feature (753)..(753): n is a, c, t, g, unknown, or other
  misc_feature (793)..(793): n is a, c, t, g, unknown, or other
  misc_feature (794)..(794): n is a, c, t, g, unknown, or other
  misc_feature (828)..(828): n is a, c, t, g, unknown, or other
aaatctggagctccccgcggtggcggccgctctagaactagtggatcccccgggctgcaggaattcgcacgagaccattacctagaacatcctaatcgaaaaactccgtactcggcgctcctcccccgtcgccgccggaaatcaggaagcccaagtgctctcttgggtgcgctcgtcgccggtggcantgagccagtgatgcatcttcatctccggcttccttattaggatcagcccgtcgatcgatcatggcgtcgtcgagctcggctgctactactagtggtgacagtcagggtctcaaggctcgaaatncctgcatcttctgggtcgcccgcacgccccatggcgcacttctcgggttttttctccccccccccccgggaacagaaagggggtncntnnnncttcnnnnnnncccccccnaangggaaaagaaaaaaacaaannttttttttaagggggggtgggggggcnaacctcccccactcccctaattttgggagggtttccgcnaaggaaaccgccccctttgggccccgcacttcccccaattctcgggccagtgccccgcgccgnaacagcctccgctcccccgcagagctaacgatcgggccggtaggcacacctcaaaaatcacacccgtggccaccactctctctctctgcnncccgtcggcgcgcgcaccctctcgccngnntcgcgcgactgtggttggccgacccaaacaacggcccttgccgggnnacactctanctatcaccgggcacgctctatcgcctcttccttccatccnnaactcactcacttccttggacgcgagactccccn

SEQ ID NO: 44704 - DNA, 753 bp, Zea mays
  misc_feature: Ceres CLONE 1447332-F
  misc_feature (393)..(393): n is a, c, t, g, unknown, or other
  misc_feature (398)..(398): n is a, c, t, g, unknown, or other
  misc_feature (413)..(413): n is a, c, t, g, unknown, or other
  misc_feature (440)..(440): n is a, c, t, g, unknown, or other
  misc_feature (628)..(628): n is a, c, t, g, unknown, or other
tcaccgcggtggcggccgctctagaactagtggatcccccgggctgcaggaattcgcacgagaccattacctagaacatcctaatcgaaaaatacctttctcggccttttggctaagatcaagtgtagtatctgttcttatcagtttaatatctgatatgtgggccatgtgtccactttgatattaaatttattttttatatgggggagagtctactgccagtggcttgccattggaggctctcaagcgtcgtccagctattgcactgctggccggaccaggcgcacccccaacaaaaaaaaaattagctttttgtggtctggtttcttggttaaactcctcctgggtttattttgcgccacccaagacgagggaggaggggctgcttcaaancccanccaaacaccccccangtctgatggaatcaaaaaggcctaccngcgatcatgatccccggctcacccaacgtaacaatcatccttcaaaacgtgcacttgggcaaaatgaaggaattagccagctgccaaccccgagtgtaaacccaacccctacaggggttgccaatgtaaaccatagcaagcaccgcattggggaccgaatcaaaaccgaaatcaaaggggggcggacncggaaaaaagacccgcaaaccctagtagggcaccgtaccccacaccccttgcctccgcccccacgccaaaaactccaccttccatccaccgcgccaacagatatgagagcgtgctctccgcatat

SEQ ID NO: 44705 - DNA, 756 bp, Zea mays
  misc_feature: Ceres CLONE 1447334-F
  misc_feature: Encodes the peptide sequence at SEQ ID NO. 44706
  misc_feature (512)..(512): n is a, c, t, g, unknown, or other
  misc_feature (599)..(599): n is a, c, t, g, unknown, or other
  misc_feature (613)..(613): n is a, c, t, g, unknown, or other
  misc_feature (628)..(628): n is a, c, t, g, unknown, or other
  misc_feature (629)..(629): n is a, c, t, g, unknown, or other
  misc_feature (638)..(638): n is a, c, t, g, unknown, or other
  misc_feature (707)..(707): n is a, c, t, g, unknown, or other
  misc_feature (709)..(709): n is a, c, t, g, unknown, or other
acagctggagctccccgcggtggcggccgctctagaactagtggatcccccgggctgcaggaattcgcacgagaccattacctagaacatcctaatcgaaaaaaccccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccgtcggtggactgtatctcccaggccgccagcctgatcgactgcatcgactacgtccagaaggggagcagcgcgcgccgtccgtccgctgcctgctgcggcgaggtcaaaaccgcagtggccagccccgtcatcgtgggctgcctctgctccctcgccggctccaactccagtaacctgggctttcccatcgacatgaagcgcgtgctggcgctccccggcgcgtgcggngcgtccaacgccgccttcagcaagtgcaacatttccgcgctttccccaaacgaagcacctgcaccgtccgccgccggggggtcatcnagcggtggcgcggnggcatcttcaccgcnngcccccggnggcaagcctctcctccaaagacggcgaccgccctgtttggctgccgtggccggctcccctgcgtccccnanaacgggtggctaccgtcttcggaagggttcccttcgggtggtggcta

SEQ ID NO: 44706 - protein, 192 aa, Zea mays
  misc_feature: Ceres CLONE 1447334-F
  misc_feature (145)..(145): Xaa is any aa, unknown, or other
  misc_feature (150)..(150): Xaa is any aa, unknown, or other
  misc_feature (177)..(177): Xaa is any aa, unknown, or other
MALASRAAAAAVACVLLALAASAAGAGSNSPAPAPSVDCISQAASLIDCIDYVQKGSSARRPSAACCGEVKTAVASPVIVGCLCSLAGSNSSNLGFPIDMKRVLALPGACGASNAAFSKCNISALSPNEAPAPSAAGGSSSGGAXASSPXAPGGKPLLQRRRPPCLAAVAGSPASPXTGGYRLRKGSLRVVA

SEQ ID NO: 44707 - DNA, 765 bp, Zea mays
  misc_feature: Ceres CLONE 1447337-F
  misc_feature: Encodes the peptide sequence at SEQ ID NO. 44708
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaactggtctcatcccttctggattgaaccctgctgtgatgcgagacagcgcaatgctggcggcgcgggaggcgaataagcggccacgcgcagcgccgacgacgaccctccccattgccttctcactgatccctacaacaccaattatagttggggaaggtgaacctccctcttgggatccggtaccaactctaaaagttctacaatgagtatgtcattacgagatcatattagaaagaggagggaagaagaagatgatgacatgatgttgtttattttccctgccttatatctgatgggttcaactagaagtgggggacaaaagaagaaacgccatacatcagatgagacaactccgtatgtgtattgtcaagtattgggaagacaactccgtaggtgtgaccattgttattactgtatttgcttatgtagctgattacttatatatctgtttcttggcgagtatgcgtgaacaattgcaagtctttttgttattactgtatgtattaaattgatttgaacagattgagtgcatcctgattgtgtacatgtgctgaaatcctgncatggtaggattctaggatgggcgcatggtatgctgctctggttttgcactggtttgactgtatggaatggaaccgaattgactacaaaaaaaaaaaaaaag

SEQ ID NO: 44708 - protein, 76 aa, Zea mays
  misc_feature: Ceres CLONE 1447337-F
MSMSLRDHIRKRREEEDDDMMLFIFPALYLMGSTRSGGQKKKRHTSDETTPYVYCQVLGRQLRRCDHCYYCICLCS

SEQ ID NO: 44709 - DNA, 772 bp, Zea mays
  misc_feature: Ceres CLONE 1447341-F
  misc_feature: Encodes the peptide sequence at SEQ ID NO. 44710
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (11)..(11): n is a, c, t, g, unknown, or other
  misc_feature (49)..(49): n is a, c, t, g, unknown, or other
  misc_feature (80)..(80): n is a, c, t, g, unknown, or other
  misc_feature (480)..(480): n is a, c, t, g, unknown, or other
  misc_feature (554)..(554): n is a, c, t, g, unknown, or other
  misc_feature (617)..(617): n is a, c, t, g, unknown, or other
  misc_feature (684)..(684): n is a, c, t, g, unknown, or other
nnttatcttnnatcatcactggagctccccgcggtggcggccgctctanaatagtggatcccccgggctgcaggaattcncacgagaccattacctagaacatcctaatcgaaaaaggccgagagttgtcaacgacgacgtctgccggcagtgctcctgctcctcctcctcctccttcccgggcggcgcgcgagcttggtgggttagtgtctcttcttcgcggagacctgtgagaggagccatcatcatggccgccgttgagactgttgtcctcaaggttgctatgtcatgcgagggttgcgccgggggcggtcagaagagtgctctccaagatggaaggaggttgaaacccttcgacatagacctcaaggagctttatgttgacagttaaagggaaggggggggcggaggaccccttccagaccgtttccaggttggggaaaaggacctcctactggggagggccaagccaccggcccnaaccctgccgccgtgttctggagcccaagaactcccgggaccgcggggaaaagcgcctcctgctgctgggtcgnggggcccagaaataaaccccgcccaaagtggactcctgaaccctcccgcctatacccaccccncggtggctggttcccgttcgtcactcctagaccctccctcctggagaccaccccggggtctccggtntccccctcccccccgcggcgcgttggccccgctcggtgggggccccgcccgggacccccgcaccccgcccgttggcgtcccgggtccg

SEQ ID NO: 44710 - protein, 47 aa, Zea mays
  misc_feature: Ceres CLONE 1447341-F
MAAVETVVLKVAMSCEGCAGGGQKSALQDGRRLKPFDIDLKELYVDS

SEQ ID NO: 44711 - DNA, 768 bp, Zea mays
  misc_feature: Ceres CLONE 1447345-F
  misc_feature: Translation starting site: 234
  misc_feature (315)..(315): n is a, c, t, g, unknown, or other
  misc_feature (379)..(379): n is a, c, t, g, unknown, or other
  misc_feature (381)..(381): n is a, c, t, g, unknown, or other
  misc_feature (413)..(413): n is a, c, t, g, unknown, or other
  misc_feature (672)..(672): n is a, c, t, g, unknown, or other
aaactggagctccccgcggtggcggccgctctagaactagtggatcccccgggctgcaggaattcgcacgagaccattacctagaacatcctaatcgaaaacacacacacttttttctccggacgcgctcgttcgttcgcgaaggcgccccttcctgccctcacatccgctcctccctccccgacaccgaccgacccctcgtccgctcgcctccctccccgatccccaccgccatggccgccgccgccgccgccgcgtcctcctcttcctcctccgaggttccgatcgccgcccgcacctgcgtctccgtctgcnaggtggcggtgggcgcggaggctacaggcagcggcgaccgggtggcggcggattggggggtatncnccatctgcctcgacacgatagtggtgcaacanaccccccccccaaaggttgcaaccacccctactgtgtgacctgtattttgaggagggcatcctacaaagagaaccctctctgcccacaggggaagcatccattcaaattcctcagcgtggaccgttctctcgacggctggctacatgactaccctgtttaagagaagggttggcctcctcctgagggaggcttgggtttgaacctctgatcgaagaggctccccagggggtcctggcacgaaaaaaggttctccatccnccgtcccaaacccatgatggcgaagaagacccttgacgaggaatctttttacatggacaggtgccccaaccgtccgcattggttacggggggaggg

SEQ ID NO: 44712 - DNA, 763 bp, Zea mays
  misc_feature: Ceres CLONE 1447346-F
  misc_feature: Encodes the peptide sequence at SEQ ID NO. 44713
  misc_feature (717)..(717): n is a, c, t, g, unknown, or other
  misc_feature (763)..(763): n is a, c, t, g, unknown, or other
aagctggagctccccgcggtggcggccgctctagaactagtggatcccccgggctgcaggaattcgcacgagaccattacctagaacatcctaatctaaaagccttctccatcctaaaccctcctagtcctctccatccccatcccctccaatggcggcgactgccacgtccttcgccactctcgccgtcgcgcgctcggcggggcagcggtccctccttgcctccaaggccgccccctcgccgctcctctccctccgcggcgcccgcctcccctcgcagggcgtctccttatctgggggcctcgcggcgtcgccctctcatagccgcgcgcgcttcgccacatcagccagcgccgagcccaaggaagcagaccttcagtctaaaatcacaaacaaggtgtactttgacataaccattgggaaccctgtgggcaagaatgttgggaggatcgtcatcggcttgtacggggatgatgttccacagacaacagagaacttccgtgctctttgcactggagagaaagggtttggatacaagggatccagtttccatcgtgtcatcagcgactttatgattcagggcggagattttgacaagggcaatggtaccggtgggaagagcatatatggacgcaccttcaaagatgagaacttcaaatgtatgctctacgtttgaaacagtagtgatatgctgtgtggtttgtagttccctgcgtnaactgatggcatgctgattccatgttttagtggttcacactggacn

SEQ ID NO: 44713 - protein, 174 aa, Zea mays
  misc_feature: Ceres CLONE 1447346-F
  misc_feature (82)..(175): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MAATATSFATLAVARSAGQRSLLASKAAPSPLLSLRGARLPSQGVSLSGGLAASPSHSRARFATSASAEPKEADLQSKITNKVYFDITIGNPVGKNVGRIVIGLYGDDVPQTTENFRALCTGEKGFGYKGSSFHRVISDFMIQGGDFDKGNGTGGKSIYGRTFKDENFKCMLYV

SEQ ID NO: 44714 - DNA, 756 bp, Zea mays
  misc_feature: Ceres CLONE 1447347-F
  misc_feature: Translation starting site: 149
  misc_feature: Pfam Name: Fapy_DNA_glyco Pfam Description: Formamidopyrimidine-DNA glycosylase N-terminal domain
  misc_feature: Pfam Name: H2TH Pfam Description: Formamidopyrimidine-DNA glycosylase H2TH domain
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaaatagtgtaccaacaatggccgcccttcccgtccttccagttcgggatggcaggcgcgatatatatcaaaggcattcctgtgacgaattataagagatccgttgttaattccgaagaggagtggccctccaaacactctaaattctttgctgagcttgatgatggtttggagttctctttcactgataaacggcgctttgcaagagttcgtttgtttgaagatcctgaaaccttacccccaatttctgagttaggcccagatgctctgtttgaaccaatgtccgtcgatagtttcttggactcccctggtagaaagaagaagggataaaagctcttctacttgatcagagcttcatatcaggcattggcaattggattgcaaacgaggtgctttaccagtcaaagatcatcccattacngattgcttcgaatctactaaggagagttgtgaaccctgcacccagagattcgaaaagttgtcaaatttgctgtccaaatttatgctgacttggaccgtttcccaaggaatggtttttccttcccgtgggggaaaaaccctgggaatcccagggaaaaaaaacggttttaaaaagtgggggggggcccctgcccatgcgcccaatggaaaagggtgggacccccccccccaaaaaa

SEQ ID NO: 44715 - DNA, 708 bp, Zea mays
  misc_feature: Ceres CLONE 1447348-F
  misc_feature: Encodes the peptide sequence at SEQ ID NO. 44716
  misc_feature (571)..(571): n is a, c, t, g, unknown, or other
  misc_feature (598)..(598): n is a, c, t, g, unknown, or other
ggagctccccgcggtggcggccgctctagaactagtggatcccccgggctgcaggaattcgctcgagaccattacctagaacatcctcatcgaaaagttgattattctagagccagatccgggtaacagattcgagtttgcgcccgccctgttcggcttcagatatggggaacactacatctgtgcaagctgaggcttcagattcagcgcagaaacctgccacaacagctcctgcacctgggtcaaagccgaaaaagatctgctgtgcttgcccagatacaaagaagctgagggacgattgcatcgtgcagaatggcgaggatgcctgcggaaagctcatcgaagcccacctgaaatgcctgagagccgaagggttcagcgtctgacgtggtgctccatcatggcaactccacacacctgtttctgcagtaatctgattttgatcatgaacagtgtgatgaataaggacttctggtagagtgatagaaacaactcgcagttttatttctagactggaaggaggaaatcccctgaacattgccagtttgcaagagtttttctatcttttttncatgcatttagtgccacacatatctgncattctgggatatactttatggagcatatgtatatggaaattgctttttttttggtccactgtttggagattgagcaccacactgtatgggaacactggtgcaaaagttt

SEQ ID NO: 44716 - protein, 73 aa, Zea mays; identical to SEQ ID NO: 5059
  misc_feature: Ceres CLONE 1447348-F
  misc_feature (11)..(73): Pfam Name: COX17 Pfam Description: Cytochrome C oxidase copper chaperone (COX17)

SEQ ID NO: 44717 - DNA, 726 bp, Zea mays
  misc_feature: Ceres CLONE 1447355-F
  misc_feature: Encodes the peptide sequence at SEQ ID NO. 44718
  misc_feature (308)..(308): n is a, c, t, g, unknown, or other
  misc_feature (324)..(324): n is a, c, t, g, unknown, or other
  misc_feature (351)..(351): n is a, c, t, g, unknown, or other
  misc_feature (393)..(393): n is a, c, t, g, unknown, or other
  misc_feature (414)..(414): n is a, c, t, g, unknown, or other
  misc_feature (428)..(428): n is a, c, t, g, unknown, or other
ctggagctccccgcggtggcggccgctctagaactagtggatcccccgggctgcaggaattcgcacgagaccattacctagaacatcctaatcgaaaatgtgattatcacttcagtttctgcgatgtgattccttcaagttgcattcaaatgcgcaatgtcattcttagtgcttttccacgtaacatgagactgccagacccttctacccctaatctaaagattgatttgttggctgaaatttcaatagcaccacgaatcatgtcggatgttgatggtgcccttaaatcaaagcagttgaagactgangttgatgaatatctcnagaggccggaaagctcttccttttttnagtgactgaacctaaaattgctgctgcctcaaaatgaagcangtgttgctgggacacgctacnacgtggctctgatncattcacttgttttttatggtggcattccagctgtgcacaactggacttgaacaaaggttatccgtcttgctccgtaccgccaaattaccttattcttccatgggacttttcccaaatggaacccctcccgaaattttcgggatttttaaaaagttttggataaaagggcccttccctttgttaaaaggaatcctaaaaatggggtttaaaaaaaaaaaaaaaaaaaaaacctctttaccctggtgttttttttccgggggcccccgaaatatccccggaaaaataaaaggttttttt

SEQ ID NO: 44718 - protein, 116 aa, Zea mays
  misc_feature: Ceres CLONE 1447355-F
  misc_feature (102)..(102): Xaa is any aa, unknown, or other
  misc_feature (108)..(108): Xaa is any aa, unknown, or other
GAPRGGGRSRTSGSPGLQEFARDHYLEHPNRKCDYHFSFCDVIPSSCIQMRNVILSAFPRNMRLPDPSTPNLKIDLLAEISIAPRIMSDVDGALKSKQLKTXVDEYLXRPESSSFF

SEQ ID NO: 44719 - DNA, 746 bp, Zea mays
  misc_feature: Ceres CLONE 1447356-F
  misc_feature: Encodes the peptide sequence at SEQ ID NO. 44720
aaagctggagctccccgcggtggcggccgctctagaactagtggatcccccgggctgcaggaattcgcacgagaccattacctagaacatcctaatcgaaaactaacttcttttctattctcctccccagccgccattcacatccggccgccaggaagcaccggcgcctggccgacggcgagcctcccttttcccttctctgtcttctgttttcgttctatcagctgcgcagaacttcagccgccaaggaactctttcttggccgaccgcgcgctgcttcttcctctctgtttttttctttgccgcgctcgtccggccgcaaggaggctcctggctgaccgcgacgtggttatcctgaccgagcggttccctggctgaccgagtgatctctctctgttctttttcttaaaaaaatgagcatggccgaccgcacttgttgctctaattatgtcttttctttctttccctgtctttgtttttgtgcgttctctagcatctggccactagttcactggagcacatgcagttcattcgttacaccactggccatacagccatatgcctcacggtccctttttttttgcatcacttgaactcagccgaaaaataccgtggtgctcatggccgtttttggttacacttgtactcatatccagcctcatgtattcgatccctctcttctgtgtgaatgtatgtatgagatgtgttataatttaacaaaaaaaaaaaaaaaaagcttatcgatc

SEQ ID NO: 44720 - protein, 59 aa, Zea mays
  misc_feature: Ceres CLONE 1447356-F
MSMADRTCCSNYVFSFFPCLCFCAFSSIWPLVHWSTCSSFVTPLAIQPYASRSLFFCIT

SEQ ID NO: 44721 - DNA, 765 bp, Zea mays
  misc_feature: Ceres CLONE 1447359-F
  misc_feature: Encodes the peptide sequence at SEQ ID NO. 44722
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaactataggactccgctcctttgagctcccctcccctcgcatcgcatcgcatcgatcctcccatctgcgcacccgcaagcctattcgccgcacctcctcaggtgaccgggaagatgatgccgttgagccaaaccgacttctcgccgtcgcagttcacctcctcccagaatgccgccgccgactccaccacgccttccaagatgcgcggcgcgtccagcaccatgccgctcaccgtgaagcaggtcgtcgacgcgcagcagtctggcacgggcgagaagggcgctccgttcatcgtcaatggcgtcgagatggctaacattcgacttgtggggatggtcaatgccaaggtggagcggacgaccgatgtgaccttcacgctcgacgatggcaccggccgcctcgatttcatcagatgggtgaatgatgcttcagattcttttgaaactgctgctattcagaatggtatgtacattgcggtcattggaagcctcaagggactgcaagagaggaagcgtgctactgctttctcaatcaggcctataaccgatttcaatgaggttacgctgcatttcattcagtgtgttcggatgcatatagangacactgaatttaaggctggcagtcctgcacgaatcaattcttctatgggagtgtcattctcaaat

SEQ ID NO: 44722 - protein, 184 aa, Zea mays
  misc_feature: Ceres CLONE 1447359-F
  misc_feature (69)..(143): Pfam Name: tRNA_anti Pfam Description: OB-fold nucleic acid binding domain
  misc_feature (162)..(162): Xaa is any aa, unknown, or other
MMPLSQTDFSPSQFTSSQNAAADSTTPSKMRGASSTMPLTVKQVVDAQQSGTGEKGAPFIVNGVEMANIRLVGMVNAKVERTTDVTFTLDDGTGRLDFIRWVNDASDSFETAAIQNGMYIAVIGSLKGLQERKRATAFSIRPITDFNEVTLHFIQCVRMHIXDTEFKAGSPARINSSMGVSFSN

SEQ ID NO: 44723 - DNA, 712 bp, Zea mays
  misc_feature: Ceres CLONE 1447363-F
  misc_feature: Encodes the peptide sequence at SEQ ID NO. 44724
  misc_feature (363)..(363): n is a, c, t, g, unknown, or other
ggagctccccgcggtggcggccgctctatcactagtggatcccccgggctgcaggaattcgcacgagaccattacctagaacatcctaatcgaaaatgaacctctcctgtaattacttggctgggcagatccctgcggggcttgggggcatggggaggttgcatacgcttgacttctcacataatgggctgtcaggggaggtgcctcctggaattgcagccatgacagtgcttgaggtgcttaacctctcctacaatagcctgtctgggcctttgccaacaacgaagttcccaggagcattatctggaaacccaggaatttgcactgggaaagggtgctctgagaatgcaaggactccagaangcaaaatggaaggtagcaatcaccgcggttggcttggtgcctcgcatggagagaatggatgggtatctcttggtgcattttgtatcagcacgatgactagcttctatgtatcattagcaaccttactatgcttctctaatgccagaaactttcgtgtttcgccctggtgagggttgaatattaccagaagggagattgcaaatccgggtgttttggaatttcgagcgactctggtctggccctgattaacacaaaaatttcaccttatgaaagggatatcttccgcccaagaggaaagggctggttccttttatagatccacccacctctctctggtggacttctaaca

SEQ ID NO: 44724 - protein, 145 aa, Zea mays
  misc_feature: Ceres CLONE 1447363-F
  misc_feature: SWISSPROT Homolog: EC 2.7.11.1 Non-specific serine/threonine protein kinase
  misc_feature: Functional homolog of the protein sequence given in SEQ ID NO 96880
  misc_feature: Useful for making plants with modulated yield
  misc_feature (90)..(90): Xaa is any aa, unknown, or other
MNLSCNYLAGQIPAGLGGMGRLHTLDFSHNGLSGEVPPGIAAMTVLEVLNLSYNSLSGPLPTTKFPGALSGNPGICTGKGCSENARTPEXKMEGSNHRGWLGASHGENGWVSLGAFCISTMTSFYVSLATLLCFSNARNFRVSPW

SEQ ID NO: 44725 - DNA, 696 bp, Zea mays
  misc_feature: Ceres CLONE 1447368-F
  misc_feature: Encodes the peptide sequence at SEQ ID NO. 44726
ggagctccccgcggtggcggccgctctcccatagtggatcccccgggctgcaggtattcgcacgagaccattacctagaacatcctaatcaaaaacactccacatccacatcggcgtgctcccgagccctgaaccctgtccctgacccgttcacccgtcgcaggcgagcagcagacagccagaggagacgtcgcgcctgtgcctaccatggacgagaaggagttctggcgcatgctcgacctcttccccgtcgtccgctcccgtgactattgcgctgatcctggaacatctatcagaggaaccagacagcaatcacgagttcaggaggcagcgaagggcaatgacaaggactcatccgacgcacaagatttgtttatgcagaagttgaagatggctgcagagaaaaagattggaacaacaaaagcagagttcttctgcaaggcatttgaagaaactcatgagaagcttgtttacaaagagctgaatttggatgctgctaagaagtttctgagcgcatatgaaagctgatgatgaacagtaggtagatgctgctcaaggatcggaaggtgccaatgatccctaaaaaggtgttgatgctgtcgagattttgatctttgacaacttgtgttgtgtgcaaacagtagacatcctttttgggcagctacccttccttttttcaaaaaaaaaaaaaaaagt

SEQ ID NO: 44726 - protein, 106 aa, Zea mays
  misc_feature: Ceres CLONE 1447368-F
MDEKEFWRMLDLFPVVRSRDYCADPGTSIRGTRQQSRVQEAAKGNDKDSSDAQDLFMQKLKMAAEKKIGTTKAEFFCKAFEETHEKLVYKELNLDAAKKFLSAYES

SEQ ID NO: 44727 - DNA, 753 bp, Zea mays
  misc_feature: Ceres CLONE 1447375-F
  misc_feature: Encodes the peptide sequence at SEQ ID NO. 44728
  misc_feature (358)..(358): n is a, c, t, g, unknown, or other
  misc_feature (401)..(401): n is a, c, t, g, unknown, or other
  misc_feature (403)..(403): n is a, c, t, g, unknown, or other
  misc_feature (405)..(405): n is a, c, t, g, unknown, or other
  misc_feature (479)..(479): n is a, c, t, g, unknown, or other
  misc_feature (714)..(714): n is a, c, t, g, unknown, or other
aaacctggagctccccgcggtggcggccgctctagaactagtggatcccccgggctgcaggaattcgcacgagaccattacctagaacatcctaatcgaaaattctagcctctgtccaagccggcagcccgccacccgcgaggccgcgaccggcgaccgcccgcccctgacgtggtgactgcgtcctcctccgctctccgtgcgccaccctgaagcggtgaggcgaggacctccaggcaccgccctccccggttcggcggctccctcgaggccttcctcctcaccggttcagcagctcccgatccgcacggccaaaggccgattcgcgctcctccagccttcctccgcgtccaacagnaagtttttatattcaacccaaggagggcgaggggggggacaanangnttaaaacatcccccccctcccaggtatgccgctcaattggcagagagcacaagccttgccattgccagcaaggngaagaaaggttgaaaaggctgatggctggcaaactcctgcccccacccaagaactcaagagtacaaaggtgttcggggacaacatctcagggaaggttctgatcccaaatcccccaaaccctgagtatcctgactggtttgggagtcgctcccaaggtctcttactcagtgaccttcgcccaaaagcccacaaccctcctaggaaccttcactcgttttcaggtgcccacccgcncggaaccacaccggagcgccccctccgataactaccccc

SEQ ID NO: 44728 - protein, 104 aa, Zea mays
  misc_feature: Ceres CLONE 1447375-F
  misc_feature (17)..(17): Xaa is any aa, unknown, or other
  misc_feature (95)..(95): Xaa is any aa, unknown, or other
MPLNWQRAQALPLPARXRKVEKADGWQTPAPTQELKSTKVFGDNISGKVLIPNPPNPEYPDWFGSRSQGLLLSDLRPKAHNPPRNLHSFSGAHPXGTTPERPLR

SEQ ID NO: 44729 - DNA, 731 bp, Zea mays
  misc_feature: Ceres CLONE 1447376-F
  misc_feature: Translation starting site: 164
  misc_feature (334)..(334): n is a, c, t, g, unknown, or other
aaagctggagctccccgcggtggcggccgctctagaactagtggatcccccgggctgcaggaattcgcacgagaccattacctagaacatcctaatcgaaaaaaaatccaagtcttacgcgagtccccttcccgatccgccggccgatccacccaccgccgccatgccggcgttcaaggccccggcgccgggcttcgccgtgcgcttcagccccttccacgagaaccgcctcctcgccgccacgtcccagcacttcggtctcgtgggtaacggtcacctcatcgtcctcgacctagccggcggcgggcctggggccgccccggcgccggtcttnctcctttcccgacctccgatgcgctcttcgactgcgcgtggtccgagtcccacgactccctctgcgccgcccgctccggggacggctccgtgcgccttttcgacgccgctctcccgcggggcaaaaccccgtgcgggtcctccgggaacccgcagggaggtgaaccgcctcaagggaacccctcccccggaaaccttaattccccctccgggaaaaaagttaaaagttgggtcccgaaacgcaaacccggtccaattttgggggcaaaaattcggggtccccccccctgtcccggcgccccagaattttttctcccccccgggaaaaacacccccctttggaatcgggtaaccccccccattttttgtgcgaaaaaaacaaggtcttcttcagggga

SEQ ID NO: 44730 - DNA, 772 bp, Zea mays
  misc_feature: Ceres CLONE 1447378-F
  misc_feature: Encodes the peptide sequence at SEQ ID NO. 44731
  misc_feature (694)..(694): n is a, c, t, g, unknown, or other
  misc_feature (721)..(721): n is a, c, t, g, unknown, or other
aaagctggagctccccgcggtggcggccgctctagaactagtggatcccccgggctgcaggaattcgcacgagaccattacctagaacatcctaatcgaaaaaccaaaccgggaccgggcggcatcctcggtctcgtactgacccccgcaccggcaaaccctagtccacagcggcgaggcgaccttgtgacctccgttcctctgtgctccgactgagttgctgatttgggataatcatgttctctctgagtgaatgaacatgtctgggaatgatgataagccacatgctgctgcagacagaataaaggcagccacgttatcagtgactaagggattgagcagggctcaagctgaatgggctgcgactgctgctgcccgcaatgtgaatgcctatgggcagaaggaagagggaccaagccgctggcaggagaggaaggaagccaagagtcagatgtatctgatgagtacagagaaggttgcgaagctgggcactatgaagccaaaagcttcagaaacttcttctgttggcacatatacccaatgccagaagtgtttccagcatggtcactggacatatgagtgcaaaaagagcgggtgtacatatcacggcccctcagaacgtagcagcttaagaaccccaagctgaaagaatgcgtacctgtttcttatcgatttgagaatcctgatggtgatncgcgatcgtgagcttcccatatatgtngtgtgatacttgagacttttattatgactatatatgagatattgtctatta

SEQ ID NO: 44731 - protein, 130 aa, Zea mays
  misc_feature: Ceres CLONE 1447378-F
MNMSGNDDKPHAAADRIKAATLSVTKGLSRAQAEWAATAAARNVNAYGQKEEGPSRWQERKEAKSQMYLMSTEKVAKLGTMKPKASETSSVGTYTQCQKCFQHGHWTYECKKSGCTYHGPSERSSLRTPS

SEQ ID NO: 44732 - DNA, 737 bp, Zea mays
  misc_feature: Ceres CLONE 1447380-F
  misc_feature: Encodes the peptide sequence at SEQ ID NO. 44733
  misc_feature (411)..(411): n is a, c, t, g, unknown, or other
ctggagctccccgcggtggcggccgctctagaattagtggatcccccgggctgcaggaattcgcacgagaccattacctagaacatcctaatcgaaaaggtcctccattcaagctccactccacacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaacccaganattgcgtgcgcgcaagacgcgctgagacccaagcatcatcctatcccacggttgaccgttgaacccctaggagtgcaggggtcgtcgtccctggtgaaattggtcccccaaaaaaattgcccggggctgcccgtccccctggctgaaggccttcaaaaaatgggggttaaaggggtccaaggccaccggtttggggccaaacctttcccccttaaggcctggggggaaaaaaagtggggaaaacaagggaaaaaccctctgtaaaaagagatcctccgggcgcccgaagaatctccccaaggggggcccaaaaaccaaaaaaaaaa

SEQ ID NO: 44733 - protein, 141 aa, Zea mays
  misc_feature: Ceres CLONE 1447380-F
  misc_feature (54)..(54): Xaa is any aa, unknown, or other
MMSRERKKAAALQEKLKILRSITHSHALSNTSIIMDASAYIKELKQKVVRLNPXIACAQDALRPKHHPIPRLTVEPLGVQGSSSLVKLVPQKNCPGLPVPLAEGLQKMGVKGVQGHRFGAKPFPLKAWGEKKWGKQGKNPL

SEQ ID NO: 44734 - DNA, 829 bp, Zea mays
  misc_feature: Ceres CLONE 1447382-F
  misc_feature: Encodes the peptide sequence at SEQ ID NO. 44735
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (417)..(417): n is a, c, t, g, unknown, or other
  misc_feature (582)..(582): n is a, c, t, g, unknown, or other
  misc_feature (607)..(607): n is a, c, t, g, unknown, or other
  misc_feature (745)..(745): n is a, c, t, g, unknown, or other
  misc_feature (829)..(829): n is a, c, t, g, unknown, or other
gcgccccgtccccccccaccaaaccnannnnnnnnnnnnnnnnnnccacagctggagctccccgcggtggcggccgctctataactagtggatcccccgggctgcaggaattcgcacgagaccattacctagaacatcctaatcgaaaaaaaaaccctccatccattctacacgcgccgccgcactcctggacacggcccgccgccaccgactccaccaccacagcgcgcaggaatccctcggtctctgagggtttccggcgtcgtatgtaagagaagatggcgctctcactatccatggagggcatcgaggcgcgggcccgggatctcggggtggacctctccgctgacgatctggactcgatcaccctcccggccggagaggagttctgaatcgtcagtgatgacgaggaggtantccccgccaaggatctttcacaccccgaagtgggtttggcggggattattgacgagaacaatctgccaactcgttcctccaaaaaaagtccagaagccatgagaacgccatacacaagacccacacccaaatttggagcggtcaaaggacaatgggcccaccgcntgcctcgccacacccccaccccaancaacaccctccggggtactggtcttcattgactattaaaacccccttcagaaagacctgaactggcttacgcgaaaaaaaccactggcggtccaaccgcggacaagggcttcatattcttggagagacgaggatggtnacgaccaagttccaaaaagccccatggaaaagtgcccggaagatatggaaccctctggcttgaaaataacgcccctacgcgctn

SEQ ID NO: 44735 - protein, 37 aa, Zea mays
  misc_feature: Ceres CLONE 1447382-F
MALSLSMEGIEARARDLGVDLSADDLDSITLPAGEEF

SEQ ID NO: 44736 - DNA, 709 bp, Zea mays
  misc_feature: Ceres CLONE 1447385-F
  misc_feature: Encodes the peptide sequence at SEQ ID NO. 44737
  misc_feature (513)..(513): n is a, c, t, g, unknown, or other
  misc_feature (661)..(661): n is a, c, t, g, unknown, or other
cgcggtggcggccgctctataactagtggatcccccgggctgcaggaattcgcacgagaccattacctagaacatcctaatcgaaaagcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcatcaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaaccatttccttggaatcgccaccggcaagacgaatccgcagattgcattcattcgaggggcgattaaaatcaaggggagcatcagtgcggcgcagaagttcacccctgacatncttcccaagcctgctaagctgtagaaggttagattgtgtattacttggtcgaggtgaataataatgtttgccagctttcattactatgtacgagatacaatgagtggaacatgaaaagcacgttctcggtggggaattggatatgggntgaacttcaccttaaatcagcttcatgttcgtttctaaaaaaaaaaaa

SEQ ID NO: 44737 - protein, 122 aa, Zea mays
  misc_feature: Ceres CLONE 1447385-F
  misc_feature (12)..(116): Pfam Name: SCP2 Pfam Description: SCP-2 sterol transfer family
  misc_feature: SWISSPROT Homolog: EC 2.3.1.176 Propanoyl-CoA C-acyltransferase
  misc_feature (115)..(115): Xaa is any aa, unknown, or other
MDSSSLKSAQLLELMRQHLATDAGKEVIKKVGLVYQLNIAPKKIGVDEEIFVVDLKKGEVTKGPYQGKPDATFSFTDNHFLGIATGKTNPQIAFIRGAIKIKGSISAAQKFTPDXLPKPAKL

SEQ ID NO: 44738 - DNA, 687 bp, Zea mays
  misc_feature: Ceres CLONE 1447386-F
  misc_feature: Encodes the peptide sequence at SEQ ID NO. 44739
  misc_feature (527)..(527): n is a, c, t, g, unknown, or other
  misc_feature (585)..(585): n is a, c, t, g, unknown, or other
  misc_feature (619)..(619): n is a, c, t, g, unknown, or other
  misc_feature (676)..(676): n is a, c, t, g, unknown, or other
gctctataactagtggatcccccgggctgcaggaattcgcacgagaccattacctagaacatcctaatcgaaaaattatcggcggcgacggtactcagaaaggcgcctctgtgatttacgaggaagtccggagacggggcctcaaatgtgctgtggtcggcgtcccaaagacaatcgacaatgacatcgcggtgatcgacaagtcgttcggatttgacactgccgtggaggaggcccagagggccatcaacgctgctcatgtcgaggctgagagtgcagagaacggcatcggtgtcgtgaagctgatgggtcgcaacagcggtttcattgccatgtacgctactctagctagccgcgacgtggactgttgcttaatcccggagtcgcccttctaccttgaagggaagggagggctccttgagtttgtcgagagacggctcaaggacaacggacacatggtcatcgtggtggccgagggtgctggacaggatctcatcgcgaaaagcatgaattccgtggacacccangatgcttcgggaaaatagctgcttctgggatgtggcctctggctatcccagaagaaanggatcattttcagaagaagcccccgttcccgatnactctcaagtacatcgacccgacttacatgatccgcgccgtcagtttcaacgctttngaacacgtcta

SEQ ID NO: 44739 - protein, 180 aa, Zea mays
  misc_feature: Ceres CLONE 1447386-F
  misc_feature (2)..(177): Pfam Name: PFK Pfam Description: Phosphofructokinase
  misc_feature: SWISSPROT Homolog: EC 2.7.1.90 Diphosphate--fructose-6-phosphate 1-phosphotransferase
  misc_feature (175)..(175): Xaa is any aa, unknown, or other
SITSGSPGLQEFARDHYLEHPNRKIIGGDGTQKGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDNGHMVIVVAEGAGQDLIAKSMNSVDTXDASGK

SEQ ID NO: 44740 - DNA, 789 bp, Zea mays
  misc_feature: Ceres CLONE 1447388-F
  misc_feature: Encodes the peptide sequence at SEQ ID NO. 44741
  misc_feature (1)..(1): n is a, c, t, g, unknown, or other
  misc_feature (400)..(400): n is a, c, t, g, unknown, or other
  misc_feature (765)..(765): n is a, c, t, g, unknown, or other
naaagctggagctccccgcggtggcggccgctctagaactagtggatcccccgggctgcaggaattcgcacgagaccattacctagaacatcctaatcgaaaattcccctcgcgcaccgctcctgagtcctgtccaccctgccaccgccgacgccgcgccgccgcatcaattgtcaccgtcgctatggcccgtatcaaggtgcacgagctccgggggaagagcaagacggacctgcaggcgcagctcaaggagctgaagtctgagctctccctcctccgcgtaggcaaggtcaccggcggcgcacccaacaagctctctaagatcagggtggtgcgcacctcgatcgggcgcggggtcacagttatctcccaccaccacaaggggggggggcgggaagcntaccaaaaaaaaacccccccccccccccaactccgccaaaaaaaacccgggcctctcgcccgccgtttggaacaaccccggttttttctaaaaaccgaaagggaaaaaaagctggaaaattctctcccccgggagaatattccctttcaggctctagtccaaaacgggaaaaggcgcccttaaacaatacaccggcggggttatattttttgttttttttagaattttcccggggcgcgcggagaacaaaattcctccccctctcacccaaccgactacttggttttcgccgccaacaaaaaaaaaaaaacatttacttaaccccataccccgcggagggggcgcgaccccaccattccccctanaaagagactcacacctggcgccct

SEQ ID NO: 44741 - protein, 132 aa, Zea mays
  misc_feature: Ceres CLONE 1447388-F
  misc_feature (6)..(64): Pfam Name: Ribosomal_L29 Pfam Description: Ribosomal L29 protein
MARIKVHELRGKSKTDLQAQLKELKSELSLLRVGKVTGGAPNKLSKIRVVRTSIGRGVTVISHHHKGGGREAYQKKTPPPPQLRQKKPGPLARRLEQPRFFLKTEREKKLENSLPRENIPFQALVQNGKRRP

SEQ ID NO: 44742 - DNA, 597 bp, Zea mays
  misc_feature: Ceres CLONE 1447392-F
  misc_feature (196)..(196): n is a, c, t, g, unknown, or other
  misc_feature (216)..(216): n is a, c, t, g, unknown, or other
  misc_feature (298)..(298): n is a, c, t, g, unknown, or other
  misc_feature (299)..(299): n is a, c, t, g, unknown, or other
  misc_feature (347)..(347): n is a, c, t, g, unknown, or other
  misc_feature (348)..(348): n is a, c, t, g, unknown, or other
  misc_feature (359)..(359): n is a, c, t, g, unknown, or other
  misc_feature (478)..(478): n is a, c, t, g, unknown, or other
  misc_feature (499)..(499): n is a, c, t, g, unknown, or other
  misc_feature (502)..(502): n is a, c, t, g, unknown, or other
  misc_feature (505)..(505): n is a, c, t, g, unknown, or other
  misc_feature (512)..(512): n is a, c, t, g, unknown, or other
  misc_feature (513)..(513): n is a, c, t, g, unknown, or other
  misc_feature (528)..(528): n is a, c, t, g, unknown, or other
  misc_feature (529)..(529): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (569)..(569): n is a, c, t, g, unknown, or other
  misc_feature (573)..(573): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
tggagctccccgcggtggcggccgctctagaactagtggatcccccgggctgcaggaattcgcacgagaccattacctagaacatcctaatcgaaaaatagcctgcagccttccatccacgaactcccgttctccatttccagccatggcggtgtcgatcgagctcaccaaggagtacggggctatcgtcgtggcntgggggtgcttggggtgggncccctaaaggggtttttttcccccccccaaacccccttttttgtggggggggggggggtttttttcccagagaggggggggnngcggaagaaaagaggggcgcccctcccccgcccccaaaaaaaaaaaannagaggcccccncgggggggggggggggggtctctttcttcccccccccccccccacggggtggggggggggggccccccccccctccctctttcttataggggggggggggggagaaaaaaaaaaaaaanggaggggggggggggggcgcnccnccnccccccnnttttttttttttttnntttttatatcccannnncgggggggggaaaggagaaaganaaanaagnnncgcggggggcggcggccc

SEQ ID NO: 44743 - DNA, 870 bp, Zea mays
  misc_feature: Ceres CLONE 1447400-F
  misc_feature (17)..(17): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (242)..(242): n is a, c, t, g, unknown, or other
  misc_feature (419)..(419): n is a, c, t, g, unknown, or other
  misc_feature (420)..(420): n is a, c, t, g, unknown, or other
  misc_feature (457)..(457): n is a, c, t, g, unknown, or other
  misc_feature (475)..(475): n is a, c, t, g, unknown, or other
  misc_feature (870)..(870): n is a, c, t, g, unknown, or other
ctggttgaaaccacaancccacaaannnnnnaaannnncnncaaaactggagctcacccccgtggcggccgctctacaactaatggatccccccggctgcaggagttcgcacgagaccattacctagaacatccaatccaaaaattctttctctctcacgctaaatggatggggacgctacgccgcattcctcccccgcagccgcttcttcgcccacacgctcgcgcgctcggaatactccnaggagggtgctcgaggagggcgacgatccggccacttcctgctcgcctcggcgcgggacccgcgccccggagccctagagctctccccgcggcgggaccgccaaagccctccggcgcgtgaagaaaatgaaggctgctctggagggggcctgcgccaagggacttgatgtgattttnnccaactgggttgaaggggtgatggagttgtttagcgnccagtcccccccaaaaanaaagaaggaccagccccccaccccggagggcccccatcccggactaagaggcggaatgctaacttctgcatggccggtgggcggccgacctcgggggccccgataggggaggggcagagcggggacccccctcagggagagagcctaaattccccaagtatccaccacctatcaatctacttttgtgcattagatagcacggtggggccgcccgcgtgggggggcgtccctctctttcgttctctcgcgccaccagcacatgggtgcccctgtgggttgttgggccatggttggtgtcgactctcccgtgtgggggttacgccccacctctcatttgagtaaatcaagcaaacgattccaggtgcgcgccaatagaataggcgacccggctggtn

SEQ ID NO: 44744 - DNA, 745 bp, Zea mays
  misc_feature: Ceres CLONE 1447404-F
  misc_feature (280)..(280): n is a, c, t, g, unknown, or other
  misc_feature (302)..(302): n is a, c, t, g, unknown, or other
  misc_feature (305)..(305): n is a, c, t, g, unknown, or other
  misc_feature (306)..(306): n is a, c, t, g, unknown, or other
  misc_feature (314)..(314): n is a, c, t, g, unknown, or other
aaagctggagctccccgcggtggcggccgctctagaactagtggatcccccgggctgcaggaattcgcacgagaccattacctagaacatcctaatcgaaaaagttccatctctcccctgagacccccaacgccggggccggaaaaaagggaagccagagcacagagccagacctggcggcgctgggcatccagaaacgccgcctaggatccttctctctctctctctcttcgcgtccatcgacctgacccgcgaggcgcgtgcttcttcttcccgctcntcactgtcatgaagattgaggnaannctgcatgnttgatatacccagctgctttctgtaacgaaaactcttgggatcaaatttgtggaataagtcactgtcaggaagggattctacttggcagttcttggtattaaagggtgctggccttcccttggagggaatctggaaaaaaaatgggaaaaacccccccggaaaaatttgcccttgcccgggggtgctgggcaaatggccttttcccaaaaaaaaaacccccctgtgggatttttttaaggcggcctccttttctgtgttgggggaaaaaaaaccctctcttttttaaaggtccggggggcccctagtggggcattggcccccttttttttggggggagaaaaaaaaaggacctccgaagaacccccgggaaaaaaaaaattttggggggcccccccccttccggggggggggccccccccttcctgggggg

SEQ ID NO: 44745 - DNA, 765 bp, Zea mays
  misc_feature: Ceres CLONE 1447409-F
  misc_feature: Encodes the peptide sequence at SEQ ID NO. 44746
  misc_feature (198)..(198): n is a, c, t, g, unknown, or other
  misc_feature (292)..(292): n is a, c, t, g, unknown, or other
  misc_feature (374)..(374): n is a, c, t, g, unknown, or other
  misc_feature (387)..(387): n is a, c, t, g, unknown, or other
  misc_feature (427)..(427): n is a, c, t, g, unknown, or other
  misc_feature (434)..(434): n is a, c, t, g, unknown, or other
  misc_feature (435)..(435): n is a, c, t, g, unknown, or other
  misc_feature (555)..(555): n is a, c, t, g, unknown, or other
aaagctggagctccccgcggtggcggccgctctataactagtggatcccccgggctgcaggaattcgcacgagaccattacctagaacatcctaatcggaaaaatccatcacagctagctagcatacagacgaataatctcttcttcacctcactaacaccagctagcaactctttctctcctgcaataatggccgcntcgctcctcctcctcccagccgcagctggtcgcggcggcggcggtcctggcagcggcgctgctgctgctggcggcgggggccgggacggcgtcngcggcggtgagctgcggcgaggtgacgtcgtcggtggcgccgtgcctcgggtacgcgatgggcagcgcggcgtcgccctccngcgcgtgctgcancggggtgcgctcgctcaacagccgcgcgtcgtcaacgggngaacggnnaggccacttgcaacttgcttcaagagcatgaaggcccggttcggggggggggttaaaattggccaaagccggcaaattcccttccaaaggggggggttcccggtggggggggccattaancccccaccggtaaaggggccaaaaaaaattgggattgggggaacccttgtggggggtcccccccctctttgaagggaagacaaaaaggggcccacacaaaaatgggagctctcccctaaaaagaaaagaacccaccacaccgggggggggggcgccaaaagggggccataaaaaaaaagagaaatgtgcccccccccccccaagtgtatt

SEQ ID NO: 44746 - protein, 38 aa, Zea mays
  misc_feature: Ceres CLONE 1447409-F
  misc_feature (9)..(9): Xaa is any aa, unknown, or other
  misc_feature (13)..(13): Xaa is any aa, unknown, or other
  misc_feature (29)..(29): Xaa is any aa, unknown, or other
MGSAASPSXACCXGVRSLNSRASSTGERXGHLQLASRA

SEQ ID NO: 44747 - DNA, 728 bp, Zea mays
  misc_feature: Ceres CLONE 1447411-F
  misc_feature: Encodes the peptide sequence at SEQ ID NO. 44748
  misc_feature (352)..(352): n is a, c, t, g, unknown, or other
gctctcttctagtggatcccccgggctgcaggaattcgcacgagaccattacctagaacatcctaatcgaaaaacaacatccgatccgaaacctagcaccacccccggacagacgggcgcgaactctaaccctataaactgtagccatggattcggtaggcggaggagggagcggtgcgcacaaggcggcctcgggctccgcgccctcgccggcgcctaaccccacggcgatgctttctgcgctcatgagcaaccacgccaagctccaggaggagctccgctccatcgagcgccaggtttatgatatggagaccacctacctacaggaaactaatcaatttggaagtgtgcngaagggttttagatctttttttggcatccacaccaaacagcttgtaaccttaaggggttctcggaacttttcaaggctggcaaagaggttatttcaaccatggtcgtcccggtccctcccccccacaggctgaattaacaattcttggccttggaccaagattaacttgaagaaaatgttttggacccaggtccttttctaggggggtggaaccctccccttggcaaacgggtaaagggctaacccaaaataaggtggggggccccctgttgtggggaagatatggaaaaaacaaaatgcgccgcgaaaaggcccccaaacctcggggaaataaaaagggcaccttttctctttcccgtttttatgcccaattgag

SEQ ID NO: 44748 - protein, 112 aa, Zea mays
  misc_feature: Ceres CLONE 1447411-F
  misc_feature (25)..(108): Pfam Name: NuA4 Pfam Description: Histone acetyltransferase subunit NuA4
  misc_feature (69)..(69): Xaa is any aa, unknown, or other
MDSVGGGGSGAHKAASGSAPSPAPNPTAMLSALMSNHAKLQEELRSIERQVYDMETTYLQETNQFGSVXKGFRSFFGIHTKQLVTLRGSRNFSRLAKRLFQPWSSRSLPPTG

SEQ ID NO: 44749 - DNA, 739 bp, Zea mays
  misc_feature: Ceres CLONE 1447413-F
  misc_feature: Encodes the peptide sequence at SEQ ID NO. 44750
  misc_feature (274)..(274): n is a, c, t, g, unknown, or other
  misc_feature (333)..(333): n is a, c, t, g, unknown, or other
  misc_feature (334)..(334): n is a, c, t, g, unknown, or other
acccgcggtggcggccgctctagaactagtggatcccccgggctgcaggaattcgcacgagaccattacctagaacatcctaatcgaaatcgctcgttgcgcgttcaaatttcgaaccacctccgccttcgacgccccaaaccctagcccgacccctcctcctccacctgcgccaccgcccaccatgagctccgccgccgcgccagctgccgtcggcagcggcaaggagcttggccatctgccccgcgacggaatcaccaccctcgcttctctnacacaagcacaactcctcgtctctcatggaacagacggggcggcttacgacgcgacccnnagtgctcaggggggagtcatggcccccgggggccttcttcaaaggtggtttccaaaaactccttgggggttaaggcccgggcccaacaccccggggggagggtgggatttatccttccccagaaaaatttttggggcgctaaggggcccccttttttggggaaaaacctttttggggggggggagtctccccggggcgggggaaaaaaggaaaaaaggggggccacagagggattgggggcacccccccccctcttggggggaaatcctcccccaccgggggttttttctttcttttaaaaaaaaaaatgtggtgttctcccccccgaaaaaaaaatatattattgtggggggttttcctcccccaaaaaaaaaaaattcttttcttaaaacaaagaggggtggt

SEQ ID NO: 44750 - protein, 35 aa, Zea mays
  misc_feature: Ceres CLONE 1447413-F
  misc_feature (12)..(12): Xaa is any aa, unknown, or other
MEQTGRLTTRPXVLRGESWPPGAFFKGGFQKLLGG

SEQ ID NO: 44751 - DNA, 715 bp, Zea mays
  misc_feature: Ceres CLONE 1447415-F
  misc_feature: Encodes the peptide sequence at SEQ ID NO. 44752
  misc_feature (277)..(277): n is a, c, t, g, unknown, or other
  misc_feature (302)..(302): n is a, c, t, g, unknown, or other
tggcggccgctctagaactagtggatcccccgggctgcaggaattcgcacgagaccattacctagaacatcctaatcgaaaagcagcgcgcgcgagagggagccggagccggctgcctgcttgaacgcctggtaacacggcctctcgcttcccctcccaaactttccctaccccgaccgccgatcctcctcgccttgacgtccaagagccccggtccgatgggtcgtccgccgagcgccggtgctccggcgttccgcttcctcccgtccgaagtggncgaaatgggagcgcgcctgctgcanctcaacacgggcatcccaccgcgccgtgctgcagatcttcgcggataagtctccgcttcgcccgaccgcgctggcaaggtgccatccagcctagcaggtgtggaactggtttccaaacaaacggatctcaccggggcaaaattccaggggccggtccccccgccggtaaaaaaaacccctgggagttagaacccccggatggcctaaagcccccccctctggggggtctccctttttttgggtgggggggccaccggggttctccctttagggaaaaatttgggggaagggcctctttatattttgggcacacccccccccggggggggaggaaaaaatttctccttttttttcacacagggtttaaaaaccccggccccggggggggggttttttttttctttgggggggga

SEQ ID NO: 44752 - protein, 43 aa, Zea mays
  misc_feature: Ceres CLONE 1447415-F
  misc_feature (20)..(20): Xaa is any aa, unknown, or other
  misc_feature (28)..(28): Xaa is any aa, unknown, or other
MGRPPSAGAPAFRFLPSEVXEMGARLLXLNTGIPPRRAADLRG

SEQ ID NO: 44753 - DNA, 710 bp, Zea mays
  misc_feature: Ceres CLONE 1447420-F
  misc_feature: Encodes the peptide sequence at SEQ ID NO. 44754
  misc_feature (374)..(374): n is a, c, t, g, unknown, or other
  misc_feature (438)..(438): n is a, c, t, g, unknown, or other
  misc_feature (483)..(483): n is a, c, t, g, unknown, or other
  misc_feature (488)..(488): n is a, c, t, g, unknown, or other
ctggagctccccgcggtggcggccgctctagaactagtggatcccccgggctgcaggaattcgcacgagaccattacctagaacatcctaatcgaaaaaaagcacgagcccggttcgttctcgacctttcgtctcgctctcgcccgcccgaccccgcggagccctagcctagccttgcccccgaccgcggattccccctcggccgccgcgcgcccgcacccgcacccgcgatgatgaactgcgccggaggcggagaccccgtggaggacttcctgatctccggcgccgtcgacgacgaagatctagccatcttctgcgacggaggacttgggatttgagggtgtcatggagatgcttgtggatttgagcagtcntatttgggcaaaaggagtagagatgaaccctggttcatcttggtctaaaatccaaagcttgtcntgaaaaaattggggaggaacaagctgaatgacaggttcctggaanttaanttccggttatgattcctggaaaccaagccaaagtggataaagcccatttcttgggccgccccaccccgttggggggcccacctttaaggggggggggaaaaacttttaagaatcccatgggaacgctgggggaaaaatttcccggcctgggggggggggaaaaaatgtcctcccccaaaaaaaagggggggtgaagggtgaaaaaaaaaggggggggacccc

SEQ ID NO: 44754 - protein, 35 aa, Zea mays
  misc_feature: Ceres CLONE 1447420-F
MMNCAGGGDPVEDFLISGAVDDEDLAIFCDGGLGI

SEQ ID NO: 44755 - DNA, 705 bp, Zea mays
  misc_feature: Ceres CLONE 1447421-F
  misc_feature: Translation starting site: 399
agagctggagctcaccgcggtggcggccgctctagaactagtggatcccccgggctgcaggaattcgcacgagaccattacctagaacatcctaatcgaaaattccacctcgtccactgccgcggcgaacaccatcgtggaagaagcggcggtggcggcggctgtatccgtttcgcagcataccggatccatctccgacgcgctacggcactatgggaagtgctaccgggagctctcgaaagtccgcctcagtgctcttgttgtggcaacttcgggggctggttatgtgcttggtagtggcaacatcgtggatattgctggactttgttgcacatgtgctggtacaatgatggttgcagcatctgcaaataccctcaaccaggtgttcgagataaaaaatgatgctaatatccccccgacaatgcgacgtcccctgccatctggtcgcatcagtcctgcacatgctgcaatgtgggctacaagtgttggagttgcaggaacagctttgttggcctggaaggtttgtgcaggctaatggcttggcagctgggcttgcagcttctaaccttgttctgtacgcatttgtgtatacgccgttgacgcaaatacaccctgttaatacatgggttggggcaatcgttggtgccattccaccacttttggggtgggcggcagcttccactgaactgtcactaaatgccctga

SEQ ID NO: 44756 - DNA, 767 bp, Zea mays
  misc_feature: Ceres CLONE 1447425-F
tccccgcggtggcggccgctctagaactagtggatcccccgggctgcaggaattcgcacgagaccattacctagaacatcctaatcgaaaaaaacgaacccagccgaagcccgagctgagcaaggcggacgcggcggaaccggcgatgcaccgtctccatcggatcttaggctcctccagcccggggcagccgtcgacggactcgtcgctgatcgattacctcaagtagggctccgtctcctcgctcgcgcttctcaagatgctctagcaccgcagggccggcgtgctcatggagttcatggctctcatgttcagtgagttcatccattaccctaccgtggatgtatttggagttagttgccaaggaaaaaaacatgaattggagtttactttgggaaaccaaacagacgcgcctcccaaatatagatgctgtggagtggcttgatgagacctctcatgcctgtaaatggtttgtagggtcttgtattttcctaactacattgttttctagattggctggatattaaggcacttgcacgttctattatttagcgccacgtctttaaggtttttcaaactcctcgtgcagtttactcgatgctgtacaaattccactcctataactgttaagaggaaaaagatcgattacgcggaaccatttctgccattctggggcctctcctaaccatgattgtcttggctttcaccccccgccgataaacagtaggtgaaactggttccggtttttgtaacgaatgcttttttgg

SEQ ID NO: 44757 - DNA, 727 bp, Zea mays
  misc_feature: Ceres CLONE 1447432-F
  misc_feature: Encodes the peptide sequence at SEQ ID NO. 44758
aaaagctggagctcaccgcggtggcggccgctctagactagtggatcccccgggctgcaggaattcgcacgagaccattacctagaacatcctaatcgaaaacttaggactccggacatctccgcgatgcaccatgacggcacgcctgacctgagagtcgtggcggagaagctggccgacaacctcagggtcagggacacgtccttggacacgaggaagatggtggtcgagatctgcgacatcatcaccgggaggtctgcccggctggccgcggcggggatcgtccggattctcaggaacatcagtcgaacggcgccgggcgacgagcgccggtccgtcgtccccatcaacagaggtctgttcgagaactatgatgagttcactaagtgcctgcaggccacactagtgtgacccccccccccacgaggcgtctaggctggtggagatcaagctcaccacggacagatctggcctcggagccgccctcattgcagctgcccactcccagtactgaacgcccaacagccgtgtgtgtcgcggtgcaacttcgcgctgaattcctgtaccttttccagaacaagtttgcttcggaatctgcccacaagcaagtcgtcctcatggaaagtctctaatccagaattcctagtgagtccagggattcccaatggactccccctccccccacctggattggtgaaattcaaccttcagcttgtcccggtaattt

SEQ ID NO: 44758 - protein, 94 aa, Zea mays
  misc_feature: Ceres CLONE 1447432-F
  misc_feature: SWISSPROT Homolog: EC 2.7.1.1 Hexokinase
MHHDGTPDLRVVAEKLADNLRVRDTSLDTRKMVVEICDIITGRSARLAAAGIVRILRNISRTAPGDERRSVVPINRGLFENYDEFTKCLQATLV

SEQ ID NO: 44759 - DNA, 652 bp, Zea mays
  misc_feature: Ceres CLONE 1447434-F
  misc_feature: Encodes the peptide sequence at SEQ ID NO. 44760
ctggagctccccgcggtggcggccgctctagaactagtggatcccccgggctgcaggaattcgcacgagaccattacctagaacatcctaatcgaaaaatcccaaagagcacgcagcgcagcactgaagcaccacttcctgcactcactgctagctgctcacaccgtgctagtaacagtccatcaccagtcaccaccaatggctcccaaggttgcgctcttccttgccctcggccttctcttcgctgccgccgcgaatggctgcgaaccctactgtcccggcccagtcgtcccaacgccgccagtcgtgccgacgccgtcgtcgcacagccacggccgctgcccgatcgacgcgctcaaactcaaggtgtgcgccaacgtgctaggcctcgtcaaggtcggcctgccccagcacgagcaatgctgcccactgctggaggggctggtggacctcgatgtcgcactgtgcctctgcaccgccatcaaggccaacgtcctcggcatccacctcaatatgccccttagcctcaacctcatcctcaacaactgcggcaagatttgcccggaggacttcacttgccccaactaattgagctgaatatggagataaaaccagcatccaaggaatgtaccccttaatattcgatctcgcg

SEQ ID NO: 44760 - protein, 129 aa, Zea mays
  misc_feature: Ceres CLONE 1447434-F
  misc_feature (48)..(127): Pfam Name: Tryp_alpha_amyl Pfam Description: Protease inhibitor/seed storage/LTP family
MAPKVALFLALGLLFAAAANGCEPYCPGPVVPTPPVVPTPSSHSHGRCPIDALKLKVCANVLGLVKVGLPQHEQCCPLLEGLVDLDVALCLCTAIKANVLGIHLNMPLSLNLILNNCGKICPEDFTCPN

SEQ ID NO: 44761 - DNA, 668 bp, Zea mays
  misc_feature: Ceres CLONE 1447441-F
  misc_feature: Encodes the peptide sequence at SEQ ID NO. 44762
ctccccgcggtggcggccgctctagaactagtggatcccccgggctgcaggaattcgcacgagaccattacctagaacatcctaatcgaaaaatccaagtaaaccctgctgccgaacgaaggactgaaggagcagcaaagccaccttccttctccaccacatcacctcacctctctcagtctcacgccgcagtcaccaactcgccacgcacgccttcgccgcctataaccggtaccggccaccaccactagctcccccgaggaccacaccccccaaggccccaagcccacgacgcgccacgccacgccgccagctgtcgctctccctcgcccctccccgctcctctcgccgcctcgcaatcaatggcggtggcgcggctgtgcgcggcggccgccgccgcccggctgcagccggcgctcgccgcgggcgcccgcggcctcgggacggcggcggaggtggccgcgaccgccaggtgggagcccatgggggcgcgggagtactacgactaccgccgggccatgtacggcgacatcacgcacaaggccatcctcgtcgacgccgccggcacgctgctcgccccaaccgagcccatggcgcaggtgtacagaacgataggccagaagtatggggttgattactccgaggatgagattctgatgcggtatcgc

SEQ ID NO: 44762 - protein, 102 aa, Zea mays
  misc_feature: Ceres CLONE 1447441-F
MAVARLCAAAAAARLQPALAAGARGLGTAAEVAATARWEPMGAREYYDYRRAMYGDITHKAILVDAAGTLLAPTEPMAQVYRTIGQKYGVDYSEDEILMRYR

SEQ ID NO: 44763 - DNA, 733 bp, Zea mays
  misc_feature: Ceres CLONE 1447462-F
  misc_feature: Encodes the peptide sequence at SEQ ID NO. 44764
  misc_feature (613)..(613): n is a, c, t, g, unknown, or other
caaagctggagctccccgcggtggcggccgctctagaactagtggatcccccgggctgcaggaattcgcacgagaccattacctagaacatcctaatcgaaaaccacttctcctcctgatgtactccttttgggtacctcaaattgtcacaaatgtcatcagggatacaagaaaacctctgcacccacaatatattttaggcatgacagttacacggcttgctattccattgtatatatttggttgccctagtaatttcatgcgtatcgagcccgacaagaaatggtccatagctgttacagtattcatgggtatccaagcagcagtgcttctgcttcagcactatcttggttctcgctgctttattcctcgccagatactgcctgagaaatactgctaccataggaagggtagagacagcacaaatcagcccatcgattgtgttatttgcatgactaccatcgaccttaccaaagaaacagtgaatacatggtggcaccttgcgagcatatatttcactcaagctggttaacagcgttggatggacattaagatgggagtgcccctacttgccggggcctcccttaccaccagctttaaaatgagcctttgnatccaaattaaaaaagggaaacaaaaataaggtagctccacctaatacaaggggggggggaacttaatgtaccaaaaggggagggttcccaatccgtgtaaaaactttaaaaagaaattt

SEQ ID NO: 44764 - protein, 176 aa, Zea mays
  misc_feature: Ceres CLONE 1447462-F
KAGAPRGGGRSRTSGSPGLQEFARDHYLEHPNRKPLLLLMYSFWVPQIVTNVIRDTRKPLHPQYILGMTVTRLAIPLYIFGCPSNFMRIEPDKKWSIAVTVFMGIQAAVLLLQHYLGSRCFIPRQILPEKYCYHRKGRDSTNQPIDCVICMTTIDLTKETVNTWWHLASIYFTQAG

SEQ ID NO: 44765 - DNA, 639 bp, Zea mays
  misc_feature: Ceres CLONE 1447482-F
  misc_feature: Encodes the peptide sequence at SEQ ID NO. 44766
  misc_feature (630)..(630): n is a, c, t, g, unknown, or other
gcggtggcggccgctctagaactagtggatcccccgggctgcaggaattcgcacgagaccattacctagaacatcctaatcgaaaactgcaccacacccaaggcagccagtgagccagaaagaagaagaggccattcgaagctgccacgcacgccacgcggaaaccattcgagtccacgaggacgaggagcagcagcagaagaaagggcaaggaacatcctccggtggccgccgccatggccggctgctgcgtgttcctccggtggccgtcggcctcgccgtcgcgcatcggctaccgctccctcgtccacacggcggccgacgacggcgccccgccgtcgacggtgacggtcgtggtcgggaaggagcggcgggcgttcgcggtggaccgcctcgtgctcgactcctacccgctccggctgctcctggagacggcggcgcgcagggaggagcgcagggccgggggcggcgccatcttcgtggacgtcgacgccatcctcttcgagcacatcctctggctcgcctgcgacgcccgctccgtctcccagatcctgcacctcgacctcaaggagatcatcgacttctacgctcaggacgcgtgactggtccaccactctcagctgcgcggcntcggctccg

SEQ ID NO: 44766 - protein, 121 aa, Zea mays
  misc_feature: Ceres CLONE 1447482-F
MAGCCVFLRWPSASPSRIGYRSLVHTAADDGAPPSTVTVVVGKERRAFAVDRLVLDSYPLRLLLETAARREERRAGGGAIFVDVDAILFEHILWLACDARSVSQILHLDLKEIIDFYAQDA

SEQ ID NO: 44767 - DNA, 680 bp, Zea mays
  misc_feature: Ceres CLONE 1447489-F
  misc_feature: Encodes the peptide sequence at SEQ ID NO. 44768
  misc_feature (621)..(621): n is a, c, t, g, unknown, or other
  misc_feature (625)..(625): n is a, c, t, g, unknown, or other
caaagctggagctccccgcggtggcggccgctctagaactagtggatcccccgggctgcaggaattcgcacgagaccattacctagaacatcctaatcgaaaagttgacagggcttcaaatctctcactgatccgggaaactcaaatctccacagtaaggatccaacttcattatggtgccaccgcatattcccaattcaagaaacttgcattctatcagaagaagacctgcatgccactgtgtcaaagttattccttgacttctcgaggagcaagacaaacgaagacaagcctataaagtttgcggttgcctataatagaaggggcattgatgagacagagaagaacagtaatgaaggttcaaaccagcagactttgatggatagggagcaatgtttcaaagtggtagctgctgctgtcaaatccgttgctgagaactcagtggttgatcttagatcgcctgaggttgcggtactcgttgagatgctcccggtttccggggtacctcttggatcttcggtggctggggtgtctgttctcccagccgaactcatctcgaccaaacctcgcctttgtgtcaggtctttggtgcctgatgcaaaaccagaaaaaagagtgaantacngtggcgctcgtcaaccaaagtactgtaatgggaactgcccatgcagtttttccat

SEQ ID NO: 44768 - protein, 100 aa, Zea mays
  misc_feature: Ceres CLONE 1447489-F
  misc_feature (81)..(81): Xaa is any aa, unknown, or other
  misc_feature (83)..(83): Xaa is any aa, unknown, or other
MDREQCFKVVAAAVKSVAENSVVDLRSPEVAVLVEMLPVSGVPLGSSVAGVSVLPAELISTKPRLCVRSLVPDAKPEKRVXYXGARQPKYCNGNCPCSFS

SEQ ID NO: 44769 - DNA, 763 bp, Zea mays
  misc_feature: Ceres CLONE 1447492-F
  misc_feature: Encodes the peptide sequence at SEQ ID NO. 44770
  misc_feature (347)..(347): n is a, c, t, g, unknown, or other
  misc_feature (419)..(419): n is a, c, t, g, unknown, or other
caaagctggagctccccgcggtggcggccgctctagaactagtggatcccccgggctgcaggaattcgcacgagaccattacctagaacatcctaatcgaaaaattttccgtgcccgcgcccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtgatcgagggggagagatagagcttgggtggttggattagggagagaagggaggggaggatgtccanacggtcgttgaacccgagccggcgggtggcggacgggggtctgccgacagtcggaggcctgtttcacccaantcacgctcgcctcccgtgcttactattgccctagtcgtccctggtgtcattcttctcgtcgcctacttcacagcggttcaagtcggttaaaagatctccggtgtaactgtacaagcagaaaatccggtaccaggtctgaagggcaacccaggtccaccaaaacgctagggcccaaaactcccaaatttgggaaaaccggcaaaatttgcgaagttctttaggggggaaccgggactttttcccaaacgggttgcacaaaaaacaagggccccttaaaaaatccaaaaagcttccttccaaaaaaaaaaaaaacccggggggcaaaaattccccccgagtccccc

SEQ ID NO: 44770 - protein, 37 aa, Zea mays
  misc_feature: Ceres CLONE 1447492-F
  misc_feature (3)..(3): Xaa is any aa, unknown, or other
  misc_feature (27)..(27): Xaa is any aa, unknown, or other
MSXRSLNPSRRVADGGLPTVGGLFHPXHARLPCLLLP

SEQ ID NO: 44771 - DNA, 650 bp, Zea mays
  misc_feature: Ceres CLONE 1447494-F
  misc_feature: Encodes the peptide sequence at SEQ ID NO. 44772
tccccgcggtggcggccgctctagaactagtggatcccccgggctgcaggaattcgcacgagaccattacctagaacatcctaatcgaaaaatacctccggcgagaccactcgccgttacaaccatcaggacgcggacgcggacgcggacgcggctcacatcaaacacccccttcagctgtgctcagtgctcactgccgcaaaaccacagccacacagggaagcgcccagcgccctttcacatcaccacatccacgctcctccgttccatggccatgtcgagcagcgccagcaagaagcaagcccaggcccaggcccaggcccagaaggccgggcggaggcccccggcggtgtcgtcggccgcggccgcggacgcggagatgcagagggtgttctcgcgcatccacccacacggcgacgggcggatctcgccgtcggagctggcggcggtgtcgcccgccatctccccgccggcgagctcctcgcacgggcggcgcgaggtggcggccatgatggaggagctggacacggaccgcgacggcttcgtggacctgggcgagttcagggcgttccacgcgcgcggcggcggctttggcggcgactaccacgacgacgcggagctccgcgcccccttcgccgtgtaccacgccc

SEQ ID NO: 44772 - protein, 127 aa, Zea mays
  misc_feature: Ceres CLONE 1447494-F
  misc_feature (77)..(105): Pfam Name: efhand Pfam Description: EF hand
MAMSSSASKKQAQAQAQAQKAGRRPPAVSSAAAADAEMQRVFSRIHPHGDGRISPSELAAVSPAISPPASSSHGRREVAAMMEELDTDRDGFVDLGEFRAFHARGGGFGGDYHDDAELRAPFAVYHA

SEQ ID NO: 44773 - DNA, 734 bp, Zea mays
  misc_feature: Ceres CLONE 1447498-F
taaagctggagctccccgcggtggcggccgctctagaactagtggatcccccgggctgcaggaattcgcaagagaccattacctagaacatcctaatcgaaaaagctcttagttcttctcctctctctctctctctctctcctctcccctctcctgtcgcactctcctgttccggccaccagcgtgcccagcatggtgcaacgctcgggtagaggagggcggagctggtcttcaggggtagcttgaactggcgaccggattggtttggagaccggtttgtccctgatttggtgccccaagtgcaagatggcccgagtgattgaactgagggtgaagagggagaatgagaacctaggccaagtgtttatcaagtgccctaggagtgttgacgctttgattgccattactttgtgtttttccaaaatctgattttggaatatttgatttgcttttgtatgtgtagatgccaggaaggggcccatcctacagatggcagagggagtattttgaggaatttgttaaaggaaggttgaattgccttgttattcaaaaatttgaaagaaaaaaattgaaaaggggaattccaaaaaggtttctgaaattggaaaaaagggaaaaaattcccactttctgttttaaagggtttaaaaacccttggggaaaaaggggggaaaaaaaaatttttaaaaaacttctcctctcaggggttttttaaaaaaaattgaaaaaatttt

SEQ ID NO: 44774 - DNA, 672 bp, Zea mays
  misc_feature: Ceres CLONE 1447500-F
  misc_feature: Encodes the peptide sequence at SEQ ID NO. 44775
  misc_feature (672)..(672): n is a, c, t, g, unknown, or other
tggagctccccgcggtggcggccgctctagaactagtggatcccccgggctgcaggaattcgcacgagaccattacctagaacatcctaatcgaaaaatatattccctcggagcaaagtgttgcggaattcacatcagccagggagaagcccgctgacagctgcaactgcaagccgccacgggctgagctgaggctgtgtcgatccatccgtattcaggaaaacaacgccaatcaatccagtccagaggaagggcgatggccgccgctaggatcgccgcctgcaccacctccgcccgcaccgccctcgccttggcagacgaccccgcgccgccggacacgctggacgtggtgcgccggcagcgccagctcctacgccgcgccgcggccctctgcctcgaccccatcgccgaggagtccgacggtggcatcgactctgcctccgacgtccactccttgggccggagccggagccggggccagaccgccgccacctccgcactgccggcgcgtccctgaggatctgaaccgtcaaagacgagaccttttccttcttgccataggagtggagttttttcccgtgggttttaagaaatactccgtacaatgtatatgttgttactatagtaatattatagaatatagaccaaaagctgtttcagacaccgttgcan

SEQ ID NO: 44775 - protein, 86 aa, Zea mays
  misc_feature: Ceres CLONE 1447500-F
MAAARIAACTTSARTALALADDPAPPDTLDVVRRQRQLLRRAAALCLDPIAEESDGGIDSASDVHSLGRSRSRGQTAATSALPARP

SEQ ID NO: 44776 - DNA, 781 bp, Zea mays
  misc_feature: Ceres CLONE 1447502-F
  misc_feature (185)..(185): n is a, c, t, g, unknown, or other
  misc_feature (227)..(227): n is a, c, t, g, unknown, or other
  misc_feature (447)..(447): n is a, c, t, g, unknown, or other
  misc_feature (515)..(515): n is a, c, t, g, unknown, or other
  misc_feature (516)..(516): n is a, c, t, g, unknown, or other
  misc_feature (518)..(518): n is a, c, t, g, unknown, or other
  misc_feature (549)..(549): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaactactacagtggcccgccgccgctgcgtccaccaccacctcctttcccaactcctccgcgtacccccgccctctccggcggnccgcgtaaccaccccgcgcagatggcgaccggcggccaccgncggtcccgcgacgggcggcgacccgctttaacggctcctaacggggggcggggctccccaggcgcaataaccccccctccccccccccccctgggggtttcaacccccccccggggggggggcacccccccccccgccctccctaagaaaaacccccccccccccccaccccccaaagaaaaggggaagggttgttggccccccggggtaaaaaaaaaanggggggtgttttttttccaaaacacacaacggggggtccccccaaaaaggagggcgcccccatttttnnanttaaaaaaaacacccccctcgcccccggganaacgggggtnnnnnnnnnnnnnnnttcctcctcccccggtaacccctcctnnnnnntgggctccacaggtctagggccccccaaaggcttccccccctcagggggaacccaagaggggaccttccaaactaccccgaaaacattaactgggaaccatggggtaacttcctcccaaacaggggaaggaacccaactcctgcacaatttttgagggttgagggagcatttgggg

SEQ ID NO: 44777 - DNA, 726 bp, Zea mays
  misc_feature: Ceres CLONE 1447507-F
  misc_feature (704)..(704): n is a, c, t, g, unknown, or other
  misc_feature (705)..(705): n is a, c, t, g, unknown, or other
aagctggagctccccgcggtggcggccgctctagaactagtggatcccccgggctgcaggaattcgcacgagaccattacctagaacatcctaatcgaaaaacgcttcgctctagtcggaaggtttcgaggaactcccgggctcgaggagatcgggacgatgatgggagggcgcgctctgctgctgctcctggtctcggcgctgctcgttcagatccgcgcctctgacccggtaatctaagcgagcctgtggcgatttggctattctgtttgtttttcccggaattttgtgggtgagatttgtgactgtctctcccggtggcgttgtttgcagctgctgtacgagccgtttgatgaggacttcgagggtagatggatcgtctccaagaaggatgaataccaaggtgtatggaaccatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaggttcatttcatcctnntagcacagaaatcctagactg

SEQ ID NO: 44778 - DNA, 712 bp, Zea mays
  misc_feature: Ceres CLONE 1447521-F
  misc_feature (712)..(712): n is a, c, t, g, unknown, or other
taaagctggagctccccgcggtggcggccgctctagaactagtggatcccccgggctgcaggaattcgcacgagaccattacctagaacatcctaatcgaaaaacacatctccctctcgcgctctctcctccatcccccagagatccaccttcccctgctcgcctccgctcacctgcgtgctccggcaacagccgctttcggacttcggtttccctccaccggcgctccaaagaacgttgacgaatatacagatcagctgaccaagaatgaattatcatcaccaccaaaaaagatgaagcacacccaggttagcaaaagcatgccagattctacatattcaaagaatgacaacatttagtccatcatgaaatatatcaaggtatcatgctccatcacttttggtcctgagacttttatgtacatattaaccttatgtttagaccttcctaaaacggtgtctatgcaagaaaagctaggtcacttttgatcagtaaactgttatttgcaccttgcacacatagaaaaggctccatcacttttggtcacaagacttttatgtacatattaacctgatgttgaagcctttctagaactatgtgtgtatgcaagaaaaactatgtcacttctggtcagtagacttttatgtatatatgactccaccgttggagcctttttacaactatgtttgcatatgtaaactctgcatatacn

SEQ ID NO: 44779 - DNA, 648 bp, Zea mays
  misc_feature: Ceres CLONE 1447523-F
  misc_feature: Encodes the peptide sequence at SEQ ID NO. 44780
gctcttacactagtggatcccccgggctgcaggaattcgcacgagaccattacctagaacatcctaatcgaaaaaaccgacccgccgcataagaccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacgcacgtcgacgtcgaagccgttttccggaggttcggtatctcccccggcgttaccgtaggcggcgaggccttatgtgtccccgtttcccgcgatgaacacctgcgcgacgtcccccccccgttctatggccaaccaggtactgcaagaagagacggagcgagagcggcagccccgcaacaggacgatggagctcgtggcgtcaagtggcggcgcgttcgcgctcgctgtcgtctgcaacaaggcactattccccgtgagggtacccatcaccatcgcgctcacgccgcccgtctgccgggacctaagccgctggaggctcgtcaagagctgatctgttgttttttcgtcacaactgctctgggaaatagggtgcat

SEQ ID NO: 44780 - protein, 68 aa, Zea mays
  misc_feature: Ceres CLONE 1447523-F
MANQVLQEETERERQPRNRTMELVASSGGAFALAVVCNKALFPVRVPITIALTPPVCRDLSRWRLVKS

SEQ ID NO: 44781 - DNA, 680 bp, Zea mays
  misc_feature: Ceres CLONE 1447524-F
  misc_feature: Encodes the peptide sequence at SEQ ID NO. 44782
  misc_feature (680)..(680): n is a, c, t, g, unknown, or other
ctggagctccccgcggtggcggccgctctagaactagtggatcccccgggctgcaggaattcgcacgagaccattacctagaacatcctaatcgaaaagagaaattcactctcaccaccaccgcgccgcctccactccccccacacccccggtctgaaacccaagcttccgcttctctcatggccgacgccaccgccgccctctcagctcggagcaaggtgcaggctttcctggaggctgcgcgcgccggcgacctccaatccctcaagaacctcgtcgcggcgctcgacgaggacggcacgggcgccgcctccgtcaccgccgccgtgcgtgacacctacaagcgcaccgacctccacttcgcggcgatcggatgtagcaccgacgtctgtaaattcctcatcggcgagctcggcctccctgtcgacccaaaggacgatgatgggaaaactccgctcatccatgcgacacaccagggccatctggacactgtcaagtatcttctcgaccatggagctgatacttcgctggccaccatcctaggagccacatcgctacaccatgctgcaagcatatggaacacggaactcatgaagcttctcctctccaagggagttgacatccagtcagaaagtgatgctggcactccccttgtgtgggctgctggtcatggcaaccan

SEQ ID NO: 44782 - protein, 166 aa, Zea mays
  misc_feature: Ceres CLONE 1447524-F
  misc_feature (88)..(120): Pfam Name: Ank Pfam Description: Ankyrin repeat
  misc_feature (121)..(153): Pfam Name: Ank Pfam Description: Ankyrin repeat
  misc_feature: SWISSPROT Homolog: EC 2.1.1.43 Histone-lysine N-methyltransferase
MADATAALSARSKVQAFLEAARAGDLQSLKNLVAALDEDGTGAASVTAAVRDTYKRTDLHFAAIGCSTDVCKFLIGELGLPVDPKDDDGKTPLIHATHQGHLDTVKYLLDHGADTSLATILGATSLHHAASIWNTELMKLLLSKGVDIQSESDAGTPLVWAAGHGN

SEQ ID NO: 44783 - DNA, 680 bp, Zea mays
  misc_feature: Ceres CLONE 1447526-F
  misc_feature: Encodes the peptide sequence at SEQ ID NO. 44784
  misc_feature (404)..(404): n is a, c, t, g, unknown, or other
  misc_feature (474)..(474): n is a, c, t, g, unknown, or other
  misc_feature (480)..(480): n is a, c, t, g, unknown, or other
ggagctccccgcggtggcggccgctctagaactagtggatcccccgggctgcaggaattcgcacgagaccattacctagaacatcctaatcgaaaaaaaaatatccgcgcgaccccgacctcccccctcccactccgggcagcagccagcagccagcaggcatggggatacccgtggtggttcccgtcgcggcggcctactcgtgctcctcctccctcgccgcgccaccgagggccgccgccgccgcggcgagggcgccgagccgcgcgcacgtcgcggcggccgggatgtcctccagggcgtcctccttcgtcgggggcagcggaggcgacctcgcggcggtggccgcgtcggtagccgcgcggcccaggagggcgggctccgggggaggcggcgcgctcggntgcaagtgcctctttcgggctcgcgtgccggagctcgccgtcatcgccggcgtcgccgcgcttgtgttcnggcccnagcagctccccgagatcggccgcagcatcggcaagaccgtcaagagcttccaccagggcggctagggagtttgaaactgaactgaaaaaagaccctggggaaagggggggaattagccccaacctgggaattcccaaaaattgtaaaatggccgggaaaaaaaaagggcctttgaggcctttttataccccgggaaaccc

SEQ ID NO: 44784 - protein, 127 aa, Zea mays
  misc_feature: Ceres CLONE 1447526-F
  misc_feature (105)..(105): Xaa is any aa, unknown, or other
  misc_feature (107)..(107): Xaa is any aa, unknown, or other
MGIPVVVPVAAAYSCSSSLAAPPRAAAAAARAPSRAHVAAAGMSSRASSFVGGSGGDLAAVAASVAARPRRAGSGGGGALGCKCLFRARVPELAVIAGVAALVFXPXQLPEIGRSIGKTVKSFHQGG

SEQ ID NO: 44785 - DNA, 659 bp, Zea mays
  misc_feature: Ceres CLONE 1447529-F
  misc_feature: Encodes the peptide sequence at SEQ ID NO. 44786
ctccccgcggtggcggccgctctagaactagtggatcccccgggctgcaggaattcgcacgagaccattacctagaacatcctaatcgaaaaatcgactggttttttttttctgaattgtgatgataggcgggcagcgctgagaaacggaagaggacacgaagcagaagcaaagaaaaaaagtaaaaccaagaaccgccgcctcgccgttcgagagaagggaagaggggggaaaaagatgctcgccagaaccatcggaggcgccgtccgaacccgcctcgcgccgtccctcgcgagccttctctgccgcggctacgcgtcccccgcctcctccgccgacgaccttgtcatcgacgaggacccgccgcgcgccgcctcgacgtccgttgccgccaccaccgtggcggccaccgtgccgaccctcctgcagccgcgggtgctcatctacgacggcgtctgtcacctctgccaccgcggggtgaagtgggtgattaggacggataagcacgccaagatcaagttctgctgcgtgcagtccaaggccgccgagccatacctgaggctggtgggcatggacagggaggatgtgctgcggcgtgtcctctttgtcgagggccccgaggcctattacgagggctctacggctgcgctgaaagtcgc

SEQ ID NO: 44786 - protein, 140 aa, Zea mays
  misc_feature: Ceres CLONE 1447529-F
MLARTIGGAVRTRLAPSLASLLCRGYASPASSADDLVIDEDPPRAASTSVAATTVAATVPTLLQPRVLIYDGVCHLCHRGVKWVIRTDKHAKIKFCCVQSKAAEPYLRLVGMDREDVLRRVLFVEGPEAYYEGSTAALKV

SEQ ID NO: 44787 - DNA, 655 bp, Zea mays
  misc_feature: Ceres CLONE 1447531-F
  misc_feature: Translation starting site: 211
ctccccgcggtggcggccgctctagaactagtggatcccccgggctgcaggaattcgcacgagaccattacctagaacatcctaatcgaaaagctcctctcctgtgctgcgcagccttgccctgctttctccgccgacccaccggccacctcccatcaccactcagtcagatccagtgctccacctacctaccagctccagccgccggcgatggccgtgtccttacccgtcccgatcccgccggcgctcctccacgcggccgcggcgctcgcgctcgccgccgccgcccacttcctccacctcccttccctcttcctctacgccctccacacctacatccacccggacgccgtcccctccaacaccccgcgcgcagtcctccgcccgccgggctccaacgccggtcccgccccgggttcctccaagcgcggcgccgccaaggacaaggacccgttcgacgccacttccgcgcagctctaccgcctccggctctcccacgccacgctcgcctcccgcccccatttcgccgcctaccacctcgcgctcctcctcccgctcgcgctccttctgcccgcgctcctgctcccggccgcccccggggcctccccgctcgcgccgctcgtccccgcggcctacctcttcgttgcactcctcc

SEQ ID NO: 44788 - DNA, 737 bp, Zea mays
  misc_feature: Ceres CLONE 1447534-F
  misc_feature: Encodes the peptide sequence at SEQ ID NO. 44789
caaagctggagctccccgcggtggcggccgctctagaactagtggatcccccgggctgcaggaattcgcacgagaccattacctagaacatcctaatcgaaaaacccaaatcgacgaattcttcccccctctccgatctcgacgcgcaccgatgcgggcgatgtcgtcggcggttaatggtatgctgcgggcacggctgcgcggggcagcgcgcgttcgcggcggcggcggcgagggggccgggcggtggacgaccccaggtcacgaggagcgccccaaggggtacctcttcaaccggccgccgccgcctccgggggaatctcgcaagtgggaggattgggagctgccctgctacgtgacctccttccctcacgtcgtcatcctcggcgtcggcctcaacgcgaaagccgacctttacatcgagacgtgggcgcaccagaaggcgctcgagcggcttcagcagcaggagctcgccgcctgccgaccccagggccgagtgatcggggcgtctcaagtcctcttgaacttccgggctgcctttgaattggtttccataaaaaggccaacatggggccgtcttgaaagtcccggaccttcgggtttgggaggaacacagagctgaaacccaaggccggccggtttttccggtcccgtttaaaaaaatccccccgaaataaagggcaaatgccccgaaatttttgaaaaaaaaaaaaaaaaaaaaaaccttctcttccccc

SEQ ID NO: 44789 - protein, 156 aa, Zea mays
  misc_feature: Ceres CLONE 1447534-F
MRAMSSAVNGMLRARLRGAARVRGGGGEGAGRWTTPGHEERPKGYLFNRPPPPPGESRKWEDWELPCYVTSFPHVVILGVGLNAKADLYIETWAHQKALERLQQQELAACRPQGRVIGASQVLLNFRAAFELVSIKRPTWGRLESPGPSGLGGTQS

SEQ ID NO: 44790 - DNA, 720 bp, Zea mays
  misc_feature: Ceres CLONE 1447540-F
  misc_feature: Encodes the peptide sequence at SEQ ID NO. 44791
  misc_feature (720)..(720): n is a, c, t, g, unknown, or other
caaagctggagctccccgcggtggcggccgctctagaactagtggatcccccgggctgcaggaattcgcacgagaccattacctagaacatcctaatcgaaaagtaaccctaaccccacacccactcataaaccctccgcctcctcgcctccctcccttccatccaatcctcggaacgagcgcgcgggcgaggaggacccccgacggaggatggcggcggcggctagggttttacgcgggtccctcttcctgatgtccccggcggcgggcgccaaggcgtcggcagccaagaaggcgggcgcggcggcggcggcggcggcggtggccaagaagaccgaggcggccactacgaagccgagactgccgaccgggatcacgaagccgatgccggtctccgatgagttccgcaggcccccccgcggcgcgcccgaggtcgcacgctccgaggccatcaagctcatctgggcccacatcaaggcccacggcctccagaacccagccaagaaaacggagatcaactgcgacgccacgctcaaaagcttgtttggcgggagggacaaggttgggatgctggagatcaacaggctactgaacgctcccttcccgaagaagtagcaagcagcaggccgggggtggcagtgatccccgctttggtaaaaggactttcttggggctggacctcttttgggggtccatgttaaagtcccaagtctccccacn

SEQ ID NO: 44791 - protein, 134 aa, Zea mays
  misc_feature: Ceres CLONE 1447540-F
  misc_feature (55)..(132): Pfam Name: SWIB Pfam Description: SWIB/MDM2 domain
MAAAARVLRGSLFLMSPAAGAKASAAKKAGAAAAAAAVAKKTEAATTKPRLPTGITKPMPVSDEFRRPPRGAPEVARSEAIKLIWAHIKAHGLQNPAKKTEINCDATLKSLFGGRDKVGMLEINRLLNAPFPKK

SEQ ID NO: 44792 - DNA, 728 bp, Zea mays
  misc_feature: Ceres CLONE 1447545-F
  misc_feature: Encodes the peptide sequence at SEQ ID NO. 44793
cagagctggagctccccgcggtggcggccgctctagaactagtggatcccccgggctgcaggaattcccacgagaccattacctgagaacatcctaatcgaaaaacgacactagctagctcgttcgtccaaacgtccaccagcgagaaggcagcagccgccagcaaccagttcgtcactgcctaaacctaacctaatccattagcagttcggcactgtgggtctacggcggccggcggcagcagtactacggagcccccagccagccccaggttgcggcagcggcagcaggtggccaggttgcggcagcggcgccctgggacctggtcggccgaccctgctcgagtgctcggcgtcacagcttctcctttctacgtgcagcggttcacaggttcaggcattcagcgccacgccgccgtcgcccccaagccagcgctcagggtgccttggaagtacgctagcttgttgtcatgaagaagtcattcaagttccttccactgaagttggtgcataaggctgcaacaccatctagtggagggtgttctggacaaagaaagcttgtaccttaaaataggaggatacaagaagctggagtggttgtctgaaggcttttgaactgcttgaagcattagtgtagctttggtgcttttgtgactgatcaactctggagcagctagagtgatatagttgtgggcttttgacaatagttggagtgatatgaaacattag

SEQ ID NO: 44793 - protein, 32 aa, Zea mays
  misc_feature: Ceres CLONE 1447545-F
MKKSFKFLPLKLVHKAATPSSGGCSGQRKLVP

SEQ ID NO: 44794 - DNA, 643 bp, Zea mays
  misc_feature: Ceres CLONE 1447559-F
  misc_feature: Encodes the peptide sequence at SEQ ID NO. 44795
  misc_feature (387)..(387): n is a, c, t, g, unknown, or other
cggccgctctagaactagtggatcccccgggctgcaggaattcgcacgagaccattacctagaacatcctaatcgaaaaatcgcatcgtcttctagggtttcctcctcccgccgccacttgccgccccacgagcccattcccctcagcccttcaccatctccggcggccgcagtggcatcagcagctccggctcacgcgcagtgaaggaacgacaatatggcgaccatcgtaaacacgacggaggaggagccgatgctggccgtggtccgcttcaccgctgagctcgcctgggccgacgcgggcccggaggtcgccgaccccgaggtcacccgcctatgtctcgaggcgcaggagcatatcctcgcggggcggtggctcgacatggnctccctcatgctcgcctccgccgacctcctcctcacctccccgtcgcgcgtctcggacaaagacctggagtgcgttctctccgtcatctgcagcctcgtcactaaggtcggatccgaggaccaggggctgcgaatcaccgaactcatctgggctaggttcaccctgggacccggtggacaaaggcagggctggggcgaaaaaagtccttttcagtttgtacaatctggctcccgaagcccggtaggggaggggatc

SEQ ID NO: 44795 - protein, 142 aa, Zea mays
  misc_feature: Ceres CLONE 1447559-F
  misc_feature (57)..(57): Xaa is any aa, unknown, or other
MATIVNTTEEEPMLAVVRFTAELAWADAGPEVADPEVTRLCLEAQEHILAGRWLDMXSLMLASADLLLTSPSRVSDKDLECVLSVICSLVTKVGSEDQGLRITELIWARFTLGPGGQRQGWGEKSPFQFVQSGSRSPVGEGI

SEQ ID NO: 44796 - DNA, 780 bp, Zea mays
  misc_feature: Ceres CLONE 1447574-F
  misc_feature: Encodes the peptide sequence at SEQ ID NO. 44797
  misc_feature (400)..(400): n is a, c, t, g, unknown, or other
  misc_feature (401)..(401): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
ccggtggcggccgctctagaactagtggatcccccgggctgcaggaattcgcacgagaccattacctagaacatcctaatcaaaagaccgtgagaaactcggctacacctgcaaaatggatatggcaatggcttccttcgtcgccgctacgcaccaccacggcagtcacctggccgccggcttcccctactccgcgcgagcaggcaggagcgttggccgcagcggcgtcaccatctccattagagccccgaacaagagaaatagcgactctgggaatattatccgaggtggggacgtgcggaccaccagcaggaagcgagtgtggcgtcctcagagactgaccaaagaagatgaagtgttgccccacaagttggatcccctccctttcttaaaaggatcnnccaacccannnaagggaagaatggtgaagagcatatatccggcataatacatccccccgcagtttttcctccaacaaaaaaaaaatatcccgcttccccatcgcaggtggccttcaagaaagcgacaaaacccactcttcggcgacgaaactagttatttcatcgcggggcccgcaaaaaaacctaactaacccactgttatccccgcggagcccccaagtatatgggatcattgggttttcccccacccttgagacgagtaaccggtttaaccctctttcatgtataagcccccgcccccgtcgttttctcttttgattcaccttcaacactttaagttcgcgcccaccttcccttctacgcagcccccaacggcccg

SEQ ID NO: 44797 - protein, 110 aa, Zea mays
  misc_feature: Ceres CLONE 1447574-F
  misc_feature (96)..(96): Xaa is any aa, unknown, or other
  misc_feature (99)..(99): Xaa is any aa, unknown, or other
MDMAMASFVAATHHHGSHLAAGFPYSARAGRSVGRSGVTISIRAPNKRNSDSGNIIRGGDVRTTSRKRVWRPQRLTKEDEVLPHKLDPLPFLKGSXNPXKGRMVKSIYPA

SEQ ID NO: 44798 - DNA, 771 bp, Zea mays
  misc_feature: Ceres CLONE 1447577-F
  misc_feature: Encodes the peptide sequence at SEQ ID NO. 44799
  misc_feature (771)..(771): n is a, c, t, g, unknown, or other
ggggaaaaccccaccccccttatccccccctacaataaaaaattaagcggaacccaaaaaactggagctccccgcggtggcggccgctctatactagtggatcccccgggctgcaggatttcgcacgagaccattacctagaacatcctaatcgaaaacacgcgagtctccccatcttcttttcctcgcttgccctaattccgcatccccggctgagggagcagcggcggcgccggcagcggcaccggctcaccagcgataccaggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgaaggcctgaggaactacgtgtccctttcgaacggatcggccctgttcgggatgtttacctgccaagagattatcacactggggagccaagaagatttgggttcttggagatcgttgatgcttaggacgcttctgatgcacaggaccacatgaaatgtccagaagttttgctggggcgggaaataacctgttggtactttgctagcgggataacccggaaataagccccgcagggacatggcggtagaacgaaaactgggatccaaagtagggtcaattttctggggtcaatggataggggtctgttccactccccaaagatcgctatccaaggggctgcaccatgaaacggaggn

SEQ ID NO: 44799 - protein, 48 aa, Zea mays
  misc_feature: Ceres CLONE 1447577-F
MGRYSPAYSPPRRGHGGRGRSPPPRRGYGGGRGDHGSVSLLVRNIPLR

SEQ ID NO: 44800 - DNA, 653 bp, Zea mays
  misc_feature: Ceres CLONE 1447588-F
ctggagctccccgcggtggcggccgctctagaactagtggatcccccgggctgcaggaattcgcacgagaccattacctagaacatcctaatcgaaaaccaactacaaaagcgaacccaatccctcttgactcctctcatccgcctcgtctaaccaccaccacgagggagagttaaagtcgccagtacagaagagtgaaggggagagggttgctgggtccgattcggtgggctcatcgccgtcgggtccacgaattggtgcctaggagtctcgcgtgcttcggggacataatcgatggtctcgctgcggtgggttggtggctggagacctcagaattcgtcgtcatagtgcgagctcctccgcgtgtgcaccgtgcgccgtggccaggggtgtctgcgctgcaattgccaggcatacaagatgacgatggtatgaagactatctcatttccaaaaagctttgtgcagagcaactagtgcaatgcaagtgtttggtgcttttggttgatagaagctgctggatgcttttggtatttttgaaagatgcaagtcgtgcttctggttgatacttagaagttggtggttcaaaactgaaaaacctgtcaggctgtcacttgcttttggtttcttgtcaaactgctgggcgcctgaacc

SEQ ID NO: 44801 - DNA, 652 bp, Zea mays
  misc_feature: Ceres CLONE 1447591-F
  misc_feature: Encodes the peptide sequence at SEQ ID NO. 44802
ctggagctccccgcggtggcggccgctctagaactagtggatcccccgggctgcaggaattcgcacgagaccattacctagaacatcctaatcgaaaagaaagtttcgaacaaaagtccacaaatccccttcgccgtctccggcgagccccgcccctcatcgccgccgcgccaaagagacagtgagaggggggatggatcagtccatcagaaccgcatgcgagttcctctcgtcggtgctaaaccacgctgagtcctcgtcccgcgagctcgccgacgccgtctcccaacgccccgtccacctcgagatggcgaggacctcgttcctgcagaagctggagcacagggtggaggcgtcggccgccgacttgcagcacatcgagtccatcgccctcgacaccgtctccttcgaggagctcctcggccactgcggcgaggcgctcaaagtctacgcgcgccacgccgacgccctccagtcgcacctcgcttccttttggctacaagccccccggacgcacacacccccgagatccatgtggaatggggaaaatggaaatttccggaaaggttgggggacccttggaaaataaatgcctcagcgggttccggtttcagggcccagggccggggaaaaccggcggttttaaaagccc

SEQ ID NO: 44802 - protein, 131 aa, Zea mays
  misc_feature: Ceres CLONE 1447591-F
MDQSIRTACEFLSSVLNHAESSSRELADAVSQRPVHLEMARTSFLQKLEHRVEASAADLQHIESIALDTVSFEELLGHCGEALKVYARHADALQSHLASFWLQAPRTHTPPRSMWNGENGNFRKGWGTLGK

SEQ ID NO: 44803 - DNA, 665 bp, Zea mays
  misc_feature: Ceres CLONE 1447594-F
  misc_feature: Encodes the peptide sequence at SEQ ID NO. 44804
acccgcggtggcggccgctctagaactagtggatcccccgggctgcaggaattcgcacgagaccattacctagaacatcctaatcgaaaaattactcggcagacggcagcgcacacattcacttggccttggcttttgcctttgtgctgtgacttgcaaggaacgtcggcgagagggccgggcaggcaggcaggcgcacagcacagactcctccatcctcgcccaccggccggccggcgctcccgatggcgtccaggtgcttcttccccagggacgctgcggccgccgaccacccgcagtccaaggcggcggcggcccaggccctcgagcggctgcaccacggcgggcgcctcctgtccagggaggacgtcgggggcgcggtgcgcgtcaagatcgtcgtcagcaagcgcgagctcaagcagatggtcgcggcgctcggcgacggcggtctggtggccgcggccagcagcgagcgccaccggcagcgcgcggcggcagcggcagggccgggcgccgagcagaggctgcagtcgctgcggcggcgcagcgtgcggcgggcggccgaggctgccgcgcggcggatgcaggcgggcggggagtgggagcccggcctgcagagcatccccgaggaggtttgctgatgactaccagaccagtagatgatg

SEQ ID NO: 44804 - protein, 131 aa, Zea mays
  misc_feature: Ceres CLONE 1447594-F
MASRCFFPRDAAAADHPQSKAAAAQALERLHHGGRLLSREDVGGAVRVKIVVSKRELKQMVAALGDGGLVAAASSERHRQRAAAAAGPGAEQRLQSLRRRSVRRAAEAAARRMQAGGEWEPGLQSIPEEVC

SEQ ID NO: 44805 - DNA, 922 bp, Zea mays
  misc_feature: Ceres CLONE 1447595-F
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (36)..(36): n is a, c, t, g, unknown, or other
  misc_feature (38)..(38): n is a, c, t, g, unknown, or other
  misc_feature (43)..(43): n is a, c, t, g, unknown, or other
  misc_feature (343)..(343): n is a, c, t, g, unknown, or other
  misc_feature (400)..(400): n is a, c, t, g, unknown, or other
  misc_feature (453)..(453): n is a, c, t, g, unknown, or other
  misc_feature (906)..(906): n is a, c, t, g, unknown, or other
ttttttttttttgccctcttnnntttctcccttccngnggggngggtggggaaactttatagaagtggaactccccgcggtggcggccgctctagaactagtggatcccccgggctgcaggaattcgcacgagaccattacctagaacatcctaatcgaaaacgtcccccgtgctgtttttgttgaccttgagaccactgtcatcgatgaggtgaggactggcacctatcgccagctcttccatcctgagcagctcatctgtggctaggaggatgcagccaacaactttcgctcgtggtcactacaccattggggaagacatcggtgacctgtgcctttgacngatcaggaagcttgcaaataattgcactgggtttccagggggtttctggtttttcanccctgttgggggcgagaaaggggggctgggggcttgggtttgttttttttttnaaaagacttggttgggttgggttttgggggggggagcgcccccccccgcgggttttgcacccgaggtagcctagaatcaggagtgaggggtaggtgccacccccccccgccgccctctatgaggctatggaaaacgaggggtggtccgtggtggagaaacaagctttctctgtcgcttggtagggtgagcattcccccattaggtgcgaaacactccccgctccggcccaagaataagtggggctcttcccaaagtgagaaaaagagggggggggcctactttcgcaccaataagtcatttgtggtgtgcccccgccccgaagacactggccagccgtgtactaatggaggggtgtggttcccgcaaccacacttcctttcttttacgtcggaagaaggagggttttatctcacaaaggaagaaaatgtgtggtgcgccccgaaaggccccancggtgacatagcagag

SEQ ID NO: 44806 - DNA, 656 bp, Zea mays
  misc_feature: Ceres CLONE 1447596-F
  misc_feature: Encodes the peptide sequence at SEQ ID NO. 44807
  misc_feature (601)..(601): n is a, c, t, g, unknown, or other
ctggagctccccgcggtggcggccgctctagaactagtggatcccccgggctgcaggaattcgcacgagaccattacctagaacatcctaatcgaaaaaccaatccccatcgccccagaccacagcgcgacagtgagtacagcagcagcagctgagagcgtgagagcgtgcgaagcaggagggaggacaagaagaagccgatggcggttgtgagcggcagcggcggcaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctccccgacgacttcttctcgcctccggccccgcgctacgagagcgagcgggaggacgccgcgggcaggagggcgggccgagggcttgaggtggcggcgtggggcatcgacaggtggtggagggcgcacggtgggccgcccgagacccccangtacccggaaaaggccccccggagggtggccgcccccccccggggtgagcccccg

SEQ ID NO: 44807 - protein, 152 aa, Zea mays
  misc_feature: Ceres CLONE 1447596-F
  misc_feature (134)..(134): Xaa is any aa, unknown, or other
MAVVSGSGGRLNPWAEPFVPSGARYRGLRTVEATPEQEVEDFSPEWWRLVSASPAFRDRWLREYGALGLLDAEDDLDDDVDSFLPDDFFSPPAPRYESEREDAAGRRAGRGLEVAAWGIDRWWRAHGGPPETPXYPEKAPRRVAAPPRGEPP

SEQ ID NO: 44808 - DNA, 655 bp, Zea mays
  misc_feature: Ceres CLONE 1447597-F
  misc_feature: Encodes the peptide sequence at SEQ ID NO. 44809
  misc_feature (520)..(520): n is a, c, t, g, unknown, or other
ctggagctccccgcggtggcggccgctctagaactagtggatcccccgggctgcaggaattcgcacgagaccattacctagaacatcctaatcgaaaatcagcgatcacttactatgaagaaagtgccgagcttctgtcgaaattgcccaaaaaggatcttgagttggtccatacgctctcagtttctcttaacaaagttggagaccttcgctactatggcggggacctgcaatctgcaagaagttattatgcccgttcattagatgttcgcagaaattcagtaaaggaacattcagctgtggcctcccaggtcattgatctagcaacctctctagccaaagtcgcggatgtcgatagaaacctcggtaacgaagatgcggctgttgagggttttgaggaagcaatcaagtgccttgagaagttgaagctagattctgagcaggctagtctagaacaacggcgtcgctcggttctcgacttcctgcagaagcaattgcacgacaagtaagacagatggtnccctagtgtgtagtacccataacgcccgttgttgtgttgcaatatggaaggagttgttgtggtgcataagggagggaagggaggtgctctagtaaacgtgcccctgtgtgtaattccaaccacttgaattctgtc

SEQ ID NO: 44809 - protein, 168 aa, Zea mays
  misc_feature: Ceres CLONE 1447597-F
GAPRGGGRSRTSGSPGLQEFARDHYLEHPNRKSAITYYEESAELLSKLPKKDLELVHTLSVSLNKVGDLRYYGGDLQSARSYYARSLDVRRNSVKEHSAVASQVIDLATSLAKVADVDRNLGNEDAAVEGFEEAIKCLEKLKLDSEQASLEQRRRSVLDFLQKQLHDK

SEQ ID NO: 44810 - DNA, 651 bp, Zea mays
  misc_feature: Ceres CLONE 1447600-F
  misc_feature: Encodes the peptide sequence at SEQ ID NO. 44811
  misc_feature (651)..(651): n is a, c, t, g, unknown, or other
ctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaagaagattgttgacctgtgccttgaccgcatcaggaagcttgcagataattgcactggtctccagggcttcctcgtcttcaacgctgttggtggaggaan

SEQ ID NO: 44811 - protein, 144 aa, Zea mays
  misc_feature: Ceres CLONE 1447600-F
  misc_feature (49)..(144): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKKIVDLCLDRIRKLADNCTGLQGFLVFNAVGGG

SEQ ID NO: 44812 - DNA, 660 bp, Zea mays
  misc_feature: Ceres CLONE 1447601-F
  misc_feature: Encodes the peptide sequence at SEQ ID NO. 44813
  misc_feature (454)..(454): n is a, c, t, g, unknown, or other
  misc_feature (514)..(514): n is a, c, t, g, unknown, or other
  misc_feature (520)..(520): n is a, c, t, g, unknown, or other
  misc_feature (534)..(534): n is a, c, t, g, unknown, or other
  misc_feature (537)..(537): n is a, c, t, g, unknown, or other
  misc_feature (538)..(538): n is a, c, t, g, unknown, or other
tggagctccccgcggtggcggccgctctagaactagtggatcccccgggctgcaggaattcgcacgagaccattacctagaacatcctaatcgaaaaactcgcatcagagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggcagagaaggacccaaacaagcccaagaggcctccgagcgcgttcttcgtcttcatggaggagttcaggaaggactacaaggagaagcaccccaatgtgaagcaagtctccgtgattggcaaggctggtggtgacaagtggaagtccctgtctgatgccgagaaggctccctacgtgtctaaggcagagaagctcaaggctgagtacaccnagaagatcgacgctttacacaacagcagtctggagaccccacgcgtctggtgatccgacnagtccnagtccgaagtgacnacnnagacaagagggtgaccagtgatgttgacggatgaaactctgtccagggttggcagtcaggaaaaaaccttctggtttgcgggctaacgggttcctcaaagatttccaaagccaaaattagcc

SEQ ID NO: 44813 - protein, 107 aa, Zea mays
  misc_feature: Ceres CLONE 1447601-F
  misc_feature (28)..(97): Pfam Name: HMG_box Pfam Description: HMG (high mobility group) box
  misc_feature (91)..(91): Xaa is any aa, unknown, or other
MKSRARSTAGDSRLSVRKTKAEKDPNKPKRPPSAFFVFMEEFRKDYKEKHPNVKQVSVIGKAGGDKWKSLSDAEKAPYVSKAEKLKAEYTXKIDALHNSSLETPRVW

SEQ ID NO: 44814 - DNA, 759 bp, Zea mays
  misc_feature: Ceres CLONE 1447627-F
  misc_feature: Translation starting site: 192
  misc_feature: Pfam Name: DUF632 Pfam Description: Protein of unknown function (DUF632)
  misc_feature (12)..(12): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
gggccccccgcnccccgcgccgagttcactagagggtnttnnnnnnnttnnnnnnntaaaactgggactccccgcggtggcggccgctctagaactagtggatcccccgggctgcaggaattcgcacgagaccattacctagaacatcctaatcgaaaaaaaagtagtcatgatggcagtagttagagaccatgctccatgccatacaggccagggagaaactgcagatacgacacgacaagaagctcgccgcgctgcgggaccaggagtacagccggaaggtcgacgtggacatccagaagctcaaggcggcgtgggacagggcgcgcgcgcagctcgaggcagcctcccagtccgcggacgcggcctcggactccatcgcccagatccgcgacacccgtctggtgagtcagctcctggagctctgccacggccacgctcgacatgtggcgggcgatgcgtgagaaccaccccccccagagcctgttcgcgcaacagctgcgcgggctgagcagccgcccgtccatggaccccacgaccaaaatccccccaacaaggtcacgcggggcgctccaaggccgccatgggcggcctgggcccgcggacattgtgacacatgggcgaaaaagccgagtgcggattacgttccacacccgtccctcggggtggatgtatgcctcacgtctgaacgctggaaggcctggatgcacccccccacggatgggcccctcccccccgggcccgctagaaacctcaccc

SEQ ID NO: 44815 - DNA, 763 bp, Zea mays
  misc_feature: Ceres CLONE 1447639-F
  misc_feature: Encodes the peptide sequence at SEQ ID NO. 44816
  misc_feature (268)..(268): n is a, c, t, g, unknown, or other
aaagctggactccccgcggtggcggccgctctagaactagtggatcccccgggctgcaggaattcgcacgagaccattacctagaacatcctaatcggaaaacacccacacatccgacgccgaggaagtaggaagcacgagcagcatatgtcacagagggccagcgtcccacactcctcctgcatagccttcgcgctccattcccatctcctggtctccagtgagatgtgccccagctcctattggcagcaatagctattctccgccntccttttttttttcttccctctcctttcctcccgtctgggattcgtttccgtttgatcgagctggctctcagcttccggttttagtttttgtggcatcttggctcttcggatcggtccttcttaactctgaaaccccaaaggaaaaaaaaaccgggcaaccaacccatggggttcaaggaattcctcagggggggattccccccattgggggcgggttcccccccccccgggggacccttaaaagcccccaaaccttcgggggaggcggggggcccccttgggcccccaacggggggttcgcccgggttttttttttaacggggggggaccccttttttccccccacaaacaaaaaattcgccccccccaaaaaaacgcggcgttggtgttcggggaaaaaatttggggggggggggggcccccccccttttggggggggccccccccggggggggaaaacctcccccccccggggggggggggggccccacccc

SEQ ID NO: 44816 - protein, 35 aa, Zea mays
  misc_feature: Ceres CLONE 1447639-F
MSQRASVPHSSCIAFALHSHLLVSSEMCPSSYWQQ

SEQ ID NO: 44817 - DNA, 670 bp, Zea mays
  misc_feature: Ceres CLONE 1447640-F
  misc_feature: Encodes the peptide sequence at SEQ ID NO. 44818
  misc_feature (481)..(481): n is a, c, t, g, unknown, or other
  misc_feature (534)..(534): n is a, c, t, g, unknown, or other
aaagctggagctccccgcggtggcggccgctctagaactagtggatcccccgggctgcaggaattcgcacgagaccattacctagaacatcctaatcgaaaagcacctccctttccccaactcgatctcgcacctagggtttcgtctcgtcgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcanggcctacggggagcttcctgacacgctcaggctcaacgagggcgtcgacgtcnatgggcccgaagaaaggcgaagagggcagcgactacatccagttcgaggaccaagacttcgccagatcctaaaatcctgttcctgcttaccgctacctgtatttgttaccggacggggtcttcggcttctgctggg

SEQ ID NO: 44818 - protein, 166 aa, Zea mays
  misc_feature: Ceres CLONE 1447640-F
  misc_feature (30)..(94): Pfam Name: eIF-1a Pfam Description: Translation initiation factor 1A / IF-1
  misc_feature (104)..(104): Xaa is any aa, unknown, or other
  misc_feature (122)..(122): Xaa is any aa, unknown, or other
MPKNKGKGGKNRKRGKNEADDDKRELVFKEDGQEYAQVTRMLGNGRCEAICVDGTRRLCHIRGKMHKKVWIAAGDIVLVGLRDYQDDKADVILKYMNDEARLLXAYGELPDTLRLNEGVDVXGPEERRRGQRLHPVRGPRLRQILKSCSCLPLPVFVTGRGLRLLL

SEQ ID NO: 44819 - DNA, 731 bp, Zea mays
  misc_feature: Ceres CLONE 1447642-F
  misc_feature: Encodes the peptide sequence at SEQ ID NO. 44820
ggagctccccgcggtggcggccgctctagaactagtggatcccccgggctgcaggaattcgcacgagaccattacctagaacatcctaatcgaaaaagaagttgttcagcaagctatcaactgaccctacaacaacaaacatgttggtctctaagcagccagcctctttcactggttctgaggttcgaatcattgatgatgacatgcccctcgcttaatttgctgttgctttcaatggagcatcatgggtggatcctgattctgttgcactgatggttatgcaaacaatgcttggttcatggaacaagagtgctggtggaggaaagcacatgggttcagagcttgtgcagagggcagcaatcaatgacatcgctgagagtgtaatgggattcaatacgaattacaacgacactgggtcttttttgtgtctatgctgttgctaaggttgattgcctggatgatttggcttttgcaataatccctgaaatgagcaaattgtcctaccgggttaccggaaaaagatgttttcccgggcccgaaatcccttaaaacccctaacccaccccccccttgagggtccaccccccctttttaaagaaattgggcccccccctccccccctctggaaaaaaaatcctcccctccacttttttccaaaaaaaaagcctttaaaaacccccccttaaaccgtttttaaaacccctctccttttaaaaaagagggtcttttcg

SEQ ID NO: 44820 - protein, 56 aa, Zea mays
  misc_feature: Ceres CLONE 1447642-F
  misc_feature: SWISSPROT Homolog: EC 3.4.24.64 Mitochondrial processing peptidase
MVMQTMLGSWNKSAGGGKHMGSELVQRAAINDIAESVMGFNTNYNDTGSFLCLCCC

SEQ ID NO: 44821 - DNA, 716 bp, Zea mays
  misc_feature: Ceres CLONE 1447646-F
  misc_feature: Encodes the peptide sequence at SEQ ID NO. 44822
  misc_feature (85)..(85): n is a, c, t, g, unknown, or other
aaggctcttctgtttctgattccaaattacagcgatcatcgtttatcatcacccctaccccccttcaattattttgataataaanaaaaaatggagctccccgcggtggcggccgctcttccctaaaggatcccccgggctgcaggatttcccacgagaccattacctaaaacatcctaatcgaaaaagtcgcgctgcttccacaagtccacaaccgtaccagcaccaccgcgccatggcgtcctccgccgatcccgatgccgccacgccaccatccgcgccgcagccggagcccgcacggaaggcagtccgcgtggtggtgaaggggagcgtcacgggggtggggttccgcgactggacggcgtccacggccgagtcgctcggtctcgccggctgggtccgcaaccgccatgacggcagtgtggaggccctcctctccggagaccccgcgaagatcgaagacatgataacccgccgcctccccgtcggccctgcaaccgccaccgtcaccgccgtcgtcccgtccacggacgagcccgtggatccgtccaccgggttcgagatcaagttcaccgtctgatccccccgtcccgcgacaggttcgcgtctcgccgcgcgtccttggacggtctattcatggactactactgcgaatctgcgattaaagaacagaggcgacatctaatgtaccgtactctatttacctgaaaagctcc

SEQ ID NO: 44822 - protein, 114 aa, Zea mays
  misc_feature: Ceres CLONE 1447646-F
  misc_feature (23)..(111): Pfam Name: Acylphosphatase Pfam Description: Acylphosphatase
  misc_feature: SWISSPROT Homolog: EC 3.6.1.7 Acylphosphatase
MASSADPDAATPPSAPQPEPARKAVRVVVKGSVTGVGFRDWTASTAESLGLAGWVRNRHDGSVEALLSGDPAKIEDMITRRLPVGPATATVTAVVPSTDEPVDPSTGFEIKFTV

SEQ ID NO: 44823 - DNA, 652 bp, Zea mays
  misc_feature: Ceres CLONE 1447647-F
agctccccgcggtggcggccgctctagaactagtggatcccccgggctgcaggaattcgcacgagaccattacctagaacatcctaatcgaaaaatatagctatcgttcagctcctggtggtgctacgggggtgactgcgggggcgactgcggctggtggctgttgtcctcatcgaccatctcggcgacgtcctactcgagcgagatctcgctgcagtccctcgagatctggaggagattgacaaggagattgaggacaagaagacagagctggagcccaaggtcgtggaggcctacgaagcatctcctcctgaggtcaaggctctgttcaaggataagaagccagtcaaggtcatcaagaagaactcggctgcagtcaccaagttcctcgatgagctggctaagattggccgcacttgaagaaatcttatatcagtttgaggaaaaactccaagctgaaaaagtggaagctgctaggaagcaggaagagttgcaatctgtttgatgccttttctagaacatatctgtggttagaactttgtcagaactacgtgcaatctgtttcaatgcttcaaacctttgtggtggaacctttgtatgtttgaacctctgttgtggaagaactagtgtgctggaattgtgtaaaaaaaaa

SEQ ID NO: 44824 - DNA, 725 bp, Zea mays
  misc_feature: Ceres CLONE 1447659-F
  misc_feature: Encodes the peptide sequence at SEQ ID NO. 44825
ctggagctccccgcggtggcggccgctctagaactagtggatcccccgggctgcaggaattcgcacgagaccattacctagaacatcctaatcgaaaatccaccgtcgttcttgccacacacctgaccgaccttgcctcctctccctcctatgccaccaaaatgcctagccccaatcaccactactgccgcttcctcccggtctgctgcctaagcctctcgtctgccagcgatccgtcgtcgtccccgccggctgccgcagactccacggggtgcctctactggacgacctgctggaagaagaggaagcggttaaagcctcgtcccggctgcgagcgctgctgccgtgcggctgctatgtgacggcgctatccttaccgagctttcatgcatgtaccacgccctctttccctctcgcagtctttgtttcatcactcagcagaattcacgatgtatgtcttcttgaccttgcaagacttttcgctagaggatgaatcccaactccttgggcctttccatctcgaactaataaatcctcccatcttcttcgttcccgttaaacccttttggactttgacccttttgagtttaagctaggtaggtaggtcccctaatttcccggggacctccctcttggaaaaaagtgtcccccccccgggttcccggtaatttttttccggcgcggattttttttcccaaaatttttaaagcccttttttttgtgga

SEQ ID NO: 44825 - protein, 66 aa, Zea mays
  misc_feature: Ceres CLONE 1447659-F
MPSPNHHYCRFLPVCCLSLSSASDPSSSPPAAADSTGCLYWTTCWKKRKRLKPRPGCERCCRAAAM

SEQ ID NO: 44826 - DNA, 644 bp, Zea mays
  misc_feature: Ceres CLONE 1447665-F
  misc_feature: Encodes the peptide sequence at SEQ ID NO. 44827
ctggagctccccgcggtggcggccgctctagaactagtggatcccccgggctgcaggaattcgcacgagaccattacctagaacatcctaatcgaaaaaccaaaagaaaaaccagactggtttcccgagcgcaggccgcaaccgcaaccactcctcccggccggcacaaaaccaaccgagcaccgcgcgcgcacagacacacactcaccagcaggcagcagctagctagctctctagcaacgagcacaaaacgagcaatgccgctagttccgtcccactccctcgcttcccatcccgcaccccatggaagggagcagcactagctagcgtgggacagggcggggtggtgtcgtggtgatggaagcgggcggcggcgcctcggaactcggcctgctcggcgccggatctggcaggctgctcaagcacgggcggggcgacgcggcggggggagaggaccacgggtgggtcgtcgtcgtcggcggcggcggcagggccaagcaggccaggaccgcgtccgtcggcaccggggacgcggcggccacggcggccgtgccgttcctgctgggctcctgcggcgggccccgccacggcggggaacggatgctcagcttctcgtccgccgccgccgccgccccggatgatgg

SEQ ID NO: 44827 - protein, 95 aa, Zea mays
  misc_feature: Ceres CLONE 1447665-F
MEAGGGASELGLLGAGSGRLLKHGRGDAAGGEDHGWVVVVGGGGRAKQARTASVGTGDAAATAAVPFLLGSCGGPRHGGERMLSFSSAAAAAPDD

SEQ ID NO: 44828 - DNA, 716 bp, Zea mays
  misc_feature: Ceres CLONE 1447666-F
  misc_feature: Encodes the peptide sequence at SEQ ID NO. 44829
  misc_feature (392)..(392): n is a, c, t, g, unknown, or other
  misc_feature (434)..(434): n is a, c, t, g, unknown, or other
  misc_feature (461)..(461): n is a, c, t, g, unknown, or other
  misc_feature (463)..(463): n is a, c, t, g, unknown, or other
aagctggagctccccgcggtggcggccgctctagaactagtggatcccccgggctgcaggaattcgcacgagaccattacctagaacatcctaatcgaaaacataagattcactttgtccctggtgacatagtgaagggcctcacaacattggggtggcgatggctacaacacatggattagtcgtgccaaacatcaagaaagtgcagtcgctatcaatattggagatcacgaaggaattggcgcgattgcatgagatggcatcacaaaacaggctaagcgctgcagatattgaaggtggcactataacacttagtaacataggtgccattggtggcaagtttggctctccacttctgaacctacctgaaagtgccatcattgcccttgggncgattcaaaagcttccctcgctcgatgatgacgaaaacgttnacccttcatccaaatcaaatgtactgntngagccgatcacccgagtgtgacggggccaccggtgcaaaattctgaaatgatggaaaaacctcctgaaaaaacagagctgcctctgttgcaattgcaatgacccagtaatgacccgtaactcctacgacctgaaaccggagcttttgggctaaaaaaaaactcccgtgtttcaaaaaaaaaccaactgggcttttttcctggaaacgggaaaaaaattgggagttttttccgacccctcaaaaaaaaaaaaaa

SEQ ID NO: 44829 - protein, 107 aa, Zea mays
  misc_feature: Ceres CLONE 1447666-F
  misc_feature (1)..(108): Pfam Name: 2-oxoacid_dh Pfam Description: 2-oxoacid dehydrogenases acyltransferase (catalytic domain)
  misc_feature: SWISSPROT Homolog: EC 2.3.1.168 Dihydrolipoyllysine-residue (2-methylpropanoyl)transferase
  misc_feature (78)..(78): Xaa is any aa, unknown, or other
  misc_feature (92)..(92): Xaa is any aa, unknown, or other
  misc_feature (101)..(101): Xaa is any aa, unknown, or other
MATTHGLVVPNIKKVQSLSILEITKELARLHEMASQNRLSAADIEGGTITLSNIGAIGGKFGSPLLNLPESAIIALGXIQKLPSLDDDENVXPSSKSNVLXEPITRV

SEQ ID NO: 44830 - DNA, 655 bp, Zea mays
  misc_feature: Ceres CLONE 1447673-F
  misc_feature: Encodes the peptide sequence at SEQ ID NO. 44831
  misc_feature (339)..(339): n is a, c, t, g, unknown, or other
  misc_feature (344)..(344): n is a, c, t, g, unknown, or other
  misc_feature (346)..(346): n is a, c, t, g, unknown, or other
  misc_feature (370)..(370): n is a, c, t, g, unknown, or other
tggcggccgctctagatctacgtggatcccccgggctgcaggaattcgcacgagaccattacctagaacatcctaatcgaaaaaacaggcgaccagcccgcgaagacgtggcaccaggataggtgctcctgtcctgagcttcaaatccgcaccccgcggccaagctgttacttgcgctgcggccttagcatgaggtggccgctggcgatctcgactcgacgccgccccctcctccttttcatccttctcgtcgtcctctacacgattcctgggacattttcttcgaggcaagtcccactcgatagtgttgagatattttctactcatgaatggtttggnaaacntncagtcgttttcgggtgtaacgganaaaataaaacatatttgccacatgtgcggcaccgcccacacgctgtatacctttaagggtgaggaatcttcgccagcccttaacagagcttccagaaaataaacgcagccgatgtggtttgtatgaagaggacccaattacccctgatgatgtctttgatgaatgggatatgtgttccaagtgatttcaagggtgggaaaatacccccggtttaaggaaggccagttcaatgccactttcgtatgtcccaactgcactggctccacttggacatggaaaccgtga

SEQ ID NO: 44831 - protein, 48 aa, Zea mays
  misc_feature: Ceres CLONE 1447673-F
  misc_feature (5)..(5): Xaa is any aa, unknown, or other
  misc_feature (7)..(7): Xaa is any aa, unknown, or other
  misc_feature (15)..(15): Xaa is any aa, unknown, or other
MNGLXNXQSFSGVTXKIKHICHMCGTAHTLYTFKGEESSPALNRASRK

SEQ ID NO: 44832 - DNA, 676 bp, Zea mays
  misc_feature: Ceres CLONE 1447674-F
  misc_feature: Encodes the peptide sequence at SEQ ID NO. 44833
ctggagctccccgcggtggcggccgctctagaactagtggatcccccgggctgcaggaattcgcacgagaccattacctagaacatcctaatcgaaaatattgctgggacatgccacagtgctaagatgaacagaactatcattgttcgcaggaactacctccactttgtaaagaaataccagaggtatgagaagaggcactccaacattcctgctcacatctccccatgcttccgtgtgaaggaaggtgaccatgtcatcattggccagtgcaggcccctgtcaaaaactgtgaggttcaatgtcgttaaagtcattccagctggatccgcagctgctggaaagaaggccttcacagcagcctgagtttatagactatgttccatgagtagtctatagaatgtctttttaatcaaaagaatctctcttctaggctggtgcttttcgactataatttggagatggtccatgtccgtgccatcatctgaacatgttactactttatgtaacctgtcgtgcaaagtttgctaagatctctattggttcatgtcaaaaaaaaaaaaaaaaaacttatcgataccgtccaccttcagggggggcccggtaccccaatcccccctataggggtcctattaccgccggctcactggcctcggttttacacgccgtgacgtgg

SEQ ID NO: 44833 - protein, 79 aa, Zea mays
  misc_feature: Ceres CLONE 1447674-F
  misc_feature (1)..(63): Pfam Name: Ribosomal_S17 Pfam Description: Ribosomal protein S17
MNRTIIVRRNYLHFVKKYQRYEKRHSNIPAHISPCFRVKEGDHVIIGQCRPLSKTVRFNVVKVIPAGSAAAGKKAFTAA

SEQ ID NO: 44834 - DNA, 698 bp, Zea mays
  misc_feature: Ceres CLONE 1447675-F
  misc_feature: Encodes the peptide sequence at SEQ ID NO. 44835
  misc_feature (614)..(614): n is a, c, t, g, unknown, or other
  misc_feature (698)..(698): n is a, c, t, g, unknown, or other
ctggagctccccgcggtggcggccgctctagaactagtggatcccccgggctgcaggaattcgcacgagaccattacctagaacatcctaatcgaaaaaagacagcagtcccgagctgtagcctgctaccgttcttgtctagtcgtcttccccggcaagccgcggcggtcgttgccccctcgtataatctactcgcggcatccttgtcatcgccgattcgattgggttgatacagaggggagccgcgagggggcggagatgccgacgctgacgaagctgtacagcatggaggaggctgccctccacaacacgcccgacgactgctgggtcatcgtcgacggcaaggtagcgccactgtatcgccccctcatatcctccttgctgtagataggtattatgcatgcagcagtaggtagagattgataaaaacgcgtggggaggggagggccggaggggagagtgagggcatactgttcgagttccgatgcgatttctctcgcaacgtgttcgatggaatgtctggaaggcctttgctgtgatgtgctgcttgctgtgcacgtactcttgccaatactagcggcactctggttgtgaggtttgggagattggtaggncgtggtaaactagttagtagattgggtgtgctgtcctagaaatgagcttcaggttagtagaattggatatgctgcactgatctn

SEQ ID NO: 44835 - protein, 42 aa, Zea mays
  misc_feature: Ceres CLONE 1447675-F
  misc_feature: SWISSPROT Homolog: EC 1.7.1.1 Nitrate reductase (NADH)
MPTLTKLYSMEEAALHNTPDDCWVIVDGKVAPLYRPLISSLL

SEQ ID NO: 44836 - DNA, 647 bp, Zea mays
  misc_feature: Ceres CLONE 1447681-F
  misc_feature: Encodes the peptide sequence at SEQ ID NO. 44837
  misc_feature (372)..(372): n is a, c, t, g, unknown, or other
  misc_feature (411)..(411): n is a, c, t, g, unknown, or other
  misc_feature (434)..(434): n is a, c, t, g, unknown, or other
acccgcggtggcggccgctctagaactagtggatcccccgggctgcaggaattcgcacgagaccattacctagaacatcctaatcgaaaaagttatctcgtgcctgccccgctgttctcctctcccgccgcatccgatagttcagcgcaacaaaacctccctctccgcgcacgctccccacccccaccggtgaccgcgcgcgcatggctgccttacttcggacggccgcggccctcgcgcccccgccctcgtctcccccgtccgcacgggagccgcgtgggcggtgcctgcggctggcctgctcccggcgcgcgccggtccgaccgctccgggcgtggccgctgccgactccgcacgtcttctgtctcgccngggggcggctccggcgcctgggcgccaccgacccccacnaggccgcgcagacggcgacgcangaggatttagaaaccgaaattacttgagactctgctgcagatgacagtgctggaagcacagatgaaactccatctattattgtgacaaccctgcagtcgtacagtgaagctcttattaatgatgatgaagcaaaagctgctgagataaagtcctttttaccttctatcgaggatgagaaaaatcccctttgaacaaaacactgctctaaagcc

SEQ ID NO: 44837 - protein, 85 aa, Zea mays
  misc_feature: Ceres CLONE 1447681-F
  misc_feature (57)..(57): Xaa is any aa, unknown, or other
  misc_feature (70)..(70): Xaa is any aa, unknown, or other
  misc_feature (77)..(77): Xaa is any aa, unknown, or other
MAALLRTAAALAPPPSSPPSAREPRGRCLRLACSRRAPVRPLRAWPLPTPHVFCLAXGRLRRLGATDPHXAAQTATXEDLETEIT

SEQ ID NO: 44838 - DNA, 653 bp, Zea mays
  misc_feature: Ceres CLONE 1447684-F
  misc_feature: Encodes the peptide sequence at SEQ ID NO. 44839
  misc_feature (653)..(653): n is a, c, t, g, unknown, or other
ctccccgcggtggcggccgctctagaactagtggatcccccgggctgcaggaattcgcacgagaccattacctagaacatcctaatcgaaaatagatgtgcaagatctcttcgtggaggtgcaagcattttgcatcgccttctcgcgaataagggaggcagtggggttgttcacgctcctgaaatctctagaatgaagagcgctgcaccatcagttgggcgctggattctcagaacagaaattcccaaggtgtacatccatggctctgccttttgcttccaagctgctgacccctgcataggtctggactctgtagggcgtggattttgctggtatattggttatcatcaagctgcgtaccctgcatcatccccgaaagacattgagcagaaacagatccatacgtctgacaagtggggctcgaggtagacgtagttctgttgggagtgtccccggggcttgtcgtccttgtgcatatgcaacaatggcaagccccgagataggtcggctccaaatgagcgaatggtaccggtgactcagaaaatacctgaatagagtttcggaaggtcaatcctccttgctctacggcttaataaattttttccataaccctcaaaaacggctgctttgaaaaaaaaaacaaaaaaaaactn

SEQ ID NO: 44839 - protein, 78 aa, Zea mays
  misc_feature: Ceres CLONE 1447684-F
MKSAAPSVGRWILRTEIPKVYIHGSAFCFQAADPCIGLDSVGRGFCWYIGYHQAAYPASSPKDIEQKQIHTSDKWGSR

SEQ ID NO: 44840 - DNA, 663 bp, Zea mays
  misc_feature: Ceres CLONE 1447685-F
  misc_feature: Encodes the peptide sequence at SEQ ID NO. 44841
acccgcggtggcggccgctctagaactagtggatcccccgggctgcaggaattcgcacgagaccattacctagaacatcctaatcgaaaaatcaagcatttgtccttctggaagtttccacactcccttctcttcccgtgtacccactccaatggcgccctccctcctcgccgccgtctcagcctcgcccttcctcctacccggcagcagccgcaagccgctgggcgctgcccccacccgacgggtcggacagcgcgtggacgcccttaactacgaccctgccaaggggcacgtggcaccgcataacgactgggtgctcgtccgtcttcagcatatccctgagaaatctgctggtggtgtattgctaccgaaatctgctcgtaagtttgagaggaatctgatgagccaattctatcgactggagctaatcttactgaagttgacgctggggagaaaggtctcttctcagacctcaatggcttacaagtgacccttgatacggatgaaaaaaactgcttcctgccgggaagccaaattttttacctgagcccaaatgaattttacccctgaaatttaaaaatttacctggcccttttccaaaagggatgggacttttattggcccccacctttgtgaaaccgaaaacccggcttccacaaaaac

SEQ ID NO: 44841 - protein, 112 aa, Zea mays
  misc_feature: Ceres CLONE 1447685-F
MAPSLLAAVSASPFLLPGSSRKPLGAAPTRRVGQRVDALNYDPAKGHVAPHNDWVLVRLQHIPEKSAGGVLLPKSARKFERNLMSQFYRLELILLKLTLGRKVSSQTSMAYK

SEQ ID NO: 44842 - DNA, 723 bp, Zea mays
  misc_feature: Ceres CLONE 1447689-F
  misc_feature: Pfam Name: Sdh_cyt Pfam Description: Succinate dehydrogenase cytochrome b subunit
aaagctggagctccccgcggtggcggccgctctagaactagtggatcccccgggctgcaggaattcgcacgagaccattacctagaacatcctaatcgaaaaccgtctctccccacagggaaccgccgcccgtcgcctccagatacgtgcctccggcggaaaatcggtatcgagctcgctttgttcgagtgagtaacgcgcagcgactcctctcccaaccagattttgatggatttcgggcacgcgtggcacagatcttctgtatagccagcaaggaggcctctccatctcctccgggaaggctgtgcagcaatggagaagtataacagcaagactcagttagcacccttgagagataccccatttgctctccgtggtgctcttgggtagttcagctcataccttgagcaagccaggggctacacgtcttcccctctagcagctctgcgaccaaagatgtcttctactactggaaatcgactcctgcactccagtgccccctgtcatctcctgtagcaaaccgcccgttgtcgccccacccttctttgaaaaagccacagtttcaggcggactttcccaactccgcatcgaaaattccggggccccgttgggaattcccacctatttggtccctctcccccccaagtttcacctaaagttttggggcttaaaaacaattttttcccctcaaaaaaaacccttttttcccgtttcggggggggt

SEQ ID NO: 44843 - DNA, 690 bp, Zea mays
  misc_feature: Ceres CLONE 1447692-F
  misc_feature: Encodes the peptide sequence at SEQ ID NO. 44844
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
gggcgggctctccctttcccatcaacagaaaaccacctcatcaacgccatcaccctgaatttccgtgaannnnnttacnnnnntcaaagtggaactccccgcggtggcggccgctctttcctaaaggatcccccgggctgcaggatttcccacgagaccattacctagaacatcctaatcgaaaaacagatcggaggagatagcactgactcgtctcccttctcgtctccagcgacggcgaaggcgaagcggaggagcgggagcacaaacagaagaggcagccatggccgtgatggagaagctcaagatcttcgttgtgaaggagcctgttgtcgcagcttcctgtctcatcgccggattcggtctctttcttccagcaggtgtccggccaagcctggattcatgggagaccgcagaaaaagtgcccccaccacctctaaatgatgtggttgcgggtgccaccggcaagaaaaagtagtgaatgtgcattgatttctcaaggcaaagcggtcccacattttcctccccatgcgtttctggcgtccagatgggaaggctctccaaagacacggactccaaagcgacagcttgattgattttaaacagaatcgacagcgttttgtctctacgcagattgtagatctagcgatttaaccggtccgcttaaatccgaaacgaacaggctatgtt

SEQ ID NO: 44844 - protein, 64 aa, Zea mays
  misc_feature: Ceres CLONE 1447692-F
MAVMEKLKIFVVKEPVVAASCLIAGFGLFLPAGVRPSLDSWETAEKVPPPPLNDVVAGATGKKK

SEQ ID NO: 44845 - DNA, 730 bp, Zea mays
  misc_feature: Ceres CLONE 1447693-F
  misc_feature: Encodes the peptide sequence at SEQ ID NO. 44846
  misc_feature (245)..(245): n is a, c, t, g, unknown, or other
  misc_feature (293)..(293): n is a, c, t, g, unknown, or other
  misc_feature (298)..(298): n is a, c, t, g, unknown, or other
  misc_feature (301)..(301): n is a, c, t, g, unknown, or other
  misc_feature (307)..(307): n is a, c, t, g, unknown, or other
  misc_feature (308)..(308): n is a, c, t, g, unknown, or other
aagctggagctccccgcggtggcggccgctctagaactagtggatcccccgggctgcaggaattcgcacgagaccattacctagaacatcctaatcgaaaagacgacacaaaccccagtttaggaacagttggaaaagagggagaaatggagaacggcggcggcaaaggcgacgttcccaacgatgcgaacgaacattgccctggaacgcagtcggaggaggcggggaaggcggatgcctgcgcntggtgccccaccagcagattgcgccaccgcccccagggccccgatccngatgntgntgctanntgtgagaggtggctactgtgaaccacaattatagttttgtcctgaaagggaggttttgaaagagaaatcctcaacaaccttcctttgcctaactaaaaggccatccgggtggccttcttgacaaaaaaaattgggccctgcccccaaaaaattaggccccgggggacaaattttcccaaaaccccctgggggggccccgtggtttccaccccccctcgggggggggccaggtttttcccccccacccaaaaaacctttttttgggggcccccccaaagaggcggccccccctttttggaggggtgcggggggggaaaaatccttttggggggggccccccccccaaaaagaggaaaactctcttgtgggcccccccccccccggaggggggggggtatttaacccccccgccgggttttttt

SEQ ID NO: 44846 - protein, 60 aa, Zea mays
  misc_feature: Ceres CLONE 1447693-F
  misc_feature (51)..(51): Xaa is any aa, unknown, or other
  misc_feature (52)..(52): Xaa is any aa, unknown, or other
  misc_feature (54)..(54): Xaa is any aa, unknown, or other
MENGGGKGDVPNDANEHCPGTQSEEAGKADACAWCPTSRLRHRPQGPDPDXXAXCERWLL

SEQ ID NO: 44847 - DNA, 676 bp, Zea mays
  misc_feature: Ceres CLONE 1447699-F
atagctggagctccccgcggtggcggccgctctatactagtggatcccccgggctgcaggaattcgcacgagaccattacctagaacatcctaatcgaaaactttatttttgtggtctgctgctcccccggatggtctcccacggcttgcccgcgtccgccggtctcgtcgccgccgaccccgccgactctggtcacacctgagaatccgccgactcttcttactctgccgaaccctcctgctcctggtacgccgccgatactggtcgctcctcctctaccgctggcactgtcaagcccttggactccatcggctaggaaagggctcatgcccccctgctcaaatgggctggtgagctatctgcaccttaaatcaactacctgatgactactgccgcacatccatgacaccccaccatcccagactgggtcctgaacagacagagggactgctgagacggctagtactcccaggctctctcccatgcacttgacttgcacctccggtttgaccttgcacctctgcagatactcagggacgctctgggtctgacacactattggggcctccttgttcgtggacaacaatccactaccaccggtctcggaccaaacactgcagttctgtccaacaagctccttccaagcctaatgtcgttagtcactacgttctcgaa

SEQ ID NO: 44848 - DNA, 661 bp, Zea mays
  misc_feature: Ceres CLONE 1447700-F
  misc_feature: Encodes the peptide sequence at SEQ ID NO. 44849
  misc_feature (661)..(661): n is a, c, t, g, unknown, or other
ggagctccccgcggtggcggccgctctagaactagtggatcccccgggctgcaggaattcgcacgagaccattacctagaacatcctaatcgaaaacaacacaccggaacccccaaaatggcaccggcgccggaaccgaccgcagcggccgccggccgcaagcgcaagaaaccgcacgggccctccaaaatcatcgcgaagaaatccgcggatcccaaacgggcatacgcgaagaagaagaaagagaagcataagcaaaaggagaagaagtcgcggctaaaacccgccgagccggaccaaatcgccgccaccatcggagatggcgtcgcaggggcaacggtcctactgtcggcattgatgcagccgtcgcggcagctcgagtttctcctccgtagcttcgagcgcgcctctaagatgcgcctctctcctctcgaactcgattcctactcagagggctgcacggtgcagcttgcggagggagcagcccaggacgtcgagagcttcggtgatcatgtaaaaggggtgttcggctcttcgtggaaggaagagctctgtgagggaaatcacatcgatggtgagatcgccgtgggcagcccaacacttctggttatcagctcatctgctttgcgatctttagacctactgacgatcataaaactan

SEQ ID NO: 44849 - protein, 181 aa, Zea mays
  misc_feature: Ceres CLONE 1447700-F
MAPAPEPTAAAAGRKRKKPHGPSKIIAKKSADPKRAYAKKKKEKHKQKEKKSRLKPAEPDQIAATIGDGVAGATVLLSALMQPSRQLEFLLRSFERASKMRLSPLELDSYSEGCTVQLAEGAAQDVESFGDHVKGVFGSSWKEELCEGNHIDGEIAVGSPTLLVISSSALRSLDLLTIIKL

SEQ ID NO: 44850 - DNA, 640 bp, Zea mays
  misc_feature: Ceres CLONE 1447712-F
  misc_feature: SWISSPROT Homolog: EC 2.3.3.1 Citrate (Si)-synthase
  misc_feature (501)..(501): n is a, c, t, g, unknown, or other
  misc_feature (535)..(535): n is a, c, t, g, unknown, or other
tggagctccaccgcggtgggcggccgctctagaactagtgggatcccccggggctgcaggaattcgcgcgagaccattacctataacatcctaatcgaaaaccagcaataacagctgctgcctacttgagattagcaggaagacctcccgtccttccttgaaatactctatcttattcagagaacttcttgtacatgctggactctttgggtgacagaacatagaatccagatcctcgacttgctcgagctctagatattcattttattcagcatgctgattatggaatgaactggctccactgctgctgttaagcaaccttgcttcaagtgtgggggaagaaattaaggggtctttccgggcgggttttggacccccccactcacccccggggggggttggcccctctgggggtaatatttagcgcccccccccccacagttttaaagacttacaaaaaatgcgcacaaccacattgactaagaatataatgtgaaaaanaataacaccccgttttatccccccccccctcgcnagaagaagcacccaccagcatcccccctagattttaaaaatattaagcaaacatgcaactccaccatatctttaccaaaatacaatccacgcacataataaatta

SEQ ID NO: 44851 - DNA, 615 bp, Zea mays
  misc_feature: Ceres CLONE 1447717-F
  misc_feature: Encodes the peptide sequence at SEQ ID NO. 44852
  misc_feature (424)..(424): n is a, c, t, g, unknown, or other
tggagctccccgcggtggcggccgctctagaactagtggatcccccgggctgcaggaattcgcacgagaccattacctagaacatcctaatcgaaaaactctccgtgctcttggtcgagtagttccctctcctctctctgattcttctgcttctcggtctagctagctagctcggtgcctcggccaaccgggcgtcgcgcgctggccggcctgccaggcaagcaacaatggcagattcaggggaggggcgtcgggtgtgcggcatgccggagaaggcgcagctgcacgtggcgatgctgctgctgcagttcggctacgcgggcttccacgtggtgtcgcggctggcgctcaacatgggcatcagcaagctcgtcttccccgtctaccgcaacatcatcgcgctctgcctgctcgtgcccttcgnctactttctggaaaagaaggacagggcgcaactgaaccttcacttcgtcgtccagttcttccttctcgggctcggcgggtttcatcgcgtccgggggtggcgttcccggtgccaaatctgggggctccaccggggggggccccgggtgttcctggggggttgtaccccccggggggaaaaacccggggggg

SEQ ID NO: 44852 - protein, 129 aa, Zea mays
  misc_feature: Ceres CLONE 1447717-F
  misc_feature (66)..(66): Xaa is any aa, unknown, or other
MADSGEGRRVCGMPEKAQLHVAMLLLQFGYAGFHVVSRLALNMGISKLVFPVYRNIIALCLLVPFXYFLEKKDRAQLNLHFVVQFFLLGLGGFHRVRGWRSRCQIWGLHRGGPRVFLGGCTPRGEKPGG

SEQ ID NO: 44853 - DNA, 616 bp, Zea mays
  misc_feature: Ceres CLONE 1447722-F
  misc_feature: Encodes the peptide sequence at SEQ ID NO. 44854
  misc_feature (325)..(325): n is a, c, t, g, unknown, or other
  misc_feature (373)..(373): n is a, c, t, g, unknown, or other
  misc_feature (486)..(486): n is a, c, t, g, unknown, or other
  misc_feature (567)..(567): n is a, c, t, g, unknown, or other
ccccgcggtggcggccgctctagaactagtggatcccccgggctgcaggaattcgcacgagaccattacctagaacatcctaatcgaaaaactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaangccgggcggtgcatgggcctgtgcatgatgtgctgccgcaagtgccanggctgcctgccgtccgggccgtacgccagcaagaccaatggccctgctacagggacattgagtcccccagaaccaacggcccaagtgcccctaagccctaccgctcttagggnaaggaagatgaaccaggatttcgctcgcgatcctgcacagcttccaatcctggactgctagtttagcgccgccgagcgtcngaatgtcccgacggttccttcggtgcttgggggctgtggtccccctcgg

SEQ ID NO: 44854 - protein, 122 aa, Zea mays
  misc_feature: Ceres CLONE 1447722-F
  misc_feature (1)..(88): Pfam Name: GASA Pfam Description: Gibberellin regulated protein
  misc_feature (49)..(49): Xaa is any aa, unknown, or other
  misc_feature (65)..(65): Xaa is any aa, unknown, or other
  misc_feature (103)..(103): Xaa is any aa, unknown, or other
MKAIPVALLLLVLVAAASSFKHLAEAADGGAVPDGVCDGKCRSRCSLKXAGRCMGLCMMCCRKCXGCLPSGPYASKTNGPATGTLSPPEPTAQVPLSPTALRXRKMNQDFARDPAQLPILDC

SEQ ID NO: 44855 - DNA, 603 bp, Zea mays
  misc_feature: Ceres CLONE 1447751-F
  misc_feature: Encodes the peptide sequence at SEQ ID NO. 44856
  misc_feature (550)..(550): n is a, c, t, g, unknown, or other
ccccgcggtggcggccgctctagaactagtggatcccccgggctgcaggaattcgcacgagaccattacctagaacatcctaatcgaaaaatcttgatttcgattctctggtggctgggaaagcctgcgagagcgcgataaccggaaagatctgagctgctgcaaccgatctccggcgccatggggttcctcgaggacttccaagccagtgttgaagcattgccatctatgctgcatcggaactattcattaatgcgagagttggataaaagtttgcatggtgtgcaactagaaaatgagcagcgctgtcaacaagaaatagaggacattaagcatggacttgaatctggaagtattacatatgacccagcaaaattgaaattttccgaagaagcaatggaggagcagaaacattgtgttagaattgctgacgagaaggtggctttagccactcagacttatgacttagttgatgctcacatccaacagctagatcagtttatgaagaaagcttgagaaatcccggcaggaaaaagagcagctgctgctngtactgcagggactgcttgtgctactactgccactccaaccgtgaatggctga

SEQ ID NO: 44856 - protein, 111 aa, Zea mays
  misc_feature: Ceres CLONE 1447751-F
MGFLEDFQASVEALPSMLHRNYSLMRELDKSLHGVQLENEQRCQQEIEDIKHGLESGSITYDPAKLKFSEEAMEEQKHCVRIADEKVALATQTYDLVDAHIQQLDQFMKKA

SEQ ID NO: 44857 - DNA, 574 bp, Zea mays
  misc_feature: Ceres CLONE 1447753-F
  misc_feature: Encodes the peptide sequence at SEQ ID NO. 44858
acccgcggtggcggccgctctagaactagtggatcccccgggctgcaggaattcgcacgagaccattacctagaacatcctaatcgaaaagatttcccgatctccggcgatggccgcgcggcgcctcggatcccccgcatctaggtggctgcgcccgtccgcgctgctcctcctggtcgcctctgctctcctctcggccccgttcgcgggcccggccctccggttcaacctcaattcgggccacaccaatgtgttctccgaccaaattcaggtcaaccccttggcttccgaaagttaccatttgttggggcccaacccaatttcccaaagcccatttcctcaagttcaccccattttctctggggaaacttcccctcgggaaaaactttctttcccggaaaaatgtgttttggcccctttccctttttggggggggaggaggggaaaaaatggccgggtttttgtgggcccaaccaaaaaaaccgggggcaacaaggtttttattttttttggaggggggggggttccccccccgaaaatttcttcccccccccccaaagggaggggggtgttt

SEQ ID NO: 44858 - protein, 155 aa, Zea mays
  misc_feature: Ceres CLONE 1447753-F
MAARRLGSPASRWLRPSALLLLVASALLSAPFAGPALRFNLNSGHTNVFSDQIQVNPLASESYHLLGPNPISQSPFPQVHPIFSGETSPREKLSFPEKCVLAPFPFWGGRRGKNGRVFVGPTKKTGGNKVFIFFGGGGVPPPKISSPPPKGRGVF

SEQ ID NO: 44859 - DNA, 641 bp, Zea mays
  misc_feature: Ceres CLONE 1447754-F
  misc_feature: Encodes the peptide sequence at SEQ ID NO. 44860
  misc_feature (641)..(641): n is a, c, t, g, unknown, or other
tccccgcggtggcggccgctctagaactagtggatcccccgggctgcaggaattcgcacgagaccattacctagaacatcctaatcgaaaaatcgatcctgtcctgtccagcaagggagacctggactggaggaggaggacctacccaacccggcctgcagctctctcgtctcttcctccttcctcctcgaagctccgatccgatccgatcccccaatgtctgacagcagtcccgctcccggcgcctactactccggccctcccgccgcgccgccgcccgagtctaagcccgttgacggcggccaggtcaacgccgatgttcctggctactactcctccgcccctgctgcgaaatctggcgccggcggccagcagggcagctccgctgctcccaaggaatcgggcttcttcgccagctggtgagcattcggagcccaaacaatcgatcaaataaatcaaattaaatctagtcgctgttgcctgcttttgatttcacttgattccttctctggtggtacgtgatggctctccgtttcttgtatgcatgtatgtatgtatcatcacagttgtgggtgcttctctggcggcgaaaccgcgagatagatagattcagtgttggaccgaggaccatggatggatgn

SEQ ID NO: 44860 - protein, 68 aa, Zea mays
  misc_feature: Ceres CLONE 1447754-F
MSDSSPAPGAYYSGPPAAPPPESKPVDGGQVNADVPGYYSSAPAAKSGAGGQQGSSAAPKESGFFASW

SEQ ID NO: 44861 - DNA, 727 bp, Zea mays
  misc_feature: Ceres CLONE 1447760-F
  misc_feature (73)..(73): n is a, c, t, g, unknown, or other
  misc_feature (74)..(74): n is a, c, t, g, unknown, or other
  misc_feature (78)..(78): n is a, c, t, g, unknown, or other
  misc_feature (727)..(727): n is a, c, t, g, unknown, or other
gtggctctctgcccctcccccccccccccgagaacccgccgctccgcgctccccatataaaaaattgcgattnntttntcccccaaacctggaaccccccgaggtggaggaagatttttccaaaaggagcccccgggcatgcagttttccacaaaagaccattacctagaaacagcctaatcgaaaagtaaaaacccgccgttcactcccgcctcggcgccgtagctagcaaaggcgatatccatggccgagcccagcacggaccgagccggacaagctgagcgtggagcagctcagggggctcaaggagcagacggatctggaggtcaaccgcctccaggacagcctcaccaagatccgaaccgccgccacccgacgcgagaacgcctccgccgcgctcaaagacctatcccaccgcccccaagggaagaagatgctcgcgccgcttaaggtgtccctccaccctcccggttcaccggacgacgcggagaaggatataaacaaagaccacaccggctaaccactccaacgaaacctagaggtcacgacgaagcaaactcgggaaacgcacaatcaaatcgatcgtaactcccaaacgcgcacgaaccgcgtcgaaccggcgctaacggaaaaaccaacagccagtagtaagaaacgcctctcggggtttggccataaccaaagagcacaaagccccgcacggtcaagaccgaccccgccgaggcan

SEQ ID NO: 44862 - DNA, 651 bp, Zea mays
  misc_feature: Ceres CLONE 1447764-F
  misc_feature: Encodes the peptide sequence at SEQ ID NO. 44863
  misc_feature (509)..(509): n is a, c, t, g, unknown, or other
  misc_feature (532)..(532): n is a, c, t, g, unknown, or other
  misc_feature (536)..(536): n is a, c, t, g, unknown, or other
  misc_feature (545)..(545): n is a, c, t, g, unknown, or other
  misc_feature (552)..(552): n is a, c, t, g, unknown, or other
ctggagctccccgcggtggcggccgctctataactagtggatcccccgggctgcaggaattcgcacgagaccattacctagaacatcctaatcgaaaaacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaactgcgtacgcatcttccacgaccaccaaacacgaaagtaaatacaatctgctccccccccccgcggagcggcagaatattttttatatgaaataaaccccccgggtgtgcccaacccaccccaaacaaaacacgcccccgcccctcgtttactgagtataaaaacatgagcaagaaaacaaagcgtaattncgctggctcccaacctcagtccntttntcaacaacngccaagncataaaattgggaccaatctaaccttataactattttaataactctaatacaaacacacgcataatcaactgccaccacagtcgcaacctctctccaag

SEQ ID NO: 44863 - protein, 66 aa, Zea mays
  misc_feature: Ceres CLONE 1447764-F
  misc_feature (11)..(67): Pfam Name: potato_inhibit Pfam Description: Potato inhibitor I family
MSSTGGDDGAKKSWPEVVGLSLEEAKRVILCDKPDADIVVLPVGTPVTMDFRPNCVRIFHDHQTRK

SEQ ID NO: 44864 - DNA, 567 bp, Zea mays
  misc_feature: Ceres CLONE 1447765-F
  misc_feature: Encodes the peptide sequence at SEQ ID NO. 44865
  misc_feature (255)..(255): n is a, c, t, g, unknown, or other
  misc_feature (260)..(260): n is a, c, t, g, unknown, or other
  misc_feature (263)..(263): n is a, c, t, g, unknown, or other
  misc_feature (292)..(292): n is a, c, t, g, unknown, or other
ggagctccccgcggtggcggccgctctagaactagtggatcccccgggctgcaggaattcgcacgagaccattacctagaacatcctaatcgaaaaacacagatcgttcttcacggctttggttaggcagcaaatccgaatccagtttaaataaggtgaataatctcccccccaatccctaaacatcctcctctcgctctcaggcgcatcattcttctcgcctcgtgtcgctgacttccccaagctttgctgggntgccntcnaacaagagacagggctgggtaaggggaancctaaggctaccaaggaacgggatcaaggggttgttggcccttcaattgccccccgggggaattaagggtgggggttcaccggccccaaacgggtaacctggaaggccccctggtgccccgggcttggcccgccggggcccaccccgggggggcggttctttcccccccctccaagaaaattttcccgggccgccccccggaaattttaaaaaaaaccttggggggaattccccaaaacccaaaaccccccccgggggggtttctaagggggggg

SEQ ID NO: 44865 - protein, 41 aa, Zea mays
  misc_feature: Ceres CLONE 1447765-F
GAPRGGGRSRTSGSPGLQEFARDHYLEHPNRKTQIVLHGFG

SEQ ID NO: 44866 - DNA, 739 bp, Zea mays
  misc_feature: Ceres CLONE 1447769-F
  misc_feature: Encodes the peptide sequence at SEQ ID NO. 44867
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaaatctgcggtttcttccacgcaccaatcatttcggccacactgcacacggacgaaactcgctcgtccttcgcctccagcagcagccgatccgtatccagttcccgtgccgtgcccaccagggggaacccgatcgatgggaaactgctgtctcgagaggcctcgtcgcggtggcagcggcagtgcgggctccgcgcattacgccaggacgaaccccgtgtgggtggaggacaggagggaggaggcgtgcaagggcgagggcgagggcgccggccacgcgccggcggcggcccacgaggtgaagatcaggatcactaggaagcagctgggagagctgctgncgcgcgtaaaggacgcaagcacggcggtggctgcggaatggcccgtccaggacgtcatctcggagcttctggggctggcccagcactagcttccatttttccggcaaagaaaggaaggggcatggggggccctccctttcaaacctaacccaagggaaacggaccctgccttgattgccaaacaaaacaggtacctggaaatccctggcgggttaagaatataaacccccccccaaaaccaggagggggggggtaaaactttttggccgcctttcccccgggggccaaacttttaaccc

SEQ ID NO: 44867 - protein, 97 aa, Zea mays
  misc_feature: Ceres CLONE 1447769-F
  misc_feature (69)..(69): Xaa is any aa, unknown, or other
MGNCCLERPRRGGSGSAGSAHYARTNPVWVEDRREEACKGEGEGAGHAPAAAHEVKIRITRKQLGELLXRVKDASTAVAAEWPVQDVISELLGLAQH

SEQ ID NO: 44868 - DNA, 738 bp, Zea mays
  misc_feature: Ceres CLONE 1447774-F
  misc_feature: Translation starting site: 201
  misc_feature (326)..(326): n is a, c, t, g, unknown, or other
  misc_feature (338)..(338): n is a, c, t, g, unknown, or other
  misc_feature (339)..(339): n is a, c, t, g, unknown, or other
  misc_feature (348)..(348): n is a, c, t, g, unknown, or other
  misc_feature (351)..(351): n is a, c, t, g, unknown, or other
tggagctccccgcggtggcggccgctctagaactagtggatcccccgggctgcaggaattcgcacgagaccattacctagaacatcctaatcgaaaatttttccgtgccgccacccagccccttaaccctcgttcctctagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaanggcgagttgaanngagagcttngcnagatgtacgaagtgaaggaccccaacacaatcttcgtcttcagttccggacccacttcgtgggaggcaggtcaacggctttcggccccacttacaaaaactccgagtttgccaaaaagttcaggcccaaaaacccccccatcagaaatgtctttgccccaagggttaaaaatccccccccgcaattaaaaaaggaaaaaagggccaaaaaaatctcgggggttaaaaaaacacgggggggggcccccaaaaaaaaaaaactctttttattttttttttaccacccccaaaccggggggggcccaatataaaaaaaaaaaatagggcgggggggggtttttcccccccccccaaaagaagattttttttccttgggggagagaccccc

SEQ ID NO: 44869 - DNA, 638 bp, Zea mays
  misc_feature: Ceres CLONE 1447783-F
  misc_feature: Encodes the peptide sequence at SEQ ID NO. 44870
acccgcggtggcggccgctctagaactagtggatcccccgggctgcaggaattcgcacgagaccattacctagaacatcataatcgaaaacctcgacgacgatcagcgttactccgacaccgccgaggtcctcctagcctcctcctccgcctcctctgttgccgcgccctccacgacggttgccgtccacccctcctccgacttcagcttcgacaaggatgtccatgactccagctacgttgagcctcccttgctgggcttgcagaattttcaggatggtgcttacgctgaggatcttgcaaaattccatgaacgcagccacgctgatgactggtttggcactgatatcatggatatccgcgtaggtttgaacccaaatttgtgctcaagtaaagtttacccagcttccacctacctgaccttgggactggagtggcaaaatcttgcgcacctgcaaagcagggttttccgatccgacgggattgccttttgggaaggggatttgactttgccctaccctttcaacggggatgggtttgaacccctaaatttcctggggaaaaaagttttgggaaccaaattttgaaaagaaattttaccttttttggggaaaggggccctttggggggatggggccc

SEQ ID NO: 44870 - protein, 78 aa, Zea mays
  misc_feature: Ceres CLONE 1447783-F
MDIRVGLNPNLCSSKVYPASTYLTLGLEWQNLAHLQSRVFRSDGIAFWEGDLTLPYPFNGDGFEPLNFLGKKVLGTKF

SEQ ID NO: 44871 - DNA, 751 bp, Zea mays
  misc_feature: Ceres CLONE 1447788-F
  misc_feature: Encodes the peptide sequence at SEQ ID NO. 44872
  misc_feature (53)..(53): n is a, c, t, g, unknown, or other
tagaagggacccccccccgccggcctcccacccgggcggggggatgggggacncgcggaccgagatcaaccccgtggcggccgctctagaatagtggatcccccgggctgcaggaattcgcacgagaccataacctagaacatcctaatcgaaaaggtgaggcacaccagctccccgcgctcttggctgaacgggatgttgcaagagaagaaaatcagcatctagggagtacgtatgattacgaaaggaaactcagggtggatcactccgaatctttgcagacgatgaagaggaattatgactccatggttacggagcttgaaaaacttcatgctgagttgagggacacatctaatcttgacaaaagtggttttttctacaatagcaccacccaaaaggccgatggtatatctagccatctttctgttggacaaggtgggtaaagatactgggtatggaagtaaacaggaaaagacaactcctaccggtctggcagacttaagtggagtccctgggggggggtgggcttcgttctgggtttgacccaacaaaacgcaatgcatatgatggttctcatgttgccagtctcggcgtcttcgaaaactgggacccaatgatgcatcaagggggtgccacctggcgttttgactctctggaagggggtctggggtaggtatgctttcaaaagccgcccggtaacttggaacagggcgttcagcctgagggggggggtcagggggggccatttact

SEQ ID NO: 44872 - protein, 52 aa, Zea mays
  misc_feature: Ceres CLONE 1447788-F
MKRNYDSMVTELEKLHAELRDTSNLDKSGFFYNSTTQKADGISSHLSVGQGG

SEQ ID NO: 44873 - DNA, 843 bp, Zea mays
  misc_feature: Ceres CLONE 1447789-F
  misc_feature (376)..(376): n is a, c, t, g, unknown, or other
  misc_feature (451)..(451): n is a, c, t, g, unknown, or other
aaagctggagctccccgcggtggcggccgctctataactagtggatcccccgggctgcaggaattctcacgagaccattacctataacatcctaatcgaaaactgtcctccgaccgcttcggcaaattccctgtcctccgcccgcttcgccgaatttactctcctccccgcccgccgcccgtgaccgcggcttcctctgaacttgtccctcccgttctcaaggagcacgggcttctcgacgcgccgttcgcccgccgccgccgccaccggttcatcgccagctatgtcttctcaagtcgacagacgcagccagtccgtagggaagcgagcgcgcaactacgggctccggcgatgaggacgactgggtttgatttancttcaaaaacatttaacttcggcctttggatagcaggtgcccacccccggtgtcacttgggagcccaccccccangcccagtaaggatcgcctggggccatggcggaaacccccgcgcctcggtttttccccacccctctagggggggattcactttagacccccctggggaacttccccgccccccccaaagtaaccctttggaagggggtgggcgccctccccccaacaggggggcccctttacaaagtgttacaacggggccacccaaagagaaccccctcttttgggataaccccccggggttcccccgagggggggtccccgcccttatcacaaaaaaagaaaaggggggggcgagaaatttttatgtggggaaacccctgaacagggtaaaataagcaaatgggcctgggccccacccagagaaccctgggaggcacctaaaaattgtagccaccggggat

SEQ ID NO: 44874 - DNA, 640 bp, Zea mays
  misc_feature: Ceres CLONE 1447794-F
  misc_feature (409)..(409): n is a, c, t, g, unknown, or other
  misc_feature (490)..(490): n is a, c, t, g, unknown, or other
  misc_feature (582)..(582): n is a, c, t, g, unknown, or other
ctccccgcggtggcggccgctctagaactagtggatcccccgggctgcaggaattcgcacgagaccattacctagaacatcctaatcgaaaatgatgatgagagtgagggaaaggttttatcggccctgagtgaagctgggctttttggtggtggtggcttgataaaagataaggttctcttctgtagcacggagaatggccgtacatcttttgttcggcaactcgagcctgattggcatatcgacacgagtcctgaagttgttcaccaattagctaggtttatcaaatatcaactgcacatctccccgcagcgacctgaaagaatagcaaccaatgttttcaccgctccaagcttggaacagtattttggaggcctagaccagagataaagaggtcaaactccatccnagaaattggcggcggcggcggattagtgagaagggaagacgtcattgttttttcctttctctgctcgaatgatggaactcngtttttttcctgtatcatgtgtaaaagcctgtgctgtgtaccagtaatcccattgttgtgcgatatgtagtgcctcagaatcttttccaggnaaaacatatgtagtagcatactttgtcgaaaaaaaaaaaaaaaatccttatcgatacc

SEQ ID NO: 44875 - DNA, 617 bp, Zea mays
  misc_feature: Ceres CLONE 1447799-F
  misc_feature: Encodes the peptide sequence at SEQ ID NO. 44876
acccgcggtggcggccgctctagaactagtggatcccccgggctgcaggaattcgcacgagaccattacctagaacatcctaatcgaaaattcctcccctcttacagccgccgccgccgcatcccagcctccatcaccgtttccgtctcgctgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggtttcggcaagaagcgcgggcccaactcctccgagaagtaggcgccgctcggctcgtaccggttcctcatccttcccgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgttatttttgaacgctatccatataaatttgaaaccagattgctgatgcgtatga

SEQ ID NO: 44876 - protein, 62 aa, Zea mays; identical to SEQ ID NO: 6893
  misc_feature: Ceres CLONE 1447799-F
  misc_feature (3)..(61): Pfam Name: Ribosomal_S30 Pfam Description: Ribosomal protein S30

SEQ ID NO: 44877 - DNA, 624 bp, Zea mays
  misc_feature: Ceres CLONE 1447801-F
  misc_feature: Encodes the peptide sequence at SEQ ID NO. 44878
cgcggtggcggccgctctagaactagtggatcccccgggctgcaggaattcgcacgagaccattacctagaacatcctaatcgaaaaaaaaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaaatttctggcttttcacaacacacactgcagtcatttacagtggagagattgcgtgcacttctacgacaaagtggtcgatcgaccaaag

SEQ ID NO: 44878 - protein, 170 aa, Zea mays
  misc_feature: Ceres CLONE 1447801-F
MPTEEGSDGGGGAGAGAGEKKSSQAPAKPGACGAAKFLAGLPSRGNFSSGSAPSNLGGFRVYVCEHSTDPPEGQVIKTDSTNILIRHLQLNKQKTEGKDVDSRTVGENNRGKRSAARSLDVNNSAKKANLGTSSGSSAYEEISGFSQHTLQSFTVERLRALLRQSGRSTK

SEQ ID NO: 44879 - DNA, 701 bp, Zea mays
  misc_feature: Ceres CLONE 1447806-F
  misc_feature: Encodes the peptide sequence at SEQ ID NO. 44880
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaaaaccgcgccgctctctctctctctctcgcacgagccgcgccggcgccgccaccacgcgcgcgggagacagagaccacagccgcagccaccggcgggcggaataggaatggtggcgccggggggaggagcaggaggaggtccgtcgcggtggccggcggcggaggagcttgacactgtacggaagaaggtggtggagattagtggaagggatgaacaagaggttatggttgctgcttgcccctacagaatttgccctttgggggctcatattgatcatcagggtggagtagtcacagctatgaccataaattatggagtactccttggtttcgttccctctaatggttctgaggttttacttcattctggtcagtttgaaggtgctataagattcagagttgatgacttgcaaaagccctatgataaccctganaactaaaactgggggaaagttttccaaaaaggggtctctttattgccccgcccaaaaagggggatatttctttgggggggggtcctagggaaatttttttgggggggaaagactcttatattttgggggcccttttttttctggggggggggggggcccccctttt

SEQ ID NO: 44880 - protein, 110 aa, Zea mays
  misc_feature: Ceres CLONE 1447806-F
  misc_feature: SWISSPROT Homolog: EC 2.7.1.6 Galactokinase
  misc_feature (109)..(109): Xaa is any aa, unknown, or other
MVAPGGGAGGGPSRWPAAEELDTVRKKVVEISGRDEQEVMVAACPYRICPLGAHIDHQGGVVTAMTINYGVLLGFVPSNGSEVLLHSGQFEGAIRFRVDDLQKPYDNPXN

SEQ ID NO: 44881 - DNA, 623 bp, Zea mays
  misc_feature: Ceres CLONE 1447819-F
  misc_feature: Translation starting site: 155
  misc_feature (196)..(196): n is a, c, t, g, unknown, or other
  misc_feature (203)..(203): n is a, c, t, g, unknown, or other
  misc_feature (204)..(204): n is a, c, t, g, unknown, or other
  misc_feature (271)..(271): n is a, c, t, g, unknown, or other
  misc_feature (300)..(300): n is a, c, t, g, unknown, or other
  misc_feature (319)..(319): n is a, c, t, g, unknown, or other
  misc_feature (327)..(327): n is a, c, t, g, unknown, or other
  misc_feature (329)..(329): n is a, c, t, g, unknown, or other
  misc_feature (336)..(336): n is a, c, t, g, unknown, or other
  misc_feature (351)..(351): n is a, c, t, g, unknown, or other
  misc_feature (353)..(353): n is a, c, t, g, unknown, or other
  misc_feature (363)..(363): n is a, c, t, g, unknown, or other
  misc_feature (397)..(397): n is a, c, t, g, unknown, or other
  misc_feature (399)..(399): n is a, c, t, g, unknown, or other
cgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgncagtgcnngcacggctgcggagggtgcagcaagatgtacccggacatggctgagcaagtgaccaccaccacccangctctcatcatgggtgtcgcaccatcaanggggcacgccgagggcggntttcgagncngccgccngaactgaaaaacgcngntgcaagtgcngcggcaactgccagtgcgacccctggcaactgcngnaagtgagctaggtggctcaaccctggcagcccggcgggagggacctagcttatttttttaagctaaataaaattttaccgccttcccttggtgtggttttcaaatccatccacccctttttttgccggccctgggtgtggatgccctctaatctaaaaaatataaaaaacccctaataggcgccgcccttgccctttaaaccccccctggcccccctggggggg

SEQ ID NO: 44882 - DNA, 635 bp, Zea mays
  misc_feature: Ceres CLONE 1447827-F
  misc_feature: Encodes the peptide sequence at SEQ ID NO. 44883
ggagctccccgcggtggcggccgctctagaactagtggatcccccgggctgcaggaattcgcacgagaccattacctagaacatcctaatcgaaaaacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagaagccaagtgagtgatctgccctttccttcacccgatcgttcatgtcccactgtccttgattagattcgacgcgatctgcctggatgttatgcgatacgatgccgtcattaggggcatggatctaggtctaggtttgtctagtggttcactgatcctttgcgcttcacggctagtcgtagttgctgatggtgtaaatctgatctaatgtggtgattgatggagttggtcagaatgtgatgagtagaggctaaataattaattcgcgca

SEQ ID NO: 44883 - protein, 64 aa, Zea mays
  misc_feature: Ceres CLONE 1447827-F
  misc_feature (9)..(57): Pfam Name: ATP-synt_Eps Pfam Description: Mitochondrial ATP synthase epsilon chain
MSATTAAVPFWRAAGMTYIGYSNICAALVRNCLKEPFKSEAASREKVHFSISKWTDGKQEKPSE

SEQ ID NO: 44884 - DNA, 621 bp, Zea mays
  misc_feature: Ceres CLONE 1447829-F
  misc_feature: Encodes the peptide sequence at SEQ ID NO. 44885
acccgcggtggcggccgctctataactagtggatcccccgggctgcaggaattcgcacgagaccattacctagaacatcctaatcgaaaactctaaataatcgtaaagtgacgaaatctaattctcatagcataattccaaatttctttgtgaacaaaattccaccgaatcgctgtcgttcgacaccgtcaacggcggccgcgcgctcacgtcccggcggccacgggccgtgacagactcgagcccgtccgccgccttcgccgcgccgcctccgcctcctccatcgcacgccgactccgctgcctacatccgcgcacgtccgcctccactgcctccatccgctcgggagccgccgccctccgcgctaggcctcgcctccgtctggtctggattcttcgacatctggccatctgggcgctccgcgtcgccgacttctcgcaggcagagagcatccttgatagacctgatggctatcgcagagagctgtgttgatgcggtggtcatggagatggtggcagtctactgcggtggcctctacaccgccaaaccagagcttgctgcccgccgcatcgaggccatcggcttccaagtcgggcaccagctctctgagagatataccat

SEQ ID NO: 44885 - protein, 51 aa, Zea mays
  misc_feature: Ceres CLONE 1447829-F
MAIAESCVDAVVMEMVAVYCGGLYTAKPELAARRIEAIGFQVGHQLSERYT

SEQ ID NO: 44886 - DNA, 759 bp, Zea mays
  misc_feature: Ceres CLONE 1447844-F
  misc_feature: Encodes the peptide sequence at SEQ ID NO. 44887
aaagctggagctccccgcggtggcggccgctctataactagtggatcccccgggctgcaggaattcgcacgagaccattacctagaacatcctaatcgaaaactcaacacactctcctttctctgtcgcgtctcttccactggctcctgccccaggcggcgctgcagcccagcgcggcgaccagcgcccacgcgaggtgagccgcggccaagcccctggcgcctggcggccctgtcccctggccagccacggcgcgacgcccatcctcacccttgcgtgcggccagccccgacggcgctgcatggaagcgcggcgcggcagccggtcggcctgccagcgagcctgcgcgcccccgtcctcgccagcgtccaagctcgcctcgccggagtcgccgttcgtcaccgtgactgcgatccatcttcgagcttcgaggaatcgacggtcaagcttttgcgaccaagtgatcgaactcttcgaggtctacgaggctgaaacccctgatatcttatttcaggaaggttgcctttggggcaactcaagccccgggaaaaaaaaaggcttcaagggaaattcccggagttcccggatttccaaaatttaaggaatagggttggccaccccccccaaaaaagttccctgggggggtttatttatggggggcacattttttgttttgggggttttggaaataatatgaaaagggggccccgggttaaaaaaacaccccccccttttgtgggccccaaaaaagtggggggt

SEQ ID NO: 44887 - protein, 99 aa, Zea mays
  misc_feature: Ceres CLONE 1447844-F
MEARRGSRSACQRACAPPSSPASKLASPESPFVTVTAIHLRASRNRRSSFCDQVIELFEVYEAETPDILFQEGCLWGNSSPGKKKGFKGNSRSSRISKI

SEQ ID NO: 44888 - DNA, 722 bp, Zea mays
  misc_feature: Ceres CLONE 1447847-F
  misc_feature: Encodes the peptide sequence at SEQ ID NO. 44889
  misc_feature (508)..(508): n is a, c, t, g, unknown, or other
  misc_feature (511)..(511): n is a, c, t, g, unknown, or other
ctggagctccccgcggtggcggccgctctagaactagtggatcccccgggctgcaggaattcgcacgagaccattacctagaacatcctaatcgaaaaatcgtccgtccaatccatccattcatctacacacgcagttgcagcacatacagctagctagctcgttactgtttttgcagctgatctgatcgaccgacgcgacccaccgatcacgatcatgagctaccaagcgggctacccaccgccgggccaacaggcctacggcgcgcctccgccggcgtacgtcgcgccaccgccggcgtacccgccaacggcccaggacggcggcgcggcgtactacggccagcagcagacacctatcaccagcagcagccgcggcggcgacggtttctggaaaggatgctgcgcccgcatctgctgctgctgcgtcctcgacatgtgcttctgaagacatatcgtcgatcgatcgacgacggcccaggcatgctagctagctgatgaccggccgnacntgcctggtgaagatcaccatcagggctgctcaaaaactgctggggcataaaaataaccctcgggaaaccaaaaaaccgaaacggacggaccccaacgttttcaaattattccggggggttgggattaacaattcgcccaccttttgtccccccccccggggtgtttcgggttacaatggggagaatttttttttagatcccggggggggga

SEQ ID NO: 44889 - protein, 76 aa, Zea mays
  misc_feature: Ceres CLONE 1447847-F
MSYQAGYPPPGQQAYGAPPPAYVAPPPAYPPTAQDGGAAYYGQQQTPITSSSRGGDGFWKGCCARICCCCVLDMCF

SEQ ID NO: 44890 - DNA, 1046 bp, Zea mays
  misc_feature: Ceres CLONE 1447850
  misc_feature: Encodes the peptide sequence at SEQ ID NO. 44891
ttattctacatccacattccacacccatcacgctcgcgaagcaggagggagagagaccggcgagcggcggcaatggcgaacgcgaatcggtggtgggcggcagcgaatgtggtgtcgcaagccttcgcgcaagctgtcggcatcccggaagaagtcctcaggtcgatcaacctcgccatcgccaagctcgaggcgcgagccgggttgctgcgcgcgatccgcgacggcgccaccctcgaggaggcgaccgcaggctacgtcgagccgggtcccgccggggtcctccccgccgcgctcctcgaggacgcccggcgcggcatcaagcgccgccgctcgctccacgccttggcccgcggcctccccctctgcgcccatgcactgggccgggcacccgacgcggagacgagccagagatgggagagctgcaacgtcgccgcgctcacctacgcccgccgcgcgcagatgaggctgcgcaacgccgcgtccttctacatagcggccatggacgccatcgacttggcctcggtgcttccgttcggagccccgctccgcgtcgcctggatgggggcggccgagcggctcacgaggcttgccgccagggaggccaccatggcgcgcgacaacatggtcatgatggggctagccgttgctcagcaggcctggatcgccatggccatgatggggcctgcgccaggcgcgctcggcggaggaatcaacaaccaagtccatcaccagtaagcctctgtttccattccttcctgcattcctgcgccccggagagagattttcgcaagagcttctgtacggtgtcggtgtgtgggactcgaaactcttgatgagttggtgtgtcagatgaacacgtctccgcttcttctagatactatacgtacattggttgttaatagttgtatagattaggtgatttgtgctctagaatgtctggcgttcacctgatgcaatccggtctgtccgccgtcagattctccggctgaccaatgcaatgccaacgtgaacacgtgtactttgaaacaaaaaaaaaaaaaaaa

SEQ ID NO: 44891 - protein, 221 aa, Zea mays
  misc_feature: Ceres CLONE 1447850
MANANRWWAAANVVSQAFAQAVGIPEEVLRSINLAIAKLEARAGLLRAIRDGATLEEATAGYVEPGPAGVLPAALLEDARRGIKRRRSLHALARGLPLCAHALGRAPDAETSQRWESCNVAALTYARRAQMRLRNAASFYIAAMDAIDLASVLPFGAPLRVAWMGAAERLTRLAAREATMARDNMVMMGLAVAQQAWIAMAMMGPAPGALGGGINNQVHHQ

SEQ ID NO: 44892 - DNA, 707 bp, Zea mays
  misc_feature: Ceres CLONE 1447856-F
  misc_feature: Encodes the peptide sequence at SEQ ID NO. 44893
  misc_feature (707)..(707): n is a, c, t, g, unknown, or other
aagctggagctccccgcggtggcggccgctctagaactagtggatcccccgggctgcaggaattcgcacgagaccattacctagaacatcctaatcgaaaaatcagaagctagaagcctagagcagccaagaaaagcacatacccgagtcgccgaaacaacaacaatcccaatcccccctcgtcactcaaaactcgagctcgagcaacaatgtcgctgattcgccgtggaagcgcattcgaccccttctccctcgacctctgggaccccttccagggcttatttcccttcggctctggaagcagcagcagcagcagcctgttcccctcgttcggaggcaccaccaccagctcggagacggccgccttcgccggcgctcgcgtcgactggaaggagacgccggaggcgcacgtgttcaagaccgacgtgccggggctgaagaaggaggaggtgaaggtggagctggaggacggcaacgtgctccagatcagcggcgagcgctgcaaggagcaggaggagaagacggacacctggcaccgcgtggagcgcagcagcggcaagttcctgcgcaggttccgcctgacggagaacgccaggacggagcagatcagtgcgtccatggaggacggcgtgctcaccgtcaccgtgctaaggagggagccaagaagccgacgtcaagtctatccagatctccggctagtatgctcn

SEQ ID NO: 44893 - protein, 166 aa, Zea mays
  misc_feature: Ceres CLONE 1447856-F
  misc_feature (59)..(158): Pfam Name: HSP20 Pfam Description: Hsp20/alpha crystallin family
MSLIRRGSAFDPFSLDLWDPFQGLFPFGSGSSSSSSLFPSFGGTTTSSETAAFAGARVDWKETPEAHVFKTDVPGLKKEEVKVELEDGNVLQISGERCKEQEEKTDTWHRVERSSGKFLRRFRLTENARTEQISASMEDGVLTVTVLRREPRSRRQVYPDLRLVCS

SEQ ID NO: 44894 - DNA, 680 bp, Zea mays
  misc_feature: Ceres CLONE 1447870-F
  misc_feature: Encodes the peptide sequence at SEQ ID NO. 44895
  misc_feature (451)..(451): n is a, c, t, g, unknown, or other
ggagctccccgcggtggcggccgctctagaactagtggatcccccgggctgcaggaattcgcacgagaccattacctagaacatcctaatcgaaaaagttaggcagtgaaccaaacaagcccctagtcttccctcctgctggcggcgtgcggagggccggaggccgggtcgacaagaggagatgacgttggcggcggggctgggttacgccctgatcgcgctgggccccgccttctccctcttctccggcgtcgtcgtcaggaagcccttcctcgtcctcaccctcctctctagcaccttattttggcttataagtttgatagtcctctcgggaatatggagaggatttcttcctataaagtcaggagcttggtgggcatatgtgattctgatctttacatctgtcgcattgcaagaaggcactcgtcttgtgttttggatgctttaacangaaatggaagagatgctagatgcttttgctgatagaatatcttagccacctccttaaattggactgacaagatgctgatttcctttacctggggggtttaaggccatggaatggcctcatgcaagcttttttcggttcccaaccttttgaacccccgcgtttgggcccacccccctttttattctggaaagggggttcaaagcggcccttttttccctttcgccccccc

SEQ ID NO: 44895 - protein, 88 aa, Zea mays
  misc_feature: Ceres CLONE 1447870-F
MTLAAGLGYALIALGPAFSLFSGVVVRKPFLVLTLLSSTLFWLISLIVLSGIWRGFLPIKSGAWWAYVILIFTSVALQEGTRLVFWML

SEQ ID NO: 44896 - DNA, 683 bp, Zea mays
  misc_feature: Ceres CLONE 1447871-F
  misc_feature (25)..(25): n is a, c, t, g, unknown, or other
  misc_feature (416)..(416): n is a, c, t, g, unknown, or other
ccgcggtggcggccgctcaagtcanagaggatcccccgggctgcaggaatccccacgagaccattacctagaacatcctaatcgaaaaaccagaacaggcacgcacggccctactcatatctttaagcttgctgtgttgcaagcgtaaaaaaaacaatctgcactcgctcggtcgctctgttcaaattgctgcatgctcgcctcgccatcatctcctccaataaggtcgccgttctccacgccgcaatctggtctgtggtaataaccacctataggccgttgtacgctgaggatgctggtgaaaaataattatcaccacttacatatggcatacagattagttagccgcctgtttttccccccacccaaaatcacaatctatgttacagattaagtgttagtattttttattgttnccaacccccaaacccaacaaaaagataaacagacctataggagtgctatatgattctttttaatataaaaaaaatgacgacctggcttgacttcaatataacgaccaaccggaccaccccaatttggacggcaaatcttttaaaaaataccattttacacctccctcgaataaatttatttgtcccactgtattcctcccactgagggaatagcctaatatatcttcccccgcccattttaccacagaatccaacggctcatctaca

SEQ ID NO: 44897 - DNA, 635 bp, Zea mays
  misc_feature: Ceres CLONE 1447877-F
  misc_feature: Encodes the peptide sequence at SEQ ID NO. 44898
  misc_feature (528)..(528): n is a, c, t, g, unknown, or other
acccgcggtggcggccgctctagaactagtggatcccccgggctgcaggaattcgcacgagaccattacctagaacatcctaatcgaaaaacggccacacctctcctctctctctctccccctctgtccagcgcactctatctcctcactagctacccacctcagcgagccaaggccggcgaagcgcatccatcggtccatggagttgtacgtggacgagaagtggaagttctccaagaagagccggaacaacggcagccggcgcgtcccgggatccggcggcggggactctctgctgaagagatcgtccagcatgagggacgtcgcggcgatcggccggcgcggtaccggcggcgccggcgccgcggcggcgggcgggtgcgcgccgcagccgtcgttctcgagccggtgcgcgggcctggtgaaggagcagcgggcgcgcttctacatcatgcgccgctgcgtcaccatgctcgtctgctggaaggactgctcgtagccacggctcccaggccggccggcgaagangctcgacccctcgcagttccccccgcccgtccgcccgcccgccaggatcagagagagagagagagagtcagccatggcccatggggctgaagcaagcaagctgcaag

SEQ ID NO: 44898 - protein, 99 aa, Zea mays
  misc_feature: Ceres CLONE 1447877-F
  misc_feature (76)..(94): Pfam Name: DVL Pfam Description: DVL family
MELYVDEKWKFSKKSRNNGSRRVPGSGGGDSLLKRSSSMRDVAAIGRRGTGGAGAAAAGGCAPQPSFSSRCAGLVKEQRARFYIMRRCVTMLVCWKDCS

SEQ ID NO: 44899 - DNA, 612 bp, Zea mays
  misc_feature: Ceres CLONE 1447884-F
  misc_feature: Encodes the peptide sequence at SEQ ID NO. 44900
ccccgcggtggcggccgctctttcctagtggatcccccgggctgcaggatttcgcacgagaccattacctagaacatcataatcgaaaaagcagcaatttctgagctggatataaaaaaccaggataaagttattgtctatgatggaaagggattcttcagtgcacctcgtgtttggtggatgtttagagtgtttgggcacaagaaagtctgggtactagacggcggtttgcctcagtggcaagcttctgggttcaacgtggaagaggccagccctgacgatgacgcagttctgacatcaatcgctgcaaacagggctgtcaaaagggtttataatggtgaacagacaaatacaatctcgtttcacactgaatttcagcctaatctattctgggcactggaaaaggtcgcacaaaacgtcactgctaagacgtaccaacagatagatgccatagcaaagggcagattcgacggcgtgccgccagagccacgggaaggggaaagggagtggcatataccaggaagcgtctgcgtcccgttccccgagatgttcgacggggcaaccacgagccttctcctccccgccaacgagctgcggcggaattttcacaag

SEQ ID NO: 44900 - protein, 144 aa, Zea mays
  misc_feature: Ceres CLONE 1447884-F
  misc_feature: SWISSPROT Homolog: EC 2.8.1.2 3-mercaptopyruvate sulfurtransferase
MFRVFGHKKVWVLDGGLPQWQASGFNVEEASPDDDAVLTSIAANRAVKRVYNGEQTNTISFHTEFQPNLFWALEKVAQNVTAKTYQQIDAIAKGRFDGVPPEPREGEREWHIPGSVCVPFPEMFDGATTSLLLPANELRRNFHK

SEQ ID NO: 44901 - DNA, 657 bp, Zea mays
  misc_feature: Ceres CLONE 1447885-F
  misc_feature: Translation starting site: 106
  misc_feature: SWISSPROT Homolog: EC 1.16.3.1 Ferroxidase
  misc_feature (387)..(387): n is a, c, t, g, unknown, or other
ctccccgcggtggcggccgctctagaactagtggatcccccgggctgcaggaattcgcacgagaccattacctagaacatcctaatcgaaaaacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctncacgagcagatcaacgtggagtacaacgccctcgtatgcataccactccctcttcgcctacttcgaccgcgacaacgtggctctcaaaggattttgcccaattccttcaaggaatccagcgacgaggagagggagcacgctgaaaagcttatgaattacaaaaacaaacgtgaaagcagggtgaagctcccatcgattgtgaccccttttaaccaaattgaaccccctgaaaaaggaaagcttctgtaccctatgaagctggcttctggc

SEQ ID NO: 44902 - DNA, 630 bp, Zea mays
  misc_feature: Ceres CLONE 1447889-F
  misc_feature: Encodes the peptide sequence at SEQ ID NO. 44903
  misc_feature (241)..(241): n is a, c, t, g, unknown, or other
  misc_feature (274)..(274): n is a, c, t, g, unknown, or other
  misc_feature (294)..(294): n is a, c, t, g, unknown, or other
acccgcggtggcggccgctctagaactagtggatcccccgggcttcaggaattcgcacgagaccattacctagaacatcctaatcgaaaaacttcactcacgattggagtttcacctcggcagcccagccagccagtggttcctcggctcggaggaacaggcgaacagcaagagcttctgaagatgaaggcgatccccgtggctctcctgctcctcgtccctggtgctgccgcctcctcgnttcagcatctcgccgaagcagcaaacggcggcncggtgccggaacgcgtgtgncaacgcaagtgccgcacccggtgctccctgaaaagggccgccggtgcatggggctgtgcatgatgtgcttccgcaagtgcaggtttgcttgccttcgggccttaccccaccaagaccaggcccctgctcaggggaactgaatcccccaaaaacacgcgccccaaggccccctaggccctccccttttaaggggggggggaggacccccgattttccttcgaaactctgacagacttttaaatttttacccgcgatttttaccccccccacacccctaaatttttcaccaagttccccccccggggttggggggggggggggttcccccccccgaag

SEQ ID NO: 44903 - protein, 57 aa, Zea mays
  misc_feature: Ceres CLONE 1447889-F
  misc_feature (20)..(20): Xaa is any aa, unknown, or other
  misc_feature (31)..(31): Xaa is any aa, unknown, or other
  misc_feature (37)..(37): Xaa is any aa, unknown, or other
MKAIPVALLLLVPGAAASSXQHLAEAANGGXVPERVXQRKCRTRCSLKRAAGAWGCA

SEQ ID NO: 44904 - DNA, 636 bp, Zea mays
  misc_feature: Ceres CLONE 1447894-F
  misc_feature: Translation starting site: 199
  misc_feature: Pfam Name: Yip1 Pfam Description: Yip1 domain
  misc_feature (454)..(454): n is a, c, t, g, unknown, or other
  misc_feature (562)..(562): n is a, c, t, g, unknown, or other
aagctggagctccccgcggtggcggccgctctagatctagtggatcccccgggctgcaggaattcgcacgagaccattacctagaacatcctaatcgaaaaatctgctctaccctccttcgcgcggccggcctgattcctcacccctgctcgccgcgaagcacagctctgtcaccgcggtttgccgtggccggcgaagatgatgtccggcggtgggtactccgccctcgacgaccccaaggcctccggatccgtcccggcggccacggggacagatccgccggccatcaggttcgccgactccaacctccagaccttcccgccgtccgaggccaggggcatatctccggcgcctaccgcccgcccaccgacgccgatgacaccttctcgtcaagggcggaagagccggaagcggtggcataagcggcagcgccgggctggatgatgccgcgcanggcggctggttccgcatgttctccgtggcagcgtacaagccctacttcgacgttgacacctctgacgttgtcgagaggatctggggagtcgtcttcccctttcgcggnacattttacgagaagaactcccgagaaccctgacctgtatggggcattttggacatgcaccaccctgattttcg

SEQ ID NO: 44905 - DNA, 577 bp, Zea mays
  misc_feature: Ceres CLONE 1447898-F
  misc_feature (275)..(275): n is a, c, t, g, unknown, or other
  misc_feature (293)..(293): n is a, c, t, g, unknown, or other
ggagctccccgcggtggcggccgctctagaactagtggatcccccgggctgcaggaattcgcacgagaccattacctagaacatcctaatcgaaaaccggtcggcctctctctctctcacacacacacttttttctccggacgcgctcgttcgttcgcgaaggcgccccttcctgccctcacatccgctcctccctccccgacaccgaccgacccctcgtccgctcgcctccctccccgatccccaccgccatggccgccgccgccgccgccgcngtcctccctcttcctccntccgagggttccgaatcgcccgccccgcaaccttgggtttttccccctcgggcaaaaagggggggggtgggggccccttgtggtttaaaaaggccccccccccccaaagggggggggggggggggggaaattatttgggggggtggggcccgggcctttttttttttcttcaaaaagaaagaaaaaactccccccccccaaaagaaaaaaagccccccccccccctctgggggggggggggggtggggaccccccccccccccccctcttgggggggggggggg

SEQ ID NO: 44906 - DNA, 576 bp, Zea mays
  misc_feature: Ceres CLONE 1447907-F
  misc_feature: Encodes the peptide sequence at SEQ ID NO. 44907
  misc_feature (156)..(156): n is a, c, t, g, unknown, or other
  misc_feature (411)..(411): n is a, c, t, g, unknown, or other
  misc_feature (436)..(436): n is a, c, t, g, unknown, or other
  misc_feature (468)..(468): n is a, c, t, g, unknown, or other
  misc_feature (534)..(534): n is a, c, t, g, unknown, or other
  misc_feature (554)..(554): n is a, c, t, g, unknown, or other
tccccgcggtggcggccgctctagaactagtggatcccccgggctgcaggaattcgcacgagaccattacctagaacatcctaatcgaaaatgtctgattctgtggtggctatgatcttgaacgtcggtcgtgaaggtcccaaagttgttccggtnggaaggagcagtgaagaccaaagaggagacggctcaaaaggtggtgtatgctcttatggcttcacttttcggtgatgttaaagttgtggaggaagggagacttgtcatatctgtggatggaaatgtggcacacttgggacgggaggaagtggctatgtggaatgtgagaatgctacactgaaggacggatcaagactgcgttcgccgcatacagggtgccgtgagaccatcccacttgcctccctctgatctgangacagtgattgttgcattttccagnttgacatagtagcatttgtctgtttacattangactaggataaccagttttattttagaaaaggactgggtggccccacatgtaaaaggtgccctggnaatgtattggaaacttttgnactgccaccctactcgaagagg

SEQ ID NO: 44907 - protein, 41 aa, Zea mays
  misc_feature: Ceres CLONE 1447907-F
MASLFGDVKVVEEGRLVISVDGNVAHLGREEVAMWNVRMLH

SEQ ID NO: 44908 - DNA, 622 bp, Zea mays
  misc_feature: Ceres CLONE 1447916-F
  misc_feature: Encodes the peptide sequence at SEQ ID NO. 44909
acccgcggtggcggccgctctagaactagtggatcccccgggctgcaggaattcgcacgagaccattacctagaacatcctaatcgaaaagatcccaaatgtgcccggcccggtccctctgcactgcgcccatccatccttaaaccctcctgcgcgcgtaggcctctcgctcgtctcgtctcgtctcgtccttccccagcacaccacaacctctcctcctccttcgccaggtgcctcttcgttctcctctccgttccctgcgtggcgcgcgcggcgctccaggctatcaggacgaaataactggccgcgctgcacgccggccgccgcgagaagaagcgctcgccccgcgcgctctgccgctggttcggccgtagtccgtcgccgctgattgatcctgcaggaaaaacagggcaaggagctactttgagcccgagactgaactgaagaagatgatgatggccgaggtggccaaccacagcaagaggaaccacacggacagctacttcagtggcaagcccgtcgccgtccccgccgcggccaccagctcggaggagttcggcagcatgtcctcgaagaagccgaggaatgccagcccgagactcgcgcccgtatcaccaaagga

SEQ ID NO: 44909 - protein, 57 aa, Zea mays
  misc_feature: Ceres CLONE 1447916-F
MMMAEVANHSKRNHTDSYFSGKPVAVPAAATSSEEFGSMSSKKPRNASPRLAPVSPK

SEQ ID NO: 44910 - DNA, 632 bp, Zea mays
  misc_feature: Ceres CLONE 1447917-F
  misc_feature: Encodes the peptide sequence at SEQ ID NO. 44911
tggagctccccgcggtggcggccgctctagttctagtggatcccccgggctgcaggaattcgcacgagaccattacctagaacatcctaatcgaaaactcgcacacacgacgctagtcgtactgtgtacacacaccacttgcccgagagtcgaaggtgccaagccaacgcaggtgcagatggcggccgagcaccacctcccgccggagcacgcggaccaccacagaggcgggaggaagggggtccacgccgacgacctgaagccgcgctggtggcgccgcagcccccggtacagctactactacggcgggggcgagggcgggggcgcggtccgcgccctctgcttcgccgtcctcgtcttgctcctggccccggggatcaccctgctggtgctctacgtcgtgtaccggccgcccccacccaccttcgccgtcacctcgaccgccgtgctggcgctgtacaaagccaccgccaactcctccccggacgcgggcgcggtccccggaaccggccaccctgttggccccatcgttccagtccgcgttggtgctccgccaccccgagcgggcggtcgggggccgcgttcaaaccgggctgtgcccgaacattggcctacccccgggaagggcgctg

SEQ ID NO: 44911 - protein, 151 aa, Zea mays
  misc_feature: Ceres CLONE 1447917-F
MAAEHHLPPEHADHHRGGRKGVHADDLKPRWWRRSPRYSYYYGGGEGGGAVRALCFAVLVLLLAPGITLLVLYVVYRPPPPTFAVTSTAVLALYKATANSSPDAGAVPGTGHPVGPIVPVRVGAPPPRAGGRGPRSNRAVPEHWPTPGKGA

SEQ ID NO: 44912 - DNA, 801 bp, Zea mays
  misc_feature: Ceres CLONE 1447928-F
  misc_feature: Encodes the peptide sequence at SEQ ID NO. 44913
aaagctggagctccccgcggtggcggccgctctagaactagtggatcccccgggctgcaggaattcgcacgagaccattacctagaacatcctaatcgaaaaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtctttcgtcagacaactactttcgcgccgacgcgcccgacgcgcccgcgaagcgcggcgcgggcggccccccgaaggcccgggacccccgcgcggccggggccccgcccttcgggcgggggggcgggggccccgcccagcccaaggacccctttgaaccccccttgaaaagggccccccgggttttcccggggcccgggccccccccccaaaaagggcaaaaaaggggggggggggccccccccccccgcggagagttccccccccctaaggggggggggggccccccccaagggtacccccccggtccccaaaaaaaacccccctttttaaaaaccccccctgggggagtgtgaaaaaattcccccccccccccccccccggggagagggaggtgggggccgctctttttccctctagttgttggggccggccccgcccgcc

SEQ ID NO: 44913 - protein, 125 aa, Zea mays
  misc_feature: Ceres CLONE 1447928-F
  misc_feature (13)..(74): Pfam Name: Linker_histone Pfam Description: linker histone H1 and H5 family
MATEEVAKPSPIPPYPEMILAAIEDLGDKSGSNKSAISRYIEGKYDGDLPPAHASLLAAHLARMKESGELVFRQTTTFAPTRPTRPRSAARAAPRRPGTPARPGPRPSGGGAGAPPSPRTPLNPP

SEQ ID NO: 44914 - DNA, 766 bp, Zea mays
  misc_feature: Ceres CLONE 1447930-F
  misc_feature: Encodes the peptide sequence at SEQ ID NO. 44915
  misc_feature (640)..(640): n is a, c, t, g, unknown, or other
  misc_feature (658)..(658): n is a, c, t, g, unknown, or other
  misc_feature (729)..(729): n is a, c, t, g, unknown, or other
  misc_feature (730)..(730): n is a, c, t, g, unknown, or other
  misc_feature (738)..(738): n is a, c, t, g, unknown, or other
ctggagctccccgcggtggcggccgctctagaactagtggatcccccgggctgcaggaattcgcacgagaccattacctagaacatcctaatcgaaaacggatagaccaacccttatcctcgagcccaaactgcggtagcgaaaacgcgagcgctgcggaacaacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcgcgccgcggcgatggtcgcgatggcgaagagggagcaggagctggaggagatccgggccatgacgacggaacagatggaagaggaggtggtagacctcaagggggagcttttcctgctccgccttaagcgctcggcgcgccaggagttcaagaacagcgagttcagccgcatgcgcaagaggattgctcgtatgctaaccgtgaaaagagagcgggaaattgaacagggaatcataaaagattgtctaggaagcttgataggaaatggaagcagagcattgtggtcagaccaccaccatctctaagggggaacnaagaggagtagaaagccngcaaaagagggcatgtgcaaaagtcgtttcatgcgagtgttgcaggaaggtcccttcatggattcaacccnntatgcgtngttatgtatccatgtttacattttgcta

SEQ ID NO: 44915 - protein, 154 aa, Zea mays
  misc_feature: Ceres CLONE 1447930-F
  misc_feature (68)..(125): Pfam Name: Ribosomal_L29 Pfam Description: Ribosomal L29 protein
MATMSLAAASPLASIPRGIAAQAPCAAFLSIRLGGATATRFAGLAVASQPAERRAAAMVAMAKREQELEEIRAMTTEQMEEEVVDLKGELFLLRLKRSARQEFKNSEFSRMRKRIARMLTVKREREIEQGIIKDCLGSLIGNGSRALWSDHHHL

SEQ ID NO: 44916 - DNA, 769 bp, Zea mays
  misc_feature: Ceres CLONE 1447932-F
  misc_feature: Translation starting site: 261
  misc_feature (185)..(185): n is a, c, t, g, unknown, or other
  misc_feature (200)..(200): n is a, c, t, g, unknown, or other
  misc_feature (380)..(380): n is a, c, t, g, unknown, or other
aagctggagctccccgcggtggcggccgctctagaactagtggatcccccgggctgcaggaattcgcacgagaccattacctagaacatcctaatcgaaaactctcgtctcctccactccaagagaacaggcgccggcgaaaggcgggagcagcgcgctgcccattcaccgccccctgaattttntttccttttgggggngaagttgcggatcggtctccggggcagcgtggaacggctgggcccctcggatcgccggagatgctgccctacgcgacggcggcggaggcggaggcggcgcttggccggcccatgacgcccgccgaggcgctgtggttccggtacaccgcgtgggtgtccgactacccactctactgctgncacatcctctttctcttcgtcgtcttcacggttggccccgcttcccatcgcgctccttgagcttcgggcccccggccgcggtctcgccgtacaaaactgcagccgcgggtgccggctctccaggggccgagttccgtcggtggctacaaggaactcctcccgcattttcttcctcggaattggccccgttccatttggttcctacccggggggaaaattttgggggattccaccaaatttgcttttccccccccttggggaatttggcacaccacctcggggtgttcctccttgtggggagaaccccccatttcggggcccccgggttttcccggggggggggggggccccaaaatacccccggtgtcaccatgtttcccggcgcccaa

SEQ ID NO: 44917 - DNA, 751 bp, Zea mays
  misc_feature: Ceres CLONE 1447935-F
  misc_feature: Encodes the peptide sequence at SEQ ID NO. 44918
ctggagctccccgcggtggcggccgctctataactagtggatcccccgggctgcaggaattcgcacgagaccattacctagaacatcctaatcaaaaatttccattcatcgttcacggtgtaatctccccctgtcgcctccatagcagcaggaggtgcagctcgagcaagaaagaactagtttgatctgagaaaatgttggccatctcttacaagcaagtggcgcacgcgccgtatgagctcaacagggcgtgcggcaccaccgccaaggccaagaacaccgacgagatacctccgcgagtgccacgccgcccacccatccgacgccttctccacctcattcggcggcggctccggcatgacatgcctcgccgcgcagccccgcaaccacgtcaccggagggtaccacaacatgctctgcgagctggacgacatctactgcgactgcaaggcgacgctggacaaccagagcgcgcagatgctgcagtactgtctcacggagcgctccacaaactagcgctgctggcgatcaaggcctactcaccatgcacgacgggtgcccttaccctgctgactacgtggtgaaagacatgtcaggctctttcacttcgtcaacttaaacaaccgcacctggccagctccgggccgcccgtagttggcgagaaaactttgaaagctgtgtgcctttcctctggcgcttgcccgcggaaggttgtggggtgatttgcaacaattttcgtggccaattcagg

SEQ ID NO: 44918 - protein, 93 aa, Zea mays
  misc_feature: Ceres CLONE 1447935-F
MSSTGRAAPPPRPRTPTRYLRECHAAHPSDAFSTSFGGGSGMTCLAAQPRNHVTGGYHNMLCELDDIYCDCKATLDNQSAQMLQYCLTERSTN

SEQ ID NO: 44919 - DNA, 805 bp, Zea mays
  misc_feature: Ceres CLONE 1447938-F
  misc_feature: Encodes the peptide sequence at SEQ ID NO. 44920
aaagctggagctccccgcggtggcggccgctctagaactagtggatcccccgggctgcaggaattcgcacgagaccattacctagaacatcctaatcgaaaaaagggaaaaaaaaccaggtctgtgtgtgtgtgagagagagagagaggcgaaggcaactcaggcgacgcgatggcgatggcggcgctgcgacgcgaggggaggcgcctcatcctctcctccaccgtccccaacccgtctctggcggccgcttcctctgcggtgacgcgatcctccgccgtctcgcaaccgtaaggctatggccttccctcactctcagatctctctcgtgctcgatctgggattcggggacgggggggtgggggtgggtgggcccacgggttttgcatccggggaccttctaggagcagtaccccccccccccatttgcgtaaaggtgatccgggcaagccccccactaaaaaggtttcgatgtgtaaccaagacattgcccccctcttccatggcccccctaccaaaagtttcccctggggttagggggccggaacccctttttttaactcgccccccggaacttaaaaacttgggcggggaaaagttttccctccccccccccctcccccaaaaggggggttttggggaaaacaaaaaaaaaaaaaaaaaaatttttttttccccctcccccggggggggggggggggacaccaatccccccaaaaggggggtatatagcccgcccgcgggggggcgtttttataacgcggggaggggaaaaaaatggggtcaccccaaattttgcgcggga

SEQ ID NO: 44920 - protein, 40 aa, Zea mays
  misc_feature: Ceres CLONE 1447938-F
MAMAALRREGRRLILSSTVPNPSLAAASSAVTRSSAVSQP

SEQ ID NO: 44921 - DNA, 749 bp, Zea mays
  misc_feature: Ceres CLONE 1447939-F
  misc_feature: Encodes the peptide sequence at SEQ ID NO. 44922
  misc_feature (309)..(309): n is a, c, t, g, unknown, or other
  misc_feature (333)..(333): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (380)..(380): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (452)..(452): n is a, c, t, g, unknown, or other
tggcggccgctctagaactagtggatcccccgggctgcaggaattcgcacgagaccattacctagaacatcctaatcgaaaaagagctttaaagcttttccgattccgcaatgctcaccgttcggttccttctcgtaccgagccgcgggtagccagccaaccgccgacgcagtccacaagcgatgaagcgcttcttccagccagtgcccaaggacggctccccgtccaagaagcggctagcgggtgctgctgaaccgggcgacggtcccacatcaggcggtgccgcccccggggctggttgttatgtanagggaaggccccccgaggagcccntcaattttttttacccccccccagggaaaagaaaggggnnnnnnaanannncctcccccccttttttttaaaaaaaaaaaaaaaataaaccccaccgtgggggggggcccccagcgccnaggccggcggtggggcctcaaggtagcctagaaccccccttgctcaccaaaacgcctagcgtggcagccgagtaaagccccgagcggctcacccctagtttcgtctccgccgtgctaagctccacttccgggtcggccctaggtctcgcgcaaccgagcgtgatctctctggcgagcaccgagtccacctagccccctccccaaggctcgccctaccggctcggcgaggtccctccttctcatactcgagacacgctacctcccacttctttttactcatacacctatctcccaccc

SEQ ID NO: 44922 - protein, 73 aa, Zea mays
  misc_feature: Ceres CLONE 1447939-F
  misc_feature (43)..(43): Xaa is any aa, unknown, or other
  misc_feature (51)..(51): Xaa is any aa, unknown, or other
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (68)..(68): Xaa is any aa, unknown, or other
MKRFFQPVPKDGSPSKKRLAGAAEPGDGPTSGGAAPGAGCYVXGRPPEEPXNFFYPPPGKRKGXXXXXSPPFF

SEQ ID NO: 44923 - DNA, 758 bp, Zea mays
  misc_feature: Ceres CLONE 1447941-F
  misc_feature: Encodes the peptide sequence at SEQ ID NO. 44924
  misc_feature (646)..(646): n is a, c, t, g, unknown, or other
  misc_feature (692)..(692): n is a, c, t, g, unknown, or other
  misc_feature (735)..(735): n is a, c, t, g, unknown, or other
ctggagctccccgcggtggcggccgctctagaactagtggatcccccgggctgcaggaattcgcacgagaccattacctagaacatcctaatcgaaaaaagcaaaccgcacgccccgctccagaacggatcctcatctctcacgttgtcaccacagtctgaatccagaatccaactagtagctccataaaagcggcaatgatccagctgctgttcgtcgtgctggtggcggaggcgtccctgacggcggcgttgctcttcaagacgccgctgcggaagctcgccgtgctagtgatcgaccggctcaagcgcggccgccacgcgcccgtcgtcgtcaagacggtcgcgggcgtcatccttgccctgctcgcttcaacgctctacagcatgacacagatcgccggcagcacgagcgactccgactctggcggcgggcccacccccaccgaccaggtgctcttctcgcgtcacctcctggaggcgtgcctcatggggtactccttatttcttgctctagtgattgaccggctccaccaatacatcagagatttgcgccggtttaaaaagacttagaggctgtacgtaagcataataaaatgttggaggaggcaaaacatggaaactcggaagggagcaagaaataccangaagagattgccactctgaaacaggagatgaagaaactgaagctancagtccaagaaaagacagaaagagtcccatgttcagaggacanggcacttgctatccaaaaacatc

SEQ ID NO: 44924 - protein, 124 aa, Zea mays
  misc_feature: Ceres CLONE 1447941-F
MIQLLFVVLVAEASLTAALLFKTPLRKLAVLVIDRLKRGRHAPVVVKTVAGVILALLASTLYSMTQIAGSTSDSDSGGGPTPTDQVLFSRHLLEACLMGYSLFLALVIDRLHQYIRDLRRFKKT

SEQ ID NO: 44925 - DNA, 809 bp, Zea mays
  misc_feature: Ceres CLONE 1447943-F
  misc_feature: Encodes the peptide sequence at SEQ ID NO. 44926
  misc_feature (53)..(53): n is a, c, t, g, unknown, or other
  misc_feature (400)..(400): n is a, c, t, g, unknown, or other
  misc_feature (404)..(404): n is a, c, t, g, unknown, or other
  misc_feature (413)..(413): n is a, c, t, g, unknown, or other
  misc_feature (488)..(488): n is a, c, t, g, unknown, or other
  misc_feature (489)..(489): n is a, c, t, g, unknown, or other
cggctggagctcaccgcggtggcggccgctctagaactagtggatctcttggnctgcaggaattcgcacgagaccattacctagaacatcctaatcgaaaaattccgcctccaccccccgaactccaaaccctagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtcctatgccaggagaggtgcatgtccggcggcctcgtcctgtcttaagatgaagtacctccgcttcctccgcaagatgtttgtttcccccgcccccccgagggggggggggaanaccncccccccancctttttcccccccccgtgtgtgtgggggggaagaatcccccccgacgaccgcgggggggcggggcccccccttnnaaggtttcaagggtgatcgaaggggtgggcgcccttccttattcactcgtatcagttgcctggctcctcgcgccgaatccgttggagtggtggaggtcctgtccggcttgtgttatagggcctgcctcccctatacttgtttgtctgttggattgtcgtatggagtctggctcctagtttcttctcgggtcgtgctcgtcattcctctcttcgttatgcttcttgttttttttttttgcgccagtttctttccccttctctccccttcccttgctgcgtcggttgctcctcgaggggtgcgttctttgcctctgtcgcgg

SEQ ID NO: 44926 - protein, 55 aa, Zea mays
  misc_feature: Ceres CLONE 1447943-F
MVSGSGVCAKRVVVDARHHMLGRLASIVAKELLNGQRVVVVLCQERCMSGGLVLS

SEQ ID NO: 44927 - DNA, 763 bp, Zea mays
  misc_feature: Ceres CLONE 1447946-F
  misc_feature: Translation starting site: 139
  misc_feature: SWISSPROT Homolog: EC 1.11.1.7 Peroxidase
aaagctggagctccccgcggtggcggccgctctagaactagtggatcccccgggctgcaggaattcgcacgagaccattacctagaacatcctaatcgaaaaatttaacgctgtcgctttcgcttccactcgcactccatgggtgcgcgggcgacgatgggatgttcgcccttgctgcccttccaagcgctctggctcacagcggccgttgtcgcggcgctcgcgctcgcggccggcgcgcagccgtcgccgtcgctgtcgccggggttctacgacgcgacgtgcccggggctgcagcccatcgtgcgccgcggcgtggcgcgcgccgtccgggcggagccgcgcatggggggcgtcctcctccgctcttcttcacgactgcttcgtcaatggctgcgacgcctccgtcttgctggacgacgtgcccgggtactttcacgggggagagaaccgcgggccccacggccaactcctgcccggggaccaaggcatccacgccatcaggcccagggggaaggcttcctggaaggccacgtttcctgggccgaaatcctcgcctttcaagggggggaccccgttaaatgtgtgggggggccccggggggggggggcccctgtggggggggggaaccccgggaaaaaaaggcggggcgcgaaaaacaaactggcccccccagaggtttttctccgggttttttttcccttttggcacaagggttggaacccgagaacaaaggtgttttgggcggccacacgggggggcc

SEQ ID NO: 44928 - DNA, 769 bp, Zea mays
  misc_feature: Ceres CLONE 1447948-F
  misc_feature: Encodes the peptide sequence at SEQ ID NO. 44929
  misc_feature (393)..(393): n is a, c, t, g, unknown, or other
  misc_feature (396)..(396): n is a, c, t, g, unknown, or other
  misc_feature (399)..(399): n is a, c, t, g, unknown, or other
  misc_feature (400)..(400): n is a, c, t, g, unknown, or other
  misc_feature (403)..(403): n is a, c, t, g, unknown, or other
  misc_feature (406)..(406): n is a, c, t, g, unknown, or other
  misc_feature (410)..(410): n is a, c, t, g, unknown, or other
  misc_feature (416)..(416): n is a, c, t, g, unknown, or other
  misc_feature (438)..(438): n is a, c, t, g, unknown, or other
  misc_feature (641)..(641): n is a, c, t, g, unknown, or other
  misc_feature (668)..(668): n is a, c, t, g, unknown, or other
  misc_feature (671)..(671): n is a, c, t, g, unknown, or other
  misc_feature (683)..(683): n is a, c, t, g, unknown, or other
  misc_feature (684)..(684): n is a, c, t, g, unknown, or other
  misc_feature (769)..(769): n is a, c, t, g, unknown, or other
tccctggagctccccgcggtggcggccgctctagaactagtggatcccccgggctgcaggaattcgcacgagaccattacctagaacatcctaatcgaaaaatcacaacaaaaggcgcaagcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggagggcgccgcaccatctcccgggtctgactccgcctcgtcaccggactcctcgtcggatgttttttcccccccccccgcgggggagcgggggggntanccnntcnacncacnatctcnttctccatctacaacaaaaacnaattctacctttgtcggcgtgcgatgcaaaaatcccaatccttcgggaataattaaacccccaaaggagtgggcttgcatccctcactacctaataccctgtgtttattaatggttccctcccctgccgcccccccattttaaactttatgtatggctcaatttttggtgaaggggaaaaaccaattttttttgttttggttntgtacatagaaaatataacataacccntantctaaccccttnncaataccacactcctttttccttcccccccccccccaggggggggccggcaaccccaatcccccaaccagaatccgatcaccccn

SEQ ID NO: 44929 - protein, 124 aa, Zea mays
  misc_feature: Ceres CLONE 1447948-F
  misc_feature (74)..(74): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
  misc_feature (79)..(79): Xaa is any aa, unknown, or other
  misc_feature (81)..(81): Xaa is any aa, unknown, or other
MARAYVFLVVLLLAAVIVAPFAGATRVDVVEGRSMASADAPEGAAPSPGSDSASSPDSSSDVFSPPPAGERGGXPXXXXSXSPSTTKTNSTFVGVRCKNPNPSGIIKPPKEWACIPHYLIPCVY

SEQ ID NO: 44930 - DNA, 758 bp, Zea mays
  misc_feature: Ceres CLONE 1447952-F
  misc_feature (408)..(408): n is a, c, t, g, unknown, or other
  misc_feature (432)..(432): n is a, c, t, g, unknown, or other
  misc_feature (484)..(484): n is a, c, t, g, unknown, or other
  misc_feature (681)..(681): n is a, c, t, g, unknown, or other
  misc_feature (697)..(697): n is a, c, t, g, unknown, or other
  misc_feature (698)..(698): n is a, c, t, g, unknown, or other
  misc_feature (724)..(724): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
tccccgcggtggcggccgctctagaactagtggatcccccgggctgcaggaattcgcacgagaccattacctagaacatcctaatcgaaaaatgcccatccatcatcacacgacgacgcacacaagtcgcagctagctagctcccaaccgagccaggaaaacggacgccgtgcagctcgctcgcgcgcgccccacggaaagagagggcaggtaggaataatgtaccaggccatcccgtacagcgccggccagccgtggccgcggccggccccgacgatcggtcctgacgtggcggaggaggaggggttgctggcggcttcccagcagcaggcgtcgacgccagcggaggttgtcccccacggtggaggaggggggaggggcttctcctctttttcctattcccccccncctcctgttggaacaagccccggnagctgcctccagccacgggggtggaggggcttgctgcaaggggcttcggggnggaacccccctcccggcaccaaggtggccccggccaccaaggcggaacctcccgggcccccgcgggcgccgcgccctcccggccggggatccctcgcgggcgcagcctgccccctcggccctacatcaaggatcatggcgcgccccccctgcctccggggcaccctctcctccgtcgataagcaaccccacctctcnatttgacttgggagannagaagggcgccgcacacagaacccanannnacgacccgccgcggaaaacagccttnnntc

SEQ ID NO: 44931 - DNA, 762 bp, Zea mays
  misc_feature: Ceres CLONE 1447954-F
  misc_feature: Encodes the peptide sequence at SEQ ID NO. 44932
  misc_feature (362)..(362): n is a, c, t, g, unknown, or other
  misc_feature (374)..(374): n is a, c, t, g, unknown, or other
  misc_feature (388)..(388): n is a, c, t, g, unknown, or other
tggagctccccgcggtggcggccgctctagaactagtggatcccccgggctgcaggaattcgcacgagaccattacctagaacatcctaatcgaaaaaactctgtttcacatcgtccgctcgtcatactcccgaggccccgatccccctttcatttcaactcgcatctcccgcgccgcgccgccccagcccggcagcccaaatggacctgccagtggtagatctcacgccgtatctcggggccgcagccggcggcccggccgcgtcgggcgtggaggagctgcgcgcgctgtgcgccacagtgagcgctagtctgcgggacacgggggcgctgctggtgatggacccgcgctgctccgccgnggacaactaccncttcctcgacgtcntcaagcgctacttcgcccgatccgccgacgcaaagcgcctccaggaacggccccacctccactaccaggttggtgtcacacccgaaggggtggaggtgcctcgcagtttggtcgacaagaacatgcaggagaagatcaggagcatgcctaaggactttaggccaaccactcctaaaggcccggacccgaaatggcgatacatgtggagagtgggtccccccccctacaacacccgttttagggagctgaactcagaacctgtatatcctggaggaatacctgagtggggaaaagaagatggattcccggggtcctaaaagatttccgccattcgaagtgcttcccgaaatggccgacataaggctttcggccaa

SEQ ID NO: 44932 - protein, 167 aa, Zea mays
  misc_feature: Ceres CLONE 1447954-F
  misc_feature (54)..(54): Xaa is any aa, unknown, or other
  misc_feature (58)..(58): Xaa is any aa, unknown, or other
  misc_feature (63)..(63): Xaa is any aa, unknown, or other
MDLPVVDLTPYLGAAAGGPAASGVEELRALCATVSASLRDTGALLVMDPRCSAXDNYXFLDVXKRYFARSADAKRLQERPHLHYQVGVTPEGVEVPRSLVDKNMQEKIRSMPKDFRPTTPKGPDPKWRYMWRVGPPPYNTRFRELNSEPVYPGGIPEWGKEDGFPGS

SEQ ID NO: 44933 - DNA, 764 bp, Zea mays
  misc_feature: Ceres CLONE 1447956-F
  misc_feature: Encodes the peptide sequence at SEQ ID NO. 44934
aagctggagctccccgcggtggcggccgctctagaactagtggatcccccgggctgcaggaattcgcacgagaccattacctagaacatcctaatcgaaaaagtgatgacatatctccaaacgttgcatcaaaactcaggcagttgtgcagtgcaattgatgctagcgattttgccactgcgatgcacctccaggtactcttaacaacaagtgactgggacgagtgcaacttctggctcgcggcattgaagcggatgatcaagacaaggcagaatttcagaatgtaaaccttgtggcctttttctgcagccagttctgtacacaccttttttctgctgcttgccagaaatgatagctgtagcagttcacacagtttgcctgcacaggggtgttatcatgctgctttgccctcggcccttgattctgcctaagcgctttggtacctcagtgctgttatacattttgataatagttttttgttttccacatctgctataaggtgacctgcggctgggttgttcgttatgaatgttaattgtaagaggacacttaatctgttatagctggtggatcacctgtttcaatccttctcttaaatttcgtccgtttgaaattcccagaactcttgagggtaaaacaattgacagtggcttgttttttttttttttttttgggaaggcccccgaaatccataaaaaaaaaaaaaaaagtttattatccgcccaccccgagggggggccgggcccactttccccatatgaggc

SEQ ID NO: 44934 - protein, 94 aa, Zea mays
  misc_feature: Ceres CLONE 1447956-F
AGAPRGGGRSRTSGSPGLQEFARDHYLEHPNRKSDDISPNVASKLRQLCSAIDASDFATAMHLQVLLTTSDWDECNFWLAALKRMIKTRQNFRM

SEQ ID NO: 44935 - DNA, 760 bp, Zea mays
  misc_feature: Ceres CLONE 1447958-F
  misc_feature: Encodes the peptide sequence at SEQ ID NO. 44936
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (388)..(388): n is a, c, t, g, unknown, or other
  misc_feature (397)..(397): n is a, c, t, g, unknown, or other
  misc_feature (760)..(760): n is a, c, t, g, unknown, or other
tccccgcggtggcggccgctctagaactagtggatcccccgggctgcaggaattcgcacgagaccattacctagaacatcctaatcgaaaaacgcgccccccccaaggccccaaccttccaggaaaaaaaacccggaatccgcacccatccatggccgccgccgccctgctgcgccgctcgccgccggcgcgcgcgctcctctctccggcgctctcgtcccgcctcgtcgcgtccaagacccactcctcctcccccacgcagccgccccccgaggcaaagggcgcctccagcacgaagaccttctcgatctaccggtgggacccggactcgccgtcaaccaagccgcacctcatggactaccaggcggagcgggcggactgcnnnccnatggtgctnaacccccccctcaagatcaagaacgagcaggacccgtcgctcaccttccgccgcagctgccgcgagggcatcttcgggagctgcgccatgaacatcgtcggggacaacggcctcgcctgccctcccaagatctcctccccctccccgggggtccaccgtctcgcccctgccccacatgttcctcatccaggacctggtgggccacttgacccactttctacaacccgtacaaaaaccgtcaagcgcggggctcaagcgcccaagaacccccccccccccaatctggcaagggaggtcccccccaaacctaatgcctcaacccgccccccggctctgacggattggaacaaacgggtctcctcn

SEQ ID NO: 44936 - protein, 203 aa, Zea mays
  misc_feature: Ceres CLONE 1447958-F
  misc_feature: SWISSPROT Homolog: EC 1.3.5.1 Succinate dehydrogenase (ubiquinone)
  misc_feature (78)..(78): Xaa is any aa, unknown, or other
MAAAALLRRSPPARALLSPALSSRLVASKTHSSSPTQPPPEAKGASSTKTFSIYRWDPDSPSTKPHLMDYQAERADCXPMVLNPPLKIKNEQDPSLTFRRSCREGIFGSCAMNIVGDNGLACPPKISSPSPGVHRLAPAPHVPHPGPGGPLDPLSTTRTKTVKRGAQAPKNPPPPNLAREVPPKPNASTRPPALTDWNKRVSS

SEQ ID NO: 44937 - DNA, 745 bp, Zea mays
  misc_feature: Ceres CLONE 1447968-F
  misc_feature: Encodes the peptide sequence at SEQ ID NO. 44938
  misc_feature (363)..(363): n is a, c, t, g, unknown, or other
aagctggagctccccgcggtggcggccgctctagaactagtggatcccccgggctgcaggaattcgcacgagaccattacctagaacatcctaatcgaaaaatttctgctcttctgccgtctagtcctttgtactgaccggcgctccggtcgtctcctcgcgcttgcgggttccccgtccccaccccacgccgggggcaagagatggagaacgcggtggtgctccgggagtggtttgaccgcgtcgacgccggccgcaccggcaacatcaccgctgcccagctccagggcgcgctcgctgtcggcaacctcaacttccccatctccgtcgtgcagcagatgattaggatgtatgacttcgatncgaatggcaccatgaacttcgaagaagttctgggctcttacaaattcctacagaaagtgcaaaatgtgtttttccaccctgaataggggtccgggaatttcctaagctttggaggaggggaccaggcattaatcaaactgggttcctcgttggatccacagcctttttaactggttggaaaacttttacaaaaccaaaaagggcgggttccttggagaggtttttccccctcgctttttgttcaaccccccaaccgtgttaaatttttaaaaatagaggcgggaaaggggctttttttttcaccatttggttccgcccgaaaatgggaaaaatggggttttcatggcgcccccaaaaagggtgccggggggggcaccccccc

SEQ ID NO: 44938 - protein, 81 aa, Zea mays
  misc_feature: Ceres CLONE 1447968-F
  misc_feature: SWISSPROT Homolog: EC 2.7.11.1 Non-specific serine/threonine protein kinase
  misc_feature (54)..(54): Xaa is any aa, unknown, or other
MENAVVLREWFDRVDAGRTGNITAAQLQGALAVGNLNFPISVVQQMIRMYDFDXNGTMNFEEVLGSYKFLQKVQNVFFHPE

SEQ ID NO: 44939 - DNA, 764 bp, Zea mays
  misc_feature: Ceres CLONE 1447973-F
  misc_feature: Encodes the peptide sequence at SEQ ID NO. 44940
  misc_feature (533)..(533): n is a, c, t, g, unknown, or other
  misc_feature (534)..(534): n is a, c, t, g, unknown, or other
  misc_feature (597)..(597): n is a, c, t, g, unknown, or other
  misc_feature (607)..(607): n is a, c, t, g, unknown, or other
  misc_feature (613)..(613): n is a, c, t, g, unknown, or other
  misc_feature (642)..(642): n is a, c, t, g, unknown, or other
  misc_feature (643)..(643): n is a, c, t, g, unknown, or other
  misc_feature (655)..(655): n is a, c, t, g, unknown, or other
  misc_feature (659)..(659): n is a, c, t, g, unknown, or other
  misc_feature (665)..(665): n is a, c, t, g, unknown, or other
  misc_feature (668)..(668): n is a, c, t, g, unknown, or other
  misc_feature (697)..(697): n is a, c, t, g, unknown, or other
  misc_feature (733)..(733): n is a, c, t, g, unknown, or other
  misc_feature (764)..(764): n is a, c, t, g, unknown, or other
ctggagctccccgcggtggcggccgctctagaactagtggatcccccgggctgcaggaattcgcacgagaccattacctagaacatcctaatcgaaaaacagcaacctcccactccactgtccactccacccccaccacctttgcctctcctagcttttccttggcatcctagctcttcctcctcagccgcagcagatcgactaggaaacatgtgcggcggcgcgatcatctccgagttcatcccgcatcgcggcgccaagcggggtctctgcgccgaggacatctggccgcacgcggccgccgacttcgacgacctcctccacgcgcacgcgcacgcgcacggccacgacgacgacgacttcgccgccgccgcctccttccatcccgaccaagagccgccggcccgcaagcgggagcgcaagaccatgtaccgcggcatcgggcgccgcccctggggcaagtgggcggcggagatccgggggaccggcaagggcgcgcgcgtctggctcggcaccttttcgcaccgcgaggnncgcgcgcgcgcctacgaccgcgccgcgcgccgcatccgcggggccaagggcaaagtcaacttnccccacgagnacccgncgcccgagtacgacgacgacgaagaaggnncacgccacgccnacgncgccgnggngcaagggatgctccccatgtccgccggcngaggcagggacgaccacctagtcgactacgacgtcntccacgtcatgggcatgggcggcttcctccn

SEQ ID NO: 44940 - protein, 184 aa, Zea mays
  misc_feature: Ceres CLONE 1447973-F
  misc_feature (72)..(123): Pfam Name: AP2 Pfam Description: AP2 domain
  misc_feature (108)..(108): Xaa is any aa, unknown, or other
  misc_feature (129)..(129): Xaa is any aa, unknown, or other
  misc_feature (133)..(133): Xaa is any aa, unknown, or other
  misc_feature (135)..(135): Xaa is any aa, unknown, or other
  misc_feature (145)..(145): Xaa is any aa, unknown, or other
  misc_feature (149)..(149): Xaa is any aa, unknown, or other
  misc_feature (150)..(150): Xaa is any aa, unknown, or other
  misc_feature (152)..(152): Xaa is any aa, unknown, or other
  misc_feature (153)..(153): Xaa is any aa, unknown, or other
  misc_feature (163)..(163): Xaa is any aa, unknown, or other
  misc_feature (175)..(175): Xaa is any aa, unknown, or other
MCGGAIISEFIPHRGAKRGLCAEDIWPHAAADFDDLLHAHAHAHGHDDDDFAAAASFHPDQEPPARKRERKTMYRGIGRRPWGKWAAEIRGTGKGARVWLGTFSHREXRARAYDRAARRIRGAKGKVNXPHEXPXPEYDDDEEGXRHAXXAXXQGMLPMSAGXGRDDHLVDYDVXHVMGMGGFL

SEQ ID NO: 44941 - DNA, 749 bp, Zea mays
  misc_feature: Ceres CLONE 1447975-F
  misc_feature: Encodes the peptide sequence at SEQ ID NO. 44942
aagctggagctccccgcggtggcggccgctctagaactagtggatcccccgggctgcaggaattcgcacgagaccatcacctagaacatcctaatcgaaaaaggtgcagttcgaggacaggctcttcaccctacaaatatgggatactgccggtcaggagaggtttcaaagtcttggtgttgcattctaccgcggagcagattgttgtgttctagtttatgatgttaactcgatgaaatcatttgataatctgaacaactggcgtgaagagtttctaattcaggctagcccatcagatcctgataacttcccttttgttctgctgggtaacaaagttgatgtagatggcgggaacagtcgtgtggtttctgagaaaaaggcgaaggcatggtgtgcctctaaagggaacatcccatactttgagacttctgccaaggatggaatcaacgtggaggaagctttccattgtatagtaaagaacgctctgaagaacgagccagaagaagaactgtatatgccggacaccgtgaacgtggtgggtggcaaccgggtcaaggatcatcaggatgctgttagaacctgaggcacaactgtcagctattcctttgacatactgtatttcatggtgacttgtgaacccgtatccattcctgaccttttttcatcacctcgtagtgcccaggaatgattgatgctcttgtcccaactgtcatctgtgaacttttggtagtttatcatgaatacgtctt

SEQ ID NO: 44942 - protein, 116 aa, Zea mays
  misc_feature: Ceres CLONE 1447975-F
  misc_feature (1)..(86): Pfam Name: Ras Pfam Description: Ras family
MKSFDNLNNWREEFLIQASPSDPDNFPFVLLGNKVDVDGGNSRVVSEKKAKAWCASKGNIPYFETSAKDGINVEEAFHCIVKNALKNEPEEELYMPDTVNVVGGNRVKDHQDAVRT

SEQ ID NO: 44943 - DNA, 763 bp, Zea mays
  misc_feature: Ceres CLONE 1447976-F
  misc_feature: Translation starting site: 175
  misc_feature: Pfam Name: SURF1 Pfam Description: SURF1 family
ctggagctccccgcggtggcggccgctctagaactagtggatcccccgggctgcaggaattcgcacgagaccattacctagaacatcctaatcgaaaacttcctcttcgctcccggcgccatcaccttcgggctcggcacatggcagctcttccggaggcaggaaaagatagagatgctggattacaggacgcggaggctggagatggagcccgtggcgtggaacgagtccgccttatcctcggtccttcgtgatccgtcagcactggagttccgaaaattgtgtgcgagggtgatttcgacaaggagaagtcggtattcatcgggcctcgctcccggagcatctcaggtgtcacggagaatggggtatatgtgatcactccatggattcctaggtcgacgcctgacagctggcagtcacctatccctgtggatagaggatgggttccctcgtgatggcatgataaaaacgtaaaggatcctcagatcctggatgagctttcaaacccccaaagctgttacccaaacaaaaaaggtcgggggggaatttttggctaaaagcccaaatcctctcccgggtttaaaaaccaggaaccccctggaagggtttttggaaaacccggggaaggaaaacccaaaaattttgttcccataggaccccaagggcgccgggttttgggggagtcccccaaaggccccgggttgggaccccccagaaaacttgttttttgaaaaaaaaagaaagttccccccacccctctctc

SEQ ID NO: 44944 - DNA, 697 bp, Zea mays
  misc_feature: Ceres CLONE 1447983-F
  misc_feature (268)..(268): n is a, c, t, g, unknown, or other
  misc_feature (374)..(374): n is a, c, t, g, unknown, or other
  misc_feature (408)..(408): n is a, c, t, g, unknown, or other
  misc_feature (425)..(425): n is a, c, t, g, unknown, or other
tggagctccccgcggtggcggccgctctagaatagtggatcccccgggctgcaggaattcgcacgagaccattacctagaacatcctaatcgaaaaatccctagctccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgccccctancgtcctaccttatcgcgcaccgctccatgggcccccagtgggccccaaagaaccttctttatccccccccatcccccgggctgccacctcatcaccccccagattnctgaaggaaaaaccaggggcaaacctgggccggncggttcaaagggggttntgggggattacttttcttagaaaaaaaggtttttgaactcacaaaattatgacttcgaagggaagtgaaacctggaactttcttaaaaaattttttcaaaggccccaaggtccctggaaaccacctgtgaaagagccgataactgccccccaattaaaactccccccaggttggggtgtcccccaaaaaattcctccaaagggaggagctctccaaaccggcctttggagggaaaaagggtttggaaaataacgaaaaacgccacccctccc

SEQ ID NO: 44945 - DNA, 735 bp, Zea mays
  misc_feature: Ceres CLONE 1447984-F
  misc_feature: Encodes the peptide sequence at SEQ ID NO. 44946
  misc_feature (524)..(524): n is a, c, t, g, unknown, or other
  misc_feature (531)..(531): n is a, c, t, g, unknown, or other
  misc_feature (600)..(600): n is a, c, t, g, unknown, or other
  misc_feature (617)..(617): n is a, c, t, g, unknown, or other
  misc_feature (618)..(618): n is a, c, t, g, unknown, or other
ctggagctccccgcggtggcggccgctctagaactagtggatcccccgggctgcaggaattcgcacgagaccattacctagaacatcctaatcgaaaaacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcaggctgatggcttctgttttcntctgctngtgagctactggagtcatggtactttggtcgttgggtttgtaccagacagcaagaactgtccagcttanttgtctgtcctcgcgtnnctgtcatagtacttcaacaaaggatgcatgcattgtgataaaaacgtttcagcaatgagtacgatattctcttttttttgaattttactccgactccgtcatattgctgcatgctga

SEQ ID NO: 44946 - protein, 91 aa, Zea mays
  misc_feature: Ceres CLONE 1447984-F
MALRALYNEIRSMKVRDVPAYLKPRLTWDNVKKSADQAVDRYIEKYIDTSSPDPLYHVCIGGMIFSYFVNLPWERAHLAHLEEMERTGGKH

SEQ ID NO: 44947 - DNA, 787 bp, Zea mays
  misc_feature: Ceres CLONE 1447987-F
  misc_feature (286)..(286): n is a, c, t, g, unknown, or other
  misc_feature (634)..(634): n is a, c, t, g, unknown, or other
ggagctccccgcggtggcggccgctctagaactagtggatcccccgggctgcaggaattcgcacgagaccattacctagaacatcctaatcgaaaaggaattcctgtgttcacgctagtactcacctctccccagtcaccaaacttcgcccctcacagaaacttgcacgccatcttcctgccagtggtgaccatagcagcagtttacatcctcaccatggccaagattcgtcggaggttgtctcggtcgtgtggtgcccgttccttgtcctcatagaattcccagngaagatgaaatttcagaagtagtttctaaaaaagagtttgctccagtgcctatttcagcagtggatggagctatctaactggttatggggaaggagggtcttgagcctcttcctgcaacaaaagggatgaaggagaacctcatggttcccggaggttgaagggcccttccatttcttaaaaagagaaatttgggcttttgataaacctttgggggggccccaccccccccgtattggtataaaatcgccccttaaaaaataacggcgcttgaaaaaaataaccccctccaatgaaaaacctcttttttaaaaaaaaaaaaaattttttaaaaaaaaaaaaaaaaaaanttttccctccctcccccccccgggggggggcccccccacaccccccccaaaaggagggaataacaccgccccccgcgcggcttttttaacacgggggagaaaaaaaaaacttttaccaaaaaataatgggggggaaacacccccctcccgggg

SEQ ID NO: 44948 - DNA, 726 bp, Zea mays
  misc_feature: Ceres CLONE 1447988-F
  misc_feature (415)..(415): n is a, c, t, g, unknown, or other
ggagctccccgcggtggcggccgctctataactagtggatcccccgggctgcaggaattcgcacgagaccattacctagaacatcctaatcgaaaaacaaactttcactctcctgcgcttgcgcaggctcttcttctcagatcccgactccaactcttcctctctccttcgcctggcacatcctcgacggcgcggcagcctgcttcttcaccggagcggcggcctgcttcttcgacgacgtggaggcctgcggcggcctaccgagcggacagatccgcggacgaacggatctccggcgcctggcagatcttcggagcgcggtctaccggttgtggacggatctccgctgcctggtgccctggtatatcctcggcgtcgcggcttgctttctcatcggcgccgtgacctgcatcancgaaagcacggcggcctgattcttcgaggtacggcggcctgccggtttttgtccaggaagacgacgtgacagcctaccagtcttctccaggcgagtggatctccagcgactctcgagctgcagcaagcaggcgtgccgtacttctcaaggcggtggatcttcaccgctcgatagctcttcttcacggggcggggactacggggggaggatctgcagccactccactgatctgtgctcgctgctcgcgactgagctcggagaacgatcggggacacgactcactgctttgctgtcgtgtcccagggatcagc

SEQ ID NO: 44949 - DNA, 750 bp, Zea mays
  misc_feature: Ceres CLONE 1447989-F
  misc_feature: Encodes the peptide sequence at SEQ ID NO. 44950
  misc_feature (376)..(376): n is a, c, t, g, unknown, or other
  misc_feature (479)..(479): n is a, c, t, g, unknown, or other
  misc_feature (553)..(553): n is a, c, t, g, unknown, or other
  misc_feature (729)..(729): n is a, c, t, g, unknown, or other
tggagctccccgcggtggcggccgctctagaactagtggatcccccgggctgcaggaattcgcacgagaccattacctagaacatcctaatcgaaaaagtctctcgcccctctctcccaccccgcagccgccgcgcaggtagccctagcacccgcgacgagcaggacctgcccagttgctctttgagtagttcccccaactgtcaccatgcagaacgaggagggtaagactgtggacctctatgtccctaggaagtgctcggccacaaacaggatcatcactgccaaggaccatgcctctgtccagatcaacattggccacttggatgcgaatggcctgtatgatggtcacttcacaacgtttgctctctctgggnttgtccgtgctcagggcgacgcagacagctccttggacaggctgtggcagaagagaaagctgatatcaagcagtagattttacatctagtttaccaagattgnacactgccttagctatgttttgaatcatgtcactatatgcaatgttgtgatttcagctggtactttaatctgangatttagtatctttggtggggtcaaaaaaaaaaaaaaaagcttatcgataccgtccacctcgagggggggccccgtacccaattcgccctatagtgagtcgaattacgcgcgctcactggccgtcgttttacaacgtccggactggaaaaacccctggcgtaccccaacttatcgnctgggaacaaatccccctttt

SEQ ID NO: 44950 - protein, 85 aa, Zea mays
  misc_feature: Ceres CLONE 1447989-F
  misc_feature (1)..(81): Pfam Name: Ribosomal_S21e Pfam Description: Ribosomal protein S21e
  misc_feature (57)..(57): Xaa is any aa, unknown, or other
MQNEEGKTVDLYVPRKCSATNRIITAKDHASVQINIGHLDANGLYDGHFTTFALSGXVRAQGDADSSLDRLWQKRKLISSSRFYI

SEQ ID NO: 44951 - DNA, 782 bp, Zea mays
  misc_feature: Ceres CLONE 1447992-F
  misc_feature: Encodes the peptide sequence at SEQ ID NO. 44952
  misc_feature (398)..(398): n is a, c, t, g, unknown, or other
  misc_feature (403)..(403): n is a, c, t, g, unknown, or other
  misc_feature (687)..(687): n is a, c, t, g, unknown, or other
catttctagtggatcccccgggctgcaggaattcgcacgagaccattacctagaacatcctaatcgaaaaaacggacccccattcgcatctgcctccttttccttggagccgaacaagagggaaaggaagggaggacagccgccgccgccgccgccgccgccaccgtcaggatgcattccacgaacctcctgctcgaggagcccatccggatggcctccatcctcgagccctccaagcccagctacttcccggcgatgaccaagatcgtcggcactctcggccccaagtcgcgctccgtcgacacgatctccgcctgcctcaaggccggcatgtccgttgttttgatccatttcgggtggggggaagccgggatataggatccaaccccgcgcagccncaagntctccatcaagcccccaaagaacctctgccctgtcatgccccgacaccaagggccccggagctgccggggggggaaacaagagcgagacccccaatcttccctcaaggaagaatgggacgggacgtttttcaccccttccccgggggccaaaaaagccctcctccaagctttgttggcccatcaactttctctggaactccgccaagggggggggcccccagggggcaagcaaaattccgggggaaacaaactttgttccactaggctgttgaaaaccccctcnaatttgggtttagaggttccttaatgtccaatgggagttgattggggcggggacaaaatcaaagaacgacgccccctttgtgctgggcccactgg

SEQ ID NO: 44952 - protein, 68 aa, Zea mays
  misc_feature: Ceres CLONE 1447992-F
  misc_feature: SWISSPROT Homolog: EC 2.7.1.40 Pyruvate kinase
MHSTNLLLEEPIRMASILEPSKPSYFPAMTKIVGTLGPKSRSVDTISACLKAGMSVVLIHFGWGEAGI

SEQ ID NO: 44953 - DNA, 772 bp, Zea mays
  misc_feature: Ceres CLONE 1447993-F
  misc_feature: Encodes the peptide sequence at SEQ ID NO. 44954
  misc_feature (392)..(392): n is a, c, t, g, unknown, or other
  misc_feature (404)..(404): n is a, c, t, g, unknown, or other
  misc_feature (418)..(418): n is a, c, t, g, unknown, or other
  misc_feature (419)..(419): n is a, c, t, g, unknown, or other
aagctggagctccccgcggtggcggccgctctagaactagtggatcccccgggctgcaggaattcgcacgagaccattacctagaacatcctaatcgaaaaacacggcacacacacaaccaccggcccttctctcctcggctcacccagcaggccgcgccggatgctcatggccgcagccacgcactacttgggcggatcagcccactcctcctccaccacctcctcctccatctcgccatcgccgccgccctggcacccggtcctagtcgtacccagcaaccagcgccaggccgtcgtctacgacctaacggaagacctcgccacgccgccgtccccgtccccgtccccgtcaacgaccccgcagcacctccgccccgcgtcccggcgggncgcgggggaagncgcgcccgcccccnnccgtcgggaagctgcccaccactaaatcaacgccgaagccgcccagttccggggaatggtgaacaaggggacgggggccgggttcgggcccaaattcaacccggggaccagggacagagaaaaatgttttgccccccgggcccccctcccgccttgtgttttcaacggaacaacaaacctgggggccaacctggaaaccccggtgttcctcctcacccccggggggggggggggtttgggagagctttttccaagccctcggggtgggaaaaaaaaaaactcttggggggggccgcccctccaaaaaaggaagagagaagaaaattttttactccccggggtttgttccaatt

SEQ ID NO: 44954 - protein, 93 aa, Zea mays
  misc_feature: Ceres CLONE 1447993-F
  misc_feature (77)..(77): Xaa is any aa, unknown, or other
  misc_feature (81)..(81): Xaa is any aa, unknown, or other
  misc_feature (86)..(86): Xaa is any aa, unknown, or other
MLMAAATHYLGGSAHSSSTTSSSISPSPPPWHPVLVVPSNQRQAVVYDLTEDLATPPSPSPSPSTTPQHLRPASRRXAGEXAPAPXRREAAHH

SEQ ID NO: 44955 - DNA, 784 bp, Zea mays
  misc_feature: Ceres CLONE 1447994-F
  misc_feature: Encodes the peptide sequence at SEQ ID NO. 44956
ggagctccccgcggtggcggccgctctagaactagtggatcccccgggctgcaggaattcgcacgagaccattacctagaacatcataatcgaaaatcatcaacgagaggtagacaaggctctacagagtatggaggaggaagctgaacgcgtattccaggatgaacgagtgttacttcatgaagatggagctgcttcagcaagagatactatgtatgaacaagcagaagttgtggagcatgaactgcaacatatgacagaacaagtaaaatccatcattcagactatgaatgctactcaagggtggtgagctcgagtccgctgatagtatgacaccatttgatgttgctgtccgaatactggataatcaactgccttccctgatgtggaatgatgaaaaggttaatgaccccccctcggaggaagtagggagggctgtctaaccacaccctttcaaccggaacgtgactcctggaattcccagggttttggttaacctgaataattcccccgcattttcctgggggctctaaatcggggttttagtaaaaccttccttcgcttgggtaatccgccaacccccaccgggaaaggtttgggggaaattttcccccccggtaaaagccctttggggccaagggacctcaccccgggtcccacccggagaggggccccttatggggggcccttgggccccctcttccaagagtttctatttgtttaaaacacgggggcggaatagcgcgggggggtgaaaccatgggggggagcccttcttaacaac

SEQ ID NO: 44956 - protein, 59 aa, Zea mays
  misc_feature: Ceres CLONE 1447994-F
MEEEAERVFQDERVLLHEDGAASARDTMYEQAEVVEHELQHMTEQVKSIIQTMNATQGW

SEQ ID NO: 44957 - DNA, 742 bp, Zea mays
  misc_feature: Ceres CLONE 1447996-F
  misc_feature: Encodes the peptide sequence at SEQ ID NO. 44958
  misc_feature (410)..(410): n is a, c, t, g, unknown, or other
  misc_feature (449)..(449): n is a, c, t, g, unknown, or other
  misc_feature (463)..(463): n is a, c, t, g, unknown, or other
tccccgcggtggcggccgctctagaactagtggatcccccgggctgcaggaattcgcacgagaccattacctagaacatcctaatcgaaaaagtccccccacacctggatccatcgggtcggaggccatggcgacggcgaggctccgatcctcggcctccctccgcggggctctcctccgccacttctccgttggtcccgcctcgactccgcgcgccgtctcccgggtcccagatttccaggttcctcagtctattatgtggaggcattttgcaacgtccaggcctaattctcttgcaagacgcgacaactttggtctgatggcctgtttgcacgctcagatacgatgcgcttcgcaggctgctgctgtgaaagaaaccgaatccagtagcagcaagataagcatcgggncccaaaccaaaacagatcaagggagatgacgaggatgcntacctggtataccnaggggcaatatcatcgacccataagaaagtggagcttctctccctgttcacctgctgcctctccgggtctcgggggccagtgaaaacattcatgacttcgcctgattgaatgggatcctcagggaagggttggctcaccgttcattttcttaggccccttaccgtgggaggttaatttggttcgggagcccaaatttccaaacttcgggggggccctggtccagaacttttgggccaaggagagaaggggtactcccccctcaaagaggggaattttgc

SEQ ID NO: 44958 - protein, 103 aa, Zea mays
  misc_feature: Ceres CLONE 1447996-F
  misc_feature (95)..(95): Xaa is any aa, unknown, or other
MATARLRSSASLRGALLRHFSVGPASTPRAVSRVPDFQVPQSIMWRHFATSRPNSLARRDNFGLMACLHAQIRCASQAAAVKETESSSSKISIGXQTKTDQGR

SEQ ID NO: 44959 - DNA, 768 bp, Zea mays
  misc_feature: Ceres CLONE 1447999-F
  misc_feature: Translation starting site: 173
  misc_feature: SWISSPROT Homolog: EC 1.11.1.15 Peroxiredoxin
  misc_feature (429)..(429): n is a, c, t, g, unknown, or other
ctggagctccccgcggtggcggccgctctagaactagtggatcccccgggctgcaggaattcgcacgagaccattacctagaacatcctaatcgaaaattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagcaagggtgtagacgagatcctgcttatcagcgttaacgaccccttcgtcatgaangcgtgggcgaagaactaccccgagaaacagcacctgaaagtccctcgccgaacgatctggagcgtacacaaggcgctcgacctccagctcaatcctccggacaaagggctgggcgtgcgcctcaaaaagtttccttccctggccaaagaacctccggttaccgttcaaaaattcgggaaaggggggaattcccaaatcccgggggtagaggaaacctgaaaggcctttaaaactccccttcccctaaaaccccgaaacaaaacgggctaaattttgaacccccctttaaaaattggccgggggaagggtaatttgggggttgtggaagaacgccccccc

SEQ ID NO: 44960 - DNA, 730 bp, Zea mays
  misc_feature: Ceres CLONE 1448001-F
  misc_feature: Translation starting site: 159
  misc_feature (296)..(296): n is a, c, t, g, unknown, or other
ctccccgcggtggcggccgctctagaactagtggatcccccgggctgcaggaattcgcacgagaccattacctagaacatcctaatcgaaaactcttcggtcaaaaatatccttgtacctgcatctcgacctcaccggcgtccggcggtggtatcacgatggtggcgttgctgggccggcggatcggggtggctgcggcagctgccgcgttcatcgcctcgtggcgttcggatccgcctcatctcgcccaagtccttcgtgaagtcaccgtctccgcccacgacgtcgtcatcttnctcaagtcatactgcccgtactgcaaaagaagcaagggccgtgtttaaggagcttgagtcgaacaaagagccatatgttgtggagcttgatcagcgagaggatggctcaaagattcaggatgccttacttgaaatagttggcaagcgtactgtccctcaagttttttgtccatggaaagcacctggggtggttctgacgatactgttgactccctacaaagtgggaaaactggctaaacttctaaacatcggagtcaaagacgacctttgagtgacttgctaaatccggccagccctgttcttttgggttcaacccgaaccgggttcaaaaacttcaatatgggttttggccccaaggggtacacctcccccagtctaaatagctgattttaaccccaaggaaagtcccaaaagtttcttgttttgaattacag

SEQ ID NO: 44961 - DNA, 745 bp, Zea mays
  misc_feature: Ceres CLONE 1448005-F
  misc_feature: Encodes the peptide sequence at SEQ ID NO. 44962
  misc_feature (348)..(348): n is a, c, t, g, unknown, or other
  misc_feature (567)..(567): n is a, c, t, g, unknown, or other
  misc_feature (590)..(590): n is a, c, t, g, unknown, or other
  misc_feature (599)..(599): n is a, c, t, g, unknown, or other
  misc_feature (623)..(623): n is a, c, t, g, unknown, or other
  misc_feature (626)..(626): n is a, c, t, g, unknown, or other
  misc_feature (716)..(716): n is a, c, t, g, unknown, or other
ggagctccccgcggtggcggccgctctagaactagtggatcccccgggctgcaggaattcgcacgagaccattacctagaacatcctaatcgaaaaatctcgaactccgaaacaaagcaatcacccgagcaaagcagtgcggagagacgatccagcggcatttcgcattcgacgaacgaagcgccgccatctgatccgacacgcagcgcaatggcggcgggactgaagaggccgtcgttcgggacgcgggcgtggcggctgctgcggctggcggtgctgtgggcgcggaagggcggcgcggcgcacagcctgcgcctgcgcctgctccgcacgctccgccgccacggncacggcctcgccggcctgggcggcgcgcgcggcgaccggctccgctgcggcgagcgcgagtactccatcgacgagacgccgggcgtccgggttccgcaccccgtccgcgcgcgtgctccgcctcatcccctgcatcgcgccggccgtgccggacacgccgggcctctacggcgacgaccgctacttcttcagcgccgccgccgccgcgtgggaaacggncgaaggcgccgggtgctgctacngcgacgtcnacgatgatgagggaggagacgacnaanagccaaactgctgcggcgatggcaagatgctgctggaacgcgtggtggccgaggcctgccccgcgagctccgccggacggttcgtggcancggacagcggcgaggacccccgggtggac

SEQ ID NO: 44962 - protein, 131 aa, Zea mays
  misc_feature: Ceres CLONE 1448005-F
  misc_feature (127)..(127): Xaa is any aa, unknown, or other
  misc_feature (130)..(130): Xaa is any aa, unknown, or other
MAAGLKRPSFGTRAWRLLRLAVLWARKGGAAHSLRLRLLRTLRRHGHGLAGLGGARGDRLRCGEREYSIDETPGVRVPHPVRARAPPHPLHRAGRAGHAGPLRRRPLLLQRRRRRVGNGRRRRVLLXRRXR

SEQ ID NO: 44963 - DNA, 616 bp, Zea mays
  misc_feature: Ceres CLONE 1448011-F
  misc_feature: Encodes the peptide sequence at SEQ ID NO. 44964
  misc_feature (233)..(233): n is a, c, t, g, unknown, or other
  misc_feature (585)..(585): n is a, c, t, g, unknown, or other
  misc_feature (599)..(599): n is a, c, t, g, unknown, or other
ggagctccccgcggtggcggccgctctagaactagtggatcccccgggctgcaggaattcgcacgagaccattacctagaacatcctaatcgaaaaaccttcacttggccgtcctcccgagctgcggcggccgcatcgattgctagggtgaaaatccgttctcccggcgattttgggctctcgggaacagacaggaggatccgcgggaagggatcggctgcgtcctagtgtantggtcaactgggctggggcgccaggaaaaccgccctcggactgggcgaaatttcctccaacaaagggcgtcccggtgaaaccttccccgggttttcaatacccgttcaacccccgagagggggggggccccgggaaccccaaattttcccccccctaaaaggggggggcgaaatattaaaccccccccccctctggggggggccctttttttttaccccctcccttgggggggggggggagaaaaaacccccgggggggtttttaccaccactaattataacccccccccggggggaaaaaaaaaacccccccctttttttttcgacgaggggggggggggggggtttaaancccccacaaaaaanaagcccccccccccccc

SEQ ID NO: 44964 - protein, 75 aa, Zea mays
  misc_feature: Ceres CLONE 1448011-F
GAPRGGGRSRTSGSPGLQEFARDHYLEHPNRKTFTWPSSRAAAAASIARVKIRSPGDFGLSGTDRRIRGKGSAAS

SEQ ID NO: 44965 - DNA, 725 bp, Zea mays
  misc_feature: Ceres CLONE 1448012-F
  misc_feature: Encodes the peptide sequence at SEQ ID NO. 44966
ggagctccccgcggtggcggccgctctataactagtggatcccccgggctgcaggaattcgcacgagaccattacctagaacatcctaatcgaaaaagtgctgttcccctctctcttccccgtcctgcaggctccaggcgctgctgctctcgtcctccgctagcgagcgaatcgctgacgctggcccgacgccgcggcgggaggtatctcgctttcgatcagcgacggcgcgcccggatcgcttgatctgacggagtttctatctaggattttggttggggcgtcgttctccggtgcttatctcatttctatttatcggtgcctcgggttcacggccaaattcgctgctgcgtggggctttgcacattggagccgattccttaagtggcggtggcaccgtctggcgccaccatgagcttcgtgttccgaggagcaggcccgacatcgaggccggtgggctcacagggttcgcccccgagcgccgcaacatgcgaattcatgcagggagcaggccggtgaatagcatttcctgggtttttcttccaactggttttggttttgtcatggaactaaactcccaccgatgtctccccatcttttgctttggataggcttgggagccttctaatggcccccagcctttaaatgtatgccacgtgcccgcaagcttgctcatgctgcagctgccaacagtttttctggcccccactgagctgcctgggcag

SEQ ID NO: 44966 - protein, 40 aa, Zea mays
  misc_feature: Ceres CLONE 1448012-F
MRIHAGSRPVNSISWVFLPTGFGFVMELNSHRCLPIFCFG

SEQ ID NO: 44967 - DNA, 720 bp, Zea mays
  misc_feature: Ceres CLONE 1448015-F
  misc_feature: Encodes the peptide sequence at SEQ ID NO. 44968
  misc_feature (457)..(457): n is a, c, t, g, unknown, or other
  misc_feature (483)..(483): n is a, c, t, g, unknown, or other
  misc_feature (512)..(512): n is a, c, t, g, unknown, or other
  misc_feature (513)..(513): n is a, c, t, g, unknown, or other
  misc_feature (544)..(544): n is a, c, t, g, unknown, or other
  misc_feature (609)..(609): n is a, c, t, g, unknown, or other
  misc_feature (611)..(611): n is a, c, t, g, unknown, or other
  misc_feature (612)..(612): n is a, c, t, g, unknown, or other
agctccccgcggtggcggccgctctagaactagtggatcccccgggctgcaggaattcgcacgagaccattacctagaacatcctaatcgaaaaaaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacggaatgcagctccgggcattcccggtgcgagacggggagcgcagcgccggcgacggtggtgcagctggntgtgcacgcggaggggcaggacctgncgtcgtacagcgtgagcctggtggacggnntcaacgtgcccgccgtggtgagcccgcagcngtgggcggcgggcagtgcccggccctggggtgcgccgcggactcaacgccgggtgcccgcctcgnannccgtgccgggggccgggccgccttgttgcttcaaggccccccgtctactcaagagcgtgccgctgaccccacacgccacgactggagcggtcccaccgtgcttgcccc

SEQ ID NO: 44968 - protein, 195 aa, Zea mays
  misc_feature: Ceres CLONE 1448015-F
  misc_feature (34)..(195): Pfam Name: Thaumatin Pfam Description: Thaumatin family
  misc_feature (108)..(108): Xaa is any aa, unknown, or other
  misc_feature (117)..(117): Xaa is any aa, unknown, or other
  misc_feature (127)..(127): Xaa is any aa, unknown, or other
  misc_feature (137)..(137): Xaa is any aa, unknown, or other
  misc_feature (159)..(159): Xaa is any aa, unknown, or other
  misc_feature (160)..(160): Xaa is any aa, unknown, or other
MAGTAKTPVLGFLLALALVATSTPAAATTLTLHNLCPYPVWPLVSPNTGFPAISENTGRLDGGGRGLVSFRFPDSFWAGRVVARTECSSGHSRCETGSAAPATVVQLXVHAEGQDLXSYSVSLVDGXNVPAVVSPQXWAAGSARPWGAPRTQRRVPASXXVPGAGPPCCFKAPRLLKSVPLTPHATTGAVPPCLP

SEQ ID NO: 44969 - DNA, 734 bp, Zea mays
  misc_feature: Ceres CLONE 1448016-F
  misc_feature: Encodes the peptide sequence at SEQ ID NO. 44970
  misc_feature (312)..(312): n is a, c, t, g, unknown, or other
  misc_feature (388)..(388): n is a, c, t, g, unknown, or other
  misc_feature (734)..(734): n is a, c, t, g, unknown, or other
tccccgcggtggcggccgctctagaactagtggatcccccgggctgcaggaattcgcacgagaccattacctagaacatcctaatcgaaaaacccagctcctctccagtctcaacccagcccgcctctcgaacttccagaaccgtcctctcgctgcctgcggctgctatctctgtcatctagaggagagtgtaagggcactagatagagagtgatggcttctcctgatccatcggcggcagatgccggcaccgggggcgagtcgacgagccaggcggcggccgtggaaccgatccggatgccgacggtggangagatcaaggggcaggacatctggaacaactgcgccgttcgcagcgtcgtcagtggcgtcatgggaggcggtcttngtgtgcttatgggactatcctttggagctttgaaaatcccgatatggcagagcaaatgacagccaggcaacaatagtatacacagcaaagcagatgggtagtagaggtataagtaatgcccaaacctttgcagtcatgggtctgattttctcacagctgaatgtacatagaggaggtcgggccaagctgatactaccattccgccgtagctggctgtgccctggaggaacttaactggaaaaggggccctaaactacatgctttggatgggggggttgcttgcttcccaggggcattgaaattctttaaccgctacttgaaagggggtttgaatttggaacttttn

SEQ ID NO: 44970 - protein, 77 aa, Zea mays
  misc_feature: Ceres CLONE 1448016-F
  misc_feature (33)..(33): Xaa is any aa, unknown, or other
  misc_feature (59)..(59): Xaa is any aa, unknown, or other
MASPDPSAADAGTGGESTSQAAAVEPIRMPTVXEIKGQDIWNNCAVRSVVSGVMGGGLXVLMGLSFGALKIPIWQSK

SEQ ID NO: 44971 - DNA, 795 bp, Zea mays
  misc_feature: Ceres CLONE 1448018-F
  misc_feature: Encodes the peptide sequence at SEQ ID NO. 44972
aagctggagctccccgcggtggcggccgctctatactagtggatcccccgggctgcaggaattcgcacgagaccattacctagaacatcctaatcgaaaactagcccgctacccctgccccttctctcttcgtcgcgcctccgcctccgccgtcgtagcatcctcctccgccacctcggccatggcgacatccccagcgctcctcttcccttctccctcctcggcatcctctgcgccttcgtcggcgcgggtggaggcagtggtgcttttcaacgtctgcgacagctacgtgcggcgcccggaccaggcggaccgcgtcatcggcaccctcctcggttccctcctctccgacggcaccgtccaggtacgcaactcttatgtcgtcccccacagcgagtcagccgaccaggtcgccatcgacatcgactaccaccataacatgtacgcctcgcaccagaaggtgaaccccaaggaggtcatcgtcggatggttctcgactggattttgttgtttctggggggaatacccctcatcccccagttctattccaagggaagtaacaaaacccccatcaatcttaacagtccaccctgggcttcccctaggggggaaggctttccatcaaaggcctacattctcatcccaattctgtccctccagagaaagtcaaacttccctgccaaattttcaggaaaatccctcctggaatttaaaaataaattgaaggccgaaaaaggctgggaattttaaattccttacaaatctccctattgggaaaaaaaagcttcccccatg

SEQ ID NO: 44972 - protein, 180 aa, Zea mays
  misc_feature: Ceres CLONE 1448018-F
  misc_feature (17)..(117): Pfam Name: Mov34 Pfam Description: Mov34/MPN/PAD-1 family
MATSPALLFPSPSSASSAPSSARVEAVVLFNVCDSYVRRPDQADRVIGTLLGSLLSDGTVQVRNSYVVPHSESADQVAIDIDYHHNMYASHQKVNPKEVIVGWFSTGFCCFWGEYPSSPSSIPREVTKPPSILTVHPGLPLGGKAFHQRPTFSSQFCPSRESQTSLPNFQENPSWNLKIN

SEQ ID NO: 44973 - DNA, 759 bp, Zea mays
  misc_feature: Ceres CLONE 1448020-F
  misc_feature: Encodes the peptide sequence at SEQ ID NO. 44974
  misc_feature (473)..(473): n is a, c, t, g, unknown, or other
  misc_feature (478)..(478): n is a, c, t, g, unknown, or other
  misc_feature (479)..(479): n is a, c, t, g, unknown, or other
  misc_feature (624)..(624): n is a, c, t, g, unknown, or other
  misc_feature (634)..(634): n is a, c, t, g, unknown, or other
  misc_feature (651)..(651): n is a, c, t, g, unknown, or other
  misc_feature (658)..(658): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaagccgcctcctccccactgcctcgtgtggccgtcgtctcccgttcggaacgccaagccccccctccggcgaaatggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaangaaannactgtgagtcgaagaaaccaattgttgtgaagtatgggcttaaccatgtgacttacctcattgagcagaacaaggctcagctttgtgtcatcgctcacgacgtggatccgatcgaactttgtgtgtggctcccagccctgttcangaagatggangtcccttactgcattgntaaaggnaaggctcgccttgnatcgattgtccacagaaagatgcatcagtcttgtgtcttacactgtcaagaacgagaatagctggagtccgcaagattttggaagct

SEQ ID NO: 44974 - protein, 186 aa, Zea mays
  misc_feature: Ceres CLONE 1448020-F
  misc_feature (97)..(181): Pfam Name: Ribosomal_L7Ae Pfam Description: Ribosomal protein L7Ae/L30e/S12e/Gadd45 family
  misc_feature (101)..(101): Xaa is any aa, unknown, or other
  misc_feature (102)..(102): Xaa is any aa, unknown, or other
  misc_feature (103)..(103): Xaa is any aa, unknown, or other
  misc_feature (151)..(151): Xaa is any aa, unknown, or other
  misc_feature (154)..(154): Xaa is any aa, unknown, or other
  misc_feature (160)..(160): Xaa is any aa, unknown, or other
  misc_feature (167)..(167): Xaa is any aa, unknown, or other
MDKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEXXXCESKKPIVVKYGLNHVTYLIEQNKAQLCVIAHDVDPIELCVWLPALFXKMXVPYCIXKGKARLXSIVHRKMHQSCVLHCQERE

SEQ ID NO: 44975 - DNA, 749 bp, Zea mays
  misc_feature: Ceres CLONE 1448024-F
  misc_feature (584)..(584): n is a, c, t, g, unknown, or other
aagctggagctccccgcggtggcggccgctctagaatagtggatcccccgggctgcaggaattcgcacgagaccattacctagaacatcctaatcgaaaatcatccgctgttgggagcttgcaatcttccaggaacgttttttttgtgctagccgagagagaatcaagaggaagagagagagaaaaccatgcaccatggcctgacaaccggtgtcgcggggtgtgaagctcgccgaacttgggtcgtctggcgctgcttgtccacggcgtgggggctgccgctggccgtgggagctctttgctcgggcgccgtcgttcgatcgtgtggcagacgggtgcaagtggtgggtggtgcccaatgtgcagttggctgtctggggctgctggtcagcccgtgggttgccatcctccaactgggatctctgcgcgatcacccgcgctcggccgagccgtggtctggagcgaccacgtggcgaggggactggacatcggagtttagagcgtcctcgtgatctaagcggcacggtcggtcaactctgcttccatcgacggtcaagacaggtaccgcaggatgaggcgcttgnaggatgctgccatgtgttcctgagaggctaggccgtcgtctcccagtcaacttggggttgctggaccgttgtccccctatatttaaataattaatttggaaagaattccgttatgtaaaaaagatgtgaaatccgatcctgtgtcaaaaaaaaaaaaaaaaactt

SEQ ID NO: 44976 - DNA, 769 bp, Zea mays
  misc_feature: Ceres CLONE 1448028-F
  misc_feature: Encodes the peptide sequence at SEQ ID NO. 44977
  misc_feature (238)..(238): n is a, c, t, g, unknown, or other
  misc_feature (404)..(404): n is a, c, t, g, unknown, or other
aagctggagctccccgcggtggcggccgctctagaactagtggatcccccgggctgcaggaattcgcacgagaccattacctagaacatcctaatcgaaaaaagcgagagaatggctgggaggctaaccgcggcagggtcccgcatcctgggcggcggcggcgcacgcgccgcggcttccgccctccgacaccgcgccggcatgggcctccccgtcggccgccacatcgtccccgacnagccccctcccgtgaacgacgagttggtatgggataacggcacgccctttccggaaccctgcatcgaccgccttgccccgcacatcggcaagtacgaggcgttggcgtggctgtgcggagggctagggttcttcgctgccctcggtatgggctgctgttgtaaacnacaaggcctccaatataccatatactcccaaagtctacccgtacgacaacttgaaagctgaccttggtgaaaaaccaaagaaagttttttggccggttgacaaggccactttgatgaaaataatctgagatctatatctccttttcatcagaaaagaacaggggggaacttatttaccttggtttttttgggactgccttggtttaaacccaccgtattggatttgcctaaatattggaaaacatgggtttccctcacataaagcaccaccctctaaacctatttccgataaaaaaaaaaaaaaaaagtttattatatccgcccaaccttcggggggggccccgtaccccatttccccccatagg

SEQ ID NO: 44977 - protein, 117 aa, Zea mays
  misc_feature: Ceres CLONE 1448028-F
  misc_feature (43)..(43): Xaa is any aa, unknown, or other
  misc_feature (98)..(98): Xaa is any aa, unknown, or other
MAGRLTAAGSRILGGGGARAAASALRHRAGMGLPVGRHIVPDXPPPVNDELVWDNGTPFPEPCIDRLAPHIGKYEALAWLCGGLGFFAALGMGCCCKXQGLQYTIYSQSLPVRQLES

SEQ ID NO: 44978 - DNA, 785 bp, Zea mays
  misc_feature: Ceres CLONE 1448031-F
  misc_feature: Translation starting site: 207
aagctggagctccccgcggtggcggccgctctatactagtggatcccccgggctgcaggaattcgcacgagaccattacctagaacatcctaatcgaaaaatcacaagctgtcacaaactcagcacacaatcacactgacacacacaccaccaccacggcaccgctagtgagaagcggagcgggaggacacgcggcgcgtagtgcgatggctcgtgcgctcggcgcttgcgtgctgctcgccgtcctgctcggtgccctggcgccggcggtggccgagcgcgcccacgactaccagcgtagcggagccggcatactgcacccaagcggccagtaccgcgggaggacagtgtgggtcacgactgatgtgcgggacacgaagggcgacggagaggttgcagaaataggccggcaacggccccccaaaacaacacggaaatccgataaggtgctgctggtgaccgcaggctcgagtcctgcaggctggtgccggcacatcgaaaggtggtgtcagggatcaagtactacctccgcgtcttgcccatgcaggagggcggttcgtgtaacggaggagagcgggtgttcaacgccgtcgttcaactacaagccctgggtcgactaggcccccctggttccggttcgtgcccggtggccgtcaaataagccgcgattctaccggcgggggtaaaccgtctagggttagtattttctgggtctgccctttctgcgaattccatcggtacggcttaaaaaaaggccctgggggtgcttggttttaaccgcaacc

SEQ ID NO: 44979 - DNA, 767 bp, Zea mays
  misc_feature: Ceres CLONE 1448032-F
  misc_feature: Encodes the peptide sequence at SEQ ID NO. 44980
  misc_feature (560)..(560): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaacgcgtatcttcgtccgccgcaacccttcacgtatcgtctctctctcacacggtcacaccctgacctcccccctccccctcccagaaaagacccctcgaaaaacggcggcgctgcgacatggcggaggtcgaggctccagctactgcggtcgaggctccagctgctgcggtcgcgacgacgacccctgaggtggcggcgcccgaggccggagccgctacggaggcgaagggtccgcacaagcttcaccggcagtggaccttctggtacgacatccagacgaagaccaagtccggggctgcgtggggcacctccctcaaaaaggcctacaccttcgacaccgttgaggagttctggagcatgtatgatcagatttttcgtccaagcaagttgtctgggaatgctgattttcatctattcaaggctggagtagagccaaaatgggaagacccagagtgtgncaatggtggcaaatggactgtccccatgcacagaaaggcaacctttgagaccatgtggctttgaaacgttgatggctcttattggggagcagtttgatgaaacagaagacattttgtggaatttgtgctagtgtccgtgcaagagagatnagctgccattatgggactagactgccagcaatgagctgtccagttaaacattggcag

SEQ ID NO: 44980 - protein, 134 aa, Zea mays
  misc_feature: Ceres CLONE 1448032-F
  misc_feature (14)..(135): Pfam Name: IF4E Pfam Description: Eukaryotic initiation factor 4E
  misc_feature (114)..(114): Xaa is any aa, unknown, or other
MAEVEAPATAVEAPAAAVATTTPEVAAPEAGAATEAKGPHKLHRQWTFWYDIQTKTKSGAAWGTSLKKAYTFDTVEEFWSMYDQIFRPSKLSGNADFHLFKAGVEPKWEDPECXNGGKWTVPMHRKATFETMWL
